United States Patent 6,812,339 (POLYMORPHISMS IN KNOWN GENES ASSOCIATED WITH HUMAN DISEASE, METHODS OF DETECTION AND USES THEREOF) - sequence listing, part 80

SEQ ID NO: 17398 - DNA, 139150 bp, Human
gagatcactccactgcactccagcctgggcaacagtgtgagactccgtctcaaaaaaaaaaaaaaataggccactgaggatgagagcactgctcagtatggcactactgggattccagcccctttagtggccagggcatcatttgcatctcagtttcctcacatgcaaaatgggctatttgcagcctgatgggaaggggatgagaaggtccgctgggtccaagggaccaggatggcaggaggttagcaaggcctgcagagggcagcagtgagctgcgcaccgcccacccagcctagaaactggggcccatgggttttccagggcaggaatgttctccaggggcactaatattaacaggcaatcacgaaatcgacccctacacaccatttatcaggttgtgttttatgtttgccccatctgggcattttatgcaggatgctctcaacattttgtaccgtggcccacaggactgggtggaagacaggacagctcagagcagggagtgaaacaaaatctttgatggttctctagggaagcctggaaatctgagacagggcaaagagcagggagtctgatgagcacaaaattaaaatacccaaaccagcctgccgggtcaggggaaaaggaagcaggattgggcacatgaagaacagatgacaaaactgaggctcagagaggctgagagagacactgctgaggtcacacagccaggagtcggcaggaagccctgaacccaagcagggctggcctggctactagcctgggctcagtcctttagattggacttcaaagtatctgctccagatgacgctggcattgggaggagggcatgataatccctaacatccacacagggacaacagcacttggaggcagatgtgcttctcacttcaaggaaactgaggcagagagggagaggtggtcaggactcaagcccagtaattcatttgccaaatcctgtttccttttcccccaacccagcgggctggtttgggtattttcagtttgtgcccatcagagtccctgcagagtgctctccactgtgtctcagatctctgtgtccccagagaaccatcaaaggttttgtttcactccctgctctgggctgtcttccacccagccctgtgaacctcagtgcaggttggccgcccccttagagggaggctaatcagggaagttctgagtcaggtcgtcctggaaaaactacattgacctctggagctcaagagaggccaggggacaaacacatggctcagcacacaggaaggcaggtgtgggtattgagtgacctgagggagaaatccctatttatcatccatcatgtggtcctgctgtgacaaacccgtgtggcagccacccacagcagatccacaacgtgagaggcccgctgaaacaagggtgctggcattggttactcagcctggccctccctgccttgcggggtgacctgcctggtcctggcctctctgtgagttgggccctgctgggtggtccctagtgtgcccagccctgaggctggtgagaggccaggctgtgaggtgtgaggaacttacctgcgtctccatggaaggtgccctccgcatcgttgggccagatctgcctggtcttgcagatgcccacgatggtggcctctgacacgacgactgggcagtgccggtgacgcttatggcactgcggcgtggtaggggcagaggggggaggttgcttctgtcggaggactgctgcgagttctgccagagagagcagctcttgtcccggaacatgaggtaggtggtggggcttggggacacgcggctggactggccggagaagtcctcctggccggaggggagccaagtgttcctgttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgagttcctcacgccacgtgcgtgggcacacctgcacgggggaggaaaaccatagacgagtaggggatacaaaacagaagttgggagggaggagtggatagttttgagtgtatcaggtgcacttgtggttcacgcggatcctgcacccgaacaaactccatcccctcctccttcctgaatgcatactgttagtgtttggaatggaattgggttgaggatggtcttgtgagggatgggaggtggtttgttcctttggttctagagcaatgtgtttgtgaagtacagcttgtgagttgaaggaagatgcttcaggcagtaacctccttgctatgtgctctctccatgccgggcagtgaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattggggtaaggaaagggtgggctggggtgtgtgtgtgaggctgtcgggaatcttttggagtcctggtccctgttaagctcatctggttttctgcttcattgatttttctttttctgctgatggaggagttgaatgtgcttggtttgtcaaaatcctcttcaaacgagtgaggctatttttggctcttagagctgctgcctttttgtggtgggcactctgtcctgtttgtgttaggtacttccagttactgatcttccatttgcagctggggtttcctgtggtgcacggctccgacctgccgtctggccgggctgcattccctaagtccctatgtgggggcggggtggaaggctgtactattcagaagcctgctttgcaggcacatcagctcgttcggggtctggaggattgccttgtggttactgggcaccagccttgtctggccagctgttggtcaggcgagccagcttgaactggccctcagtgccatggtgcaggagagttattaataaagaagaaaatgagaggtttttagggagatgtgcaaattgaaattgatagtctttgctggtggagaattctgggtttccagaaccttgggcccagcctttcctacagctcctgtagacttggccatgttggccacatcactagacgccgaatgcaagtcagtaaatgaatataggaattattatagagggatggaaagcccagtgccttgagtcagacagggcaggtcctcaggaaatggctgaggaggtaattttaccacttggacccacttttaggacttgctggattcttctccgaatgtcctcaaggtcccacagtctctttcccattaggttttattttttcccccttaaatgttttgtttgttttttgtttttaagagacagcgtctggctctgccatccaggttggaatgcagtagtatgatcatagctcactgcaacctcaaaactcttgggctcaggtgatccaccacagccttttcagcagctgggactgcaggctcaaaccactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagtttttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtctctgcctgtttactgatgttctttagagggctgtggagcctgctggtctgaaaaggaacaatgaggaaaatcactcatgggggtgggtggggggaggaagtcaccctaatgctccgcagtggcagatgtggtgacccagatctaataacctcggaatcagtctgtttggatgaatggaccgtcccatttccaagttgagggcccctcaagggagggggctgaagccatccctgggcacggtgacaaagtgcttcccatagggcccctcatgggctcatctgtcgccctggggtggggctgcccatttacaggtaaagacacaactgggaagcggcaaggctgggattctgggtctctgtgtgaatgcagagctgttccgtttggcacgtggtggccctgcggtgttcttcccactaccccacactgctacctgcaaagcacaactggggaggttcagggcgtccttccagtctttgcaccctgggcccgcctgtgggggtaatgatagacggctgtgagccctgctgtaaaactatgcagaacccggccgggcgcggtggctcaagcctgtaatcccagcacttagggagtccaaggcgggtggatcacaagggcaggagatggagaccatcctggctaacacggtgaaaccccgtctctactaaaaatacaaaaaattagccgggtgtggtggccggcgcctgtagtcccagctactcgggaggctgaggcaggagaatggcgtgaactaggggaggcggagcttgcagtgagccgagatcgctgggctgcactccagcctgggcgacagagcgagacacagtctcaaaaaacaaacaaaaaactatgcggaactcacagaaggagagtgtggttctctctgttttttttgttgttgttgtttttttgaggcggagcctcgctctgtcgcccaggctggagtgcagcccagcgatctcggctcactgcaagctccgcctctcggcttcacaccattctcctgcctcagcctcctgggtagctgggaccacaggcgcccaccaccacacccagctaatttttttgtatttttagtagagacggggtttcactgtgttagccagtatggcctcgatcttctgacctcgggttccgcccgcctcagcctccgaaagtgctgggattacaggcgtgagccaccgcgcaaggcggatagtgtggttcttgcgatctgggaacttacaagttaccggaagagagggagaggcacacatgtatgtgctcaagggaagtgagatcagagaagcttccggaaatggcaggactgaagaggacttgatcagtcaccagaagttggagggcagagagtagccgtttgccctaaggaaaaatggcagcaaaggcctggggccacccacgtctgccttgtgattctaggctgtgtgcttttctttaaatggtaaaatatgcttaacttaaaatttaccatttttgtaacttttaaaaagtttggtaaaatgcacataacaaaagttactgtcttaacccttttaaattgtttctttgggtaaggccagtcaagtgaagcaggggaacattttaaccatttttatccatacagttctgtggtgttgactacattcacattgttgtacgaccatcactactgtccatcttgaactttttcatcttcccgactgaagctctgtacccagtgaataataactccccattccctgcccccagcccctggcactgccattctccatctgtgtctctgaattcagctattatagatacctcatgtaagtccagtcctgtggcattcgtctttttgtgattggcttatttcactgagtgtaatgttaccaatgttcatccatgtgatggcagaaattgtgtggattttttttttaatggagtttcactctaggctggagtgcagtggcgtgatctctgcttactgcagcctctgcctccccagttcaagcttcaagagtctcctgcttcaggagttcaggattctcctgcttcagcctcccgagtagctgggattacaggtgtgcaccaccacacccagctaatttttgtattttcagtagagacggggtttcgccatgttggccaggctggtctggaactcctgacctcaagtgatccacccgtcttggcctcccagagtgctgggattataggcatgagccactgctctgggccaactgtgctttttgaaggcaggaataactggttcatttctgggtgtcccagggagcctggttctgagctttacacatagcacatactggaagagcccttcctccttttcatagcccatggggtcaggactggggacttttactgatcattggaaagtgacttatcaattactcggtctttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaacacccagcccaatgtgcctgtcaactttcttccaggtgtcagttgtgagacgggacagatcttgtgtttcttcatggacttcatgtgagtggctgccctgtgttttcacatttttattaagcagcttaatttgccctttgaattccggtgatgagttggcgccagagtgaccactgcattgtttttcccttgggtgatgggctggactggcaaccagtttgagtgagtaactgtggggcagagaaaggtcacctgggcctggagttggctccatcgtcatctcttaaggccagagcctcgtggccacctctcagttgagtacaggctcctttccatggatggagacagagtgggcagatctgggtggagtctgaggccgctaaaggcatcagcagcacagaagcagagtctagatcaaattttacaagcgttctctggttcaggaaggctgacttgttttgggaacagaatggagcattctgaaacatttcactgaagaaggagctgggagtgctgttgatttgactgggttcaggggagcatgccttatccatgactcccttttgcttagtttgttgcttctagctttatagcctccttccttccttggttggaagtcctgtggctgggagggcttgtgtttgtgactgctaacctcaccaggacaaagagcccaggtgagctatgtgcttgagcacacttgggagaggacacagcagtgcatgaggcccaggctgcagctcacccctgtggtttgagagggtcccctgtttagagtgaatgaatgggcatcttggaagctttctcaggttaccaaagagtaggtctgagttttggctgaggctgctgctttttgggtcaagactcggggtggtggtggattaaattaactatgaaccccagggaatatcttgaccctgactggaatacaactgttgtggctcaagtaggtttttttttttccccttttgaaaagtgtagttattttaattaaaatacaatatccatgtaacatgttagaagtttgttatttttattattgtaaaattcatgttatattttttattttttcaagacggggtctcactctgtcacctaggctggagtgcagtggcacgatctaggctcactacaacccccgccacccaggttcaagcgattcttctgccacagcctcccgagtagctgggattacagctaattagcctagctaatttttgtatttttagtagagacagggtttcaccatgttggccaggctggtcttgaactcctgacctcaggtgatctgcccccctcagcctcccaaaatgttgggattacaggcctgagccactgcgcccggctaaaatttatattataagatgcaccattttctccatttttaagtgtacagttcagtggcattaagtacatcaccttgttttgcaaccatcaccacttgtcaatttctagaactttttcatcttcccaaactgaaacttcatatccatcagactttaactccccattccccctcatccccagctcccggaagccaccgttctactctgtctccatgattttgcctctcctagatgcctcgtgtaagtggagtcttataatatttgtcctgtgtctggctgatttcactcaagcagggctttgaagttccccagggcgacactctcagtcttttcttttttttctttctttcttttcttgagacggagtttcgctcttattttgcccaggctggagtgcaatggcacgatctcggctcactgcaacctctccctcccaggttcaagtaattctcctgcctcagccacccaagtagctgggattacaggcgcctgccatcacacccggctaattttttgtatttttagtagagatggggtttcaccatgttggccaggctggtctcaatcgtttgaccccgtgatccacccgcctcggcctcccaaagtgctgggattataggcatgagccaccgctcctagcctagccctctcagtcttaagactgagttaactcccagctctgatccgtcacaagggtgttctcttccggaaaacacccgttagcaatggcgatcttccctgggccttcacgcccttagctttgaagtggcccagagtattagtttgccaaggctgtcccataacaagataccaagactgggtggcttaaataacagaaatatattttctcacacttctggatgccaaaagtccaagatcaaggtgccagcagggttggttccctggagggctctcattggcttgcaggtgccatggtcttgctgcctctgcacatggtctttttctctgtgcatgaactcccctggcatctctctgtgtccaaatttcccttctttttttgtttttgagacggagtttcactcttgtcacccagactggagtgcaatggcacagtctcagctcactgcaacctccacctcccaggttcaggcaattctcccgcctcagccttccgagtagctgggattacaggtgcctgccaacacacctgggtaatttttgtatttttagtagagacggggtttcaccatgttagccagcctggtctcgaacttctgaccttaggtgatccgccctcctcggcctccaaaagtgctgggattataggcatgagccactgcacccggcccaaatttcccttcttaaaaggacaccagtaagactggattaaggtgggcagtaaagacccctgctttaacttaatcagttcttgaaaggccttatttccaaatacagtcacattctgaggtactgggagttagaacgtcaacatatggggagtgaggcatggtttagttcgtaacacttggtgagtccgttactgggcagcagaggaaagggctgccaggcagagggagatggtgtttgtgccggctccctcagacgtgttaggaggagtgtgagccaagcgtcatgtggttttaggcagcctagaggggcctagaggacactgagccaggcatcaggagggctgcgtgctaaaacttcgtgtgctgccatctctctccacatccaaaaagtaggggtgggaacaggtcattgctaaggttctttcgttagcttctttaatttttttctttaaatttaaaatttattacctttttttttaatagataaagggtctcgctctgttgcccaggctggagtatagtggcatgatcatagctcactgtagccacaaactctcgggctcaagcgatcctctctcctcagcctcctgaatacctggtactacaggcgcgtgccaccatgcctggctaatttttaatttttgttgagacagggtcttgctttgttgcccaggctggtctcaaactcctggcctcaaacgatccttcccgcctcggcctcccgaagtgctgggaataattatagatgtgagttactgcacacagcctgaatgtattattaacacaactttttccatctcttttctgtttatcttggtttatgtctcccttattaaaaacgaaggcaaccacctctccctatccaatcgctcaaaggtatttattgagcatctactttgtgcctggcactatcttcatggaaatcctttcttccttattcattgatttatggaaaggctgatctccaagggccttgtctttaaaacaacaacaaacaaacaaaacctttctaatgtcaaagcattttcccctgcgtatctttctttaacggtatatttgcagctgtttcctgttaatcctttgtctatctggcttcctttttagggtgatgggatccttaagcacagagtatgccctgctgtagtgtcctgcaggatgggccacactctggccctttaacagtgtttgatgtgacgatgcacctgagcccatggaggtctgtgtctcgggccccgtgggtgtttgcagattgaagatggaatgatacacaccatctctgagatttttatttgctcagaccttcccctgttctggcccaaccccgcttaatcatgtctaataagtggtggtgggtttttgggggcctagtgatacaggtggcccggcgatgaaacgttggctttggagattatcccgctggttctgtttccttctttgctggtgattggtactccctggctcacccttagagaacttcccgaatcctcagactggggcctgctaattagctgtcttgggttctagctctcactgccacgactttgcaaaatgactatagatgtggatggtggctggtgcccatgggcagagcaatcagcacattcatagacccaccttcctggggctggggtgtgaagaccggacaccccactgaagtagtaaatatgactttcatggaggctgcttcatgggccctcgaaagtttcttgtaaagtggctggagcaggattataattatactccctccactgattgagtctgagggggtatgagacactctggcctggagtaacctgcccaaggtcaagtggttggtggaggggctggcgctgcctctctcctcagactgagtggttgtgttaatcacatgagagcagacacagaatgactttgcggaggtggaggagacctggatcatttgctcagcaaaccggttttgggcacctgctgtgttgggcacagatggtgctcagtacagtcaggcaggccttccagcaggtcggctttggtctggtgggaagacagcctcattaacctaagtgccatgatagaaatcaactgaccccagcctttagtctgggtcttgaaggtgtcagctgtctaggaacatgtttcccctctcattttgcaaatctccaagatagggatttcctgactcttgatagctccttctgggacactttggtaaggcttctccagcaagttgtgtggcaaggggcccaagaagacagaactgttggaagggcgctgcccatccatctgcttttcccaccaacagtcaagggctgtgaatgctgacctgctgctgacagtggtctgttgtgcaggttctgggaggggcagagggacgaggtctggctgggaagatgtagcggagatacacagaggtagccggctgtgtgtgcacagggccaggtgcagggcccagagagccaggtgagtgaccagggagcactgggaaggaaccatctccaggcaaagccaggacacagccaaggggaccccagaagaagagaggggagccttgtgcagcagccacagagagagagagccaggcagagcaaggaattgagcagcccggggagatcctctactcaagtgccactgttggctcaagaagagtttttgaagattcacttcactttaaaggcctgacatgcttccgtgtttaaagtgctgctggggtcagtttgtatgcccgtagagtagggagagattttctgcacatgacgaggtattgatgagcattcgaagcaacctacaggcaacatatgttgacagtgcagactttgaagggaaaagatctggacttgcccagagacctggcacttgccactgtgtggtcttgcacagggacttaattctcccttgacttctgtcagctggagagggtgacccttccccttgggggcttcgtgggagtagcgggtgcagaccatctggcctcctgtctggtctcatagagtctcctgttcatgtatctgatgtcagttgattgaacatcacttagcaaaaaatcttaagaagaaatgcataatttagtatggacatttcactcacttggctcagccattgtataaccagtatgagctccggggggaccctggggtgtgtcagggccctcattctcctcctataatcctcctgggctgagtggagttcttacattttgaaggttatgcaatggactgcatgtttggatccatctgcaaattccccttttggggagaggctgagttgccctgtgcttgagggagctgggcagatggtactttgtgtagcctgctgcattttgcagaatgtcttctctcacaggggtccctgtggaggagtgacaggaaccctcttagctgagtgttgggaggttttaggtggagggctcaggtcacccgcaggggtcatttgactcctaccttatctgggtagataggatcatctttgtcccacagtccttcccagtattgtgaagtgatgcattggcgtgagcccaggggtgccaagggtgggctggcaatgcccacatccagttctctgtccctgaggcacggaggtggttgtgctgggctcagagccgccgtctgactggttggaagccctgctctgattttgtgaatcaccctagttaagtggaagctcagcgtagcctgttccctctgtgggggtgtgcagaagcactgtttatttttgcccacatcttagagtgataaatggaactcatttatgaattttgacttccaaaagctttccactttctcccttaggaacatggataaaaattgtccacatttgtttttggagacatggattgttacctgaaacctacttttcagatgttcttgatgtgaaaactgttgccaggctgggcgtggtggctcatgcttgtaattccagcatcttgggaggctgaggtgggtgggtctccattttttttttctttttttttttctttcttttttctttgagatggggtctcgctctgtcgcccaggctggagtgcagtggagcaatctcggctcactgcaaactccgcctcccaggttcacgccattctcctgcctcagcctcccgagtagctggaactgcaggcgcctgccacaacgcccagctaattttttttgtatttttagtagagacggggtttcaccgtgttagccaggatggtctcgatctcctgacctcgtgatccacccacctcggcctcccaaagtgctgggattacaggcatgagccactgtgcccggccgggtggatctcttattcccaggaatttgagatcagcctgggcaacatagcaagaccccatctctacaaaaaatttaaaagtgagctgggcatggtggcatgtgcccgtaatctcagctcttctgggggctgaggcgataggatggcttgagcccaggaattcagggctggagcaaactatgattgcaccactgcactccatccagcctgggcgacagagcaagcaagaccctatctctaaaaaggaaataaataaatacacataaaaaccattgcttttttttggccgggagtggtggctcatgcctgtaatcccaacactttgggaggccgaggcaggcagaacatctgaggtcaggagttcaagaccagcctggccaacatggtgaaatgtcgtctctaccaaaaatacaaaaatgagctgagcaggctgagagcagtggttcacgcctgtaatcctagcactttgggaggccgaggcaggcggatcacctgaggtcgggagtttgagaccagcctgaccaacatggagaaaccccgtctctactaaaaatacaaaattagctgggcatggtggcacatgcctgtaatcccagctacttgggaggctgaggcgggaaaatcgcttgaactcaggaggcagaggttgcaatcatccaagatcgcgccattgcacttgagcctgggctacaagagcgaaactccgtctcaaaaaaaaaaaaaaaaaaaatatcagctgggcatgttggtgcacgcctgtaatcccagctactcaaggaggctgtggcaggagaattgtttgaacccgagaggcaggggttgcagtgagccaagatcttgccactgcactccagcctgggtgacagagcgagactgtctcaaaaaataaaaaccggccgggcgcggtggctcgcgcctgtaatcccagcactttgggaggccgaggtgggtggatcacctaaggtcaggagttcaagaccagcctggccaacatggtgacactccatctctactaaaaatacaaaaaattaattgggcattgtggcaggcgcctgtaatcccagctactcgggaggctgaggtaggagaatggcttgaacccgggaggcggaggttgcagtgaaccgagatcgtgccattgcactctggcctgggcaacaagagtgaaactctcaaaattaaaaacaaataaaataaataaataaataccactgcttttttaataacaggtacaaattttaaagagaaataaaaaaacattgccatcttcaaatctccacaaaaatggaaagacaggacagtgccagtcagccactttctgcagtcaccatgatcccttctctctccttcatttttaatgtgtgtttttttaaattgtagtaaaatacacatactctaaaatgtaccatctcaaccacttctcagtgtgcagtttagtagtgttaagcctctagtgttttataagtggcagagttgatgggaaaacactgatcttcaggaggggttttttcagtgccagcgtccctctggatgtgtaggcagataagaaggtggctcggacacagtccttaaataagtgccaggagccagcaggccagggtgggagccgggacaagcaggcacctaaagtaacggtaacataaggcaggtggcgagactctgtggatggatcagtgccaggggctgtgcgggaagggaaaccttacatctgtcctgtttcttaggggacgaggttgtggaggggagggtattccaggcagggaatgtgggcaagaactcggaggcttgaagcattcagtacagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaaagtagcaggctctggttggagagttggtataaaatgtggacaacagggaaggtgagggataggagagttggggtcatcctatgtgggtctccgaagccaggctgagggtgttgtgctttctttgaggatgatagggagccactgaaggttgttaagctggagaggggatgcctttggagctttgccttgggaaggtgagtttggcaaaagtgtgtgtgatggtccagtgggagtcaggtacctggagctgttgtcttgaggggcggtggggaggaatggggagggatggagaggacaaggaatatgagctgattctggggagggggtgacagaaagggaggctgtatgagcctggggatggtgagcgctgtgctggcaggtttcagggcctttcggagagaggaccaggccaggaatgaagaggaaggacagaagcgtgggttgcggagggtgtgtggagtggagggccggagcaggcccttgggccttgcgtcctgggggaggtcacgtgagagaaagaagtgggggagtttatgttgcggaaaggctaaaaggaagtgactgttaggaggttatgggataaaggacagaagccaggctccaagtgagtataggagagaccagagcactaaattggaccacagtgtccagcattctggcagcagggaggaggtgggtggggattcaggattagggtccgagtgctccccgagtgtccaccgtcggcctgctctgttccggggcagggccacatctttgtccgtgtgccgaggaggggactggtgggctggagtcccagggggagattattccaagtaggggctccagaaaggtgagtgatgtgtttgggtctatgggaaggttggtgacccccaaagagaggtggctgggttactgctgaacagctatcagggtgatatggctttgcaggggtccagtccatgggcctgacatgttgtagctatgctttgaaggcattttcctggtgggaggccaccgcaggtaaggggagtgaaagggtggctgtggcggctgttccctgtggctggtggccatggataagtgaagaggaacgtgatgctgggcaccatgctggtggtgcctggggcagagcctggccttgtggggctgtggagcagggtgaggatctgggatctaggactgctatgcaccgggccgaatcgtgatacccaagggaggcatcttgtcgtggagcagttgcatgggcccgcccttgttccctggagcagctggtgaggtactgttagaatttggccctaacaggactgggcacagtaggtcacacctgtaatcccagcactttgggaggccgaggctggtgtatcacctgaggtcaggagttcaagaccaggctggccaacatggcgaaacccggtctctattacaaatacacaaaaattagctggacgtgggggtgcacacctgtgatcccagctactcaggaggctgaggctaaagaatcacttgaacctgggaggcagaggttgcagtaagccaagatcacaccattgcacgccagccaaggcgacaagaacgaaactccgtctcaaaaaaaaaaaaaagaatttggccctaacaaatgcaggttgtgattattaacataagtctggtttcctctctcatggcatttctttagtggccagatggtgtgagtggctccagaagactcttctcttctctgtgcaagagccaggaaggctctagaaaggaatgtctgaggaagcatcggagactgggtcccgccatgcctgtgtcatctcctggcttccccggcccttgtgagccccgcggttgcttatttatcctgctaaggccacagtctcaggttccagaaactctggcaaggaagtctgggaaggttgatggggatgggctggcgggctgggagaggtgctttgttttcactcctcaggaagcttgaggcttcttgtggaagcgtctgctgctttgggctgggcagctgcgcccccagaaagccagctaggggtctgccgcctaataccatgggtggaaactattgcagtcagctgttgggatgcaggggaaggtattggtaggactggggtgccctgtctcctttgtccccatgagtgcaggggatagatctgaaaggagaggggaaaatggatgttttcttctttgtctctcctttctccctgctttcaagtctgtgaattaattggagtcattcccaagggaggagggtcactttattgaattttaagacaaggcggggccaggcgcgatggctcacgcctgtaatcccagcactttgggaggccaaggcgggcagatcatgaggtcaagagaccatcctggctaacacagtgaaaccccgtctctactaaaaatacaaaaaaaaaattagccgggcgtggtggcgggcgcctgtagtcccagccactcaggaggctgaggcatgagaatggcatgaactcgggaggcagagcttgcagtgagccaagatccaccactgcactccagcctgggtgacagagcaagactgcgtctcaaaaaaaaaaaaaaagcaagacaaggcatatgacagggcatgatactgacgagaccttggacatcaaaggctggagcaggacttcctcctagggaacatcctcagatatgtagatgtcaccgtgtgggctcagacatccagggtggaccagagccggtggcttaggtctggtggtctgtccctgactgcacttttttcagagctgttttggtttgaagctcaaagcgggctttttatttatttatttagagacagggtcttgctctgctgcccaggctggtgcagtggcacactcacaactcactgcagcctcaacctcctgggctcaaacagtcccctcatctcagcatctcaagtagctgggactacaggcatgcaccaccatccccccaggtaatttttaaattttttgtagagacaaggtttcactatgttgcccaggctacaagaggactttaacttttttttaattaaaaaaaaattttttttgaaacaaggtctcactctgtcgcccaggctggagtgcagtggtgcgatcatggctcaccgcagccttgacctctccaggctcaggcgattctcccacctcagccttctgagtagctgggacggcaggcacatgccaccatgcccagctaatttttgtatttttttgtagagatgaggtgtcttcatgttgcccgtgccagtctcaaactcctgggctcaagcgatccacccgccttggcctcccaaagtgctgggactccaggcatgagccaccatgcctggccaagggggcttttcaaaggctgggctgggctgttcatttggaaaaaaggttggggatgttttcacttcaccaggacttctgccagtcagcaggctggtacattaggagcccaagttttgcctggtgctggtggacgggtctaggcctgagaagccgtagtctcctagtgcttggtgctgctaagcccaaagaacagagtggttacaggaaatggaacatttagtctggcagaggccaagggcagcaggtccctactctggctgcccatgtagttaaaaagtcacacacgtgcgcagctggtctgattaatgagtttgttttttgatgtcacagtttctgggcacagcagagctggctcctctgcttggggtctcctcaggctgcagttgaggtgttggccggggctgcattccctgctggggcttggggttctcttctaagctcacctgggttgctggcagtgcttacctcctggcagttgtaggactgagtccccatttccttgctggcattggctggaggccccttctagagcccaccctgttcataggcagttcacacacagctgtttgcttttctcttctcagtgaatctggtttttttgttttttcgtttttgagacggagtcttgctctgttccccaggctggagtgcagtggggcgatcttggctcactgcaagctccgcctcctgggttcatgccattctcctgcctccgcctcctgagtagctgggactacaggcacccaccaccatgcccggctaattttttgtatttttagtagaggtggtttcaccatgttagccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaacttttgagataattatgtgtaaatcttttttatatagttaagatgttgctgtgtagttgggtgtccggccttagttaatgtgaacgtttccatgtattagtaaatcttgtgtaaatattatttttaagggccatattattactttgtagtggagttatggtttaatttatctaattttaatgaatttttgttggacatttcgagtggttctttatgcagctggttagtataatgtttcagtgaacttctctctctttttttaaatagcttcactgaggtaattcatgtaccatacaattcaaccctttaaagcagccaatttaatgggttttggtatattacattattactttttaaaaattgtggtgaaatatatatacaaatttgacattttaaccactaaaaattaaaattatggtaaaataacataaaatttaccatttttagccgcacagctaaatggtgttaagtatattcctgtcatgcacccatcactatcatccatctccagaactctttccaccttgcaaaactgaaaatctgtactcatttccacccattaaagaacagtgcttcttcccccacgcccagtccctgtaaccaccattctactttctatctctaggaatctgacgactctagaaactttatttaagtggaatcatgcagtatttgtctttttgtgacttatttcacatcatgtcctcaaagttcatctgtgttttactgtgtttcagaaccccttcctttttaagcttgagtaataattcaattgtttgtgtgtgtgtgtgtgtgtgtgtgtgtatatatatatatatttaatctatcattcattgatgggcacttgggtcattttaaccatttttaaatgtacagttcagtggcattaattacattcagtgaatttttttgtggggttttttttttgtttgtttttgaaacaggatctcgctctgccatctcactctgcatctgcactggtgcagtaagagctcactgcagccttgacctcctgtgatcctcccacctcagcctcctgagtagctgggactacagatgcacatcactacactcatctgtcgttttttttctttttgtagagacagggtcttgctgtgttgcccaggctggtcttaaactcctgggctcaaatgatctgcccgccttggcttctcctgaagtgctgggattacaggtgtgagccaccatacttggccaagtgaatacctttttatatgagtttctgcccatgatggggtgggcctctgtcactggatttaccaggtcagagaggtggatggtcttaagacccttgatggctgctgccaggtcaccttccagaaatcctgccccagtttacccttggctttatggttaactgcctgctcttttttgacttttttcttgcctccttctgttcacaggattgtactgaagcagttccatcaggtgctaaaacgtctgagctgtgtggggccttaccctccaaaaatccaaaattgtgatgtgggattttcattccagagaagcagaatctgagattaaggtttgctttgggtcagaggagtctgtgctagactgggctccacggtaattcccgattccttgatgaccctcgaaacagtccagctttgatagggaggagccctgagctggggtcacactggtccactctctcattcaggaagtttcctgaggccactggctgtgtgacactcagttctttgtcagcgctgtggttcttggtagggaaagaacttactgtccccttgtctgttgtgaagtttgctagtttattgctgttgtgggctacttgtaactgaatctgaaaagcattttggcttctcttctgtgcatcgtgagttaggtctgccagatagcattgtccagttaattctggctcatggagttcctgcttggctttcattgaagctccaaggaagcagaaggccatggcagaaaaggatttctacaaagggaaagggacttgcatggctgcacttggctggcagaagctgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtctacaggtcaccaccaggactggaacagatttcagaggccgtgcaggtttcatctggggcaacgtgccaaagtgcagagcgtgggcagcgggaggccctgccgtccgcgtggatgggggagacggcagcatgggggtgtctgccagggcggaggtgatgatgtgcaagcaggtggttggcagcaggaggcctggtagtgccagctggtgtcttgccagccagagcacagccccgcttggtcaggaatgcatgtgctgaggccagcactgagatgagcaggcatgcgtgtgtggccacccctatttctgtgctatagtgggaggagcacattaggtactttgaggccataatttacctttgttacagatgaccaattccccaacagcctcccagccttttgcaggccccacctgggatcagaaggcaaggtatccttcctgcagggaaagcctgttagtctttcctgagcattcttagtgccagttggagtaggggctgtcttggtactgagctggccggtgctggagatgggctggtcagtctggagggcataaggacaggaaggataccggcactgaacgttgtcactcctgtgggggtacagatgcctcagtggaagccacgctttccttcagaatattgcatttggtgggcctgtctcaaggtgcactttgactcctgaagaccctccttctcctcctctcacggatctgccggtgttccctctctggaaggcttgcaggagagacaggatccctccctttactggaactttgcacttgggtttggctttgtgctttgtaaggggatcccattcagcgtccaggatccgagccttgctctatttctgcaaggagctggtggttgctgctcgccaaggggatactcagacagccaaagcctaggcaggatcagaagctcaggcagcagagccaagatttgaaccaataatttttttttttttttttttactttactctacagtattgggattggctgaactttccttaaatgaccagatagtaactaattttatgtttgtggctgagaggcaaaatcgatgctactttgtggatacttacataaccatttggaatgtgagcatgtgaaactataaagagcattcttaaggcctaggtcacatgaaaacaggtggcagtgggctggatttggcctgtgggctgcagtttgccaacctgtgtttcacagcgagctgcctccaaatgcctggtggtgatgcaatcgatgacagagccaggtgtgggcgtctcacatctgtgctcaggagctcacaggagcttctctcctatagaacctgtgaggcaggtagggtagtcttccaaaccccatgaggattctttcctcagagaagttgccggaggaggaaaagctggatgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccccaagatgagcaaacttgctcctcttatttcctagcagcagatgttcctgagaaaggggtagctgtgcttgagccattccatcattcatccaagccatccatctatccatctattcatcatcaatccaagatccaaacatttatctatttatctatccacccatccatccaaccagtcatacaaccatccatttaactattctttattcatcatccatccaactaaatctattcatccctctgtcatccattcattcctccctccctccctccctccctccctccctccatccatccatccatcatctgtctaacatccagccaaccatccatccattcaacattgaactatccattattcactcatccatccaaacatgcatccattcagtcatcacctattcatccatccattcatcctccaaccattcatctgttcatttgaagttgatgtgacacctactggggtccaagcacaatgcttaggccttgactttgtccttgacctcaaggaacccatagacatatattaaaaacagctgataaaggggtgctgggatggaagtgagtaccaaccaggcactgagaagtgactgactctgctgggttagcagaaggaagacattaaggagaggatggcccattagttggatcttgaatggactcaaaaggagtatattgtaatcccagtactttgggaggctgagttgggagggtcgcttgagcccaggagttcaaaaccagcctaagcaacatagcaagacgctgtctttacaaaaaattaaaaattagccaggtgttttggtgcacacctgtagttccagctactctggaggctgagttgggaggatcgcttgagcccaggagtttgaggctacattgagctgtgattgcaccactgcactctagcctgggcgacagagacagaccctgtctctgaaaaacaaaacaaacaaaaggagtatgttaggccattgtaggggaggaggagaggccttctaagcagggactgtcacaaaggaatgaaagagcctaacagcctggcctgccacaggtttctcagacacttgggatagctggcatatggtgttggggtgagagaccagctagtgatgatgtggggtggtctggtgttgacccccagaggccagagaagacttctgcatggaggatggagtgagcatggagtgtgcgactgccataggccctgctcagtgccctacaccccgtgtgtgcctgtgacacctgatggcctatgcaccccatacacacagctggacagcagaccccggctgccctggctgaggcaggtgtgcccatctgtacccacctttgctttggctcattggctcctggtctcctgttgccgagcacctgtctagacagaatgatgttttgtgtctgtgcaaaacagacacgctggagcttcgtgtttgcagagcttcatgcttcagttggtaccccgtgaggcttgtgtgggcagctgttcagaaacctcaattgggccctctggcatttgtgagaaccttgggctggaacccacccggctggcagtgcaggagagcagcccttccccctcgagggccttgtccctttcacctgtgccgtgtctgtgtgacactgaagctctgtctggtgcgggttgaagtttgtgacccccacttaccaggcccagagcatgcatggtggactgtgggagatagtcattgggatttttcatttgattttatgtttttttttttaatcaaggtaaaatacatgtaacatttaccatcttaaccatttaaaaataacacagttcagtggtgttgagtatgttcatgttgttcagccatcaccatctgtcactgaatgtttttgtcttgtacaacaaaaactctggactcagccaggcactgtggctcatgcctataatcccagcactttgggagttcgaggcgggcagaccacctgaagtcaggagttcaagaccagtctggccaacgtggtgaaaccccgtctctactaaaaatacaaaataattagccaggcatggtagcgggcgcctgtaatcccagctcctcaggaggctgaggcaggagaatcgcttgaacccgggaggcggaggttgcagcgaactgagatcggtccactgcactccagcctgggcaacagagcgagactccgtctaaaaacaaaccaaaaaaagcttctggactcattaaatataggctttccatttcccctccccgcggcaaccactgttctactttctgtatggatttggctaatcgaggtacttcatatgagtggattcatatagccttcgtcttttgttcctggcttatttcacgtaacgtcatgtcctcaaggttcatcggtgttgtagcatgcattagaatctcctttcttttagccgggcgcggtggctcacgcctgtaatcccagcactttggtaggccgaagtgtggatcacctgagctcaggagttcaagaccacccaggacaacatcatgagaccccatctctactaaaaatacaaaaaaatgaaccgggtgtggtggcacacgcctctagtctcagctacttgggaggctgaggcaggagaatcgcttgagccccagaggtgaaggttgcagtgagccgagatcacgccactgcactccagcttgggctacagagtgagactctgtctcaaaaaaaaagaatctcttttctttttaaagctgaataatattccattggtagacacacattttgtttatccatctctctgccagtagacacttgggttgcctccaccttttggctgttgtgaataatgttggcaggaacatgggtgtacaaatttcgtggcttgtttgctaatttatttattcatttttattttatttttttgagatggagtctcgctctgttgcccaggctggagtgcagtggcgcgatctcggctcactgcaacctcccctgcctcccgggttcacaccattctgcctcagcctcccaagtagctgggactacaggcacccgccaccacacctggctaattttttgtattttcagtagaaacggggtttcaccgtgttagccaggatggtcttgatctcctgaccttgtgatccgcgcccagcctattttttaatttttttagagatggggtcttgctgtgttgcccaggctggtctcaacctcctggcctcaggccatcctcctgccttagcctcctgagtaactgtgattacagacatgcaccactgcgcccctactcaatggtatttttcacatatcagatttttacattatttgcccctcacccacttaacagctatttgtttttcaactaacttcctttactgtttcaacaaatttccaattatagtaatttttaccctagaaaaaagaaattatgggttgaaggtaaaacaaaaatacatatcttgtgaattatctgttctttttcaaacatcttaaagacttaggctgggcacagcagctcacacctgtattaccgggaggctgaggcaggaggattgcttgagcccaggaatttgagagcagcctgggcaacaaagtgagaccccatctctacaaaaaaatttgaaaattagctgggcatggtggcatggacctatagtcctggccgcttgagaaactgaggtgggaagatagcttgagcccgggaggtcgaggttgcggtgagccacaattgtgccactgtactccagcctgggtgacagagtaagaccctgtctcaaaaagaaaaaaaaaaaaaaaattaaaggcttgaaagatgtcatgatgtcatttgatggttgtatatgtgcacgtatgtgcattcaggtgtaatttacagacaatgaaagtcactcttggtatactgttctgtgaggtgtgacagcgttctgtagccattaccttcatcaagatacacagcaggcctatcaccccagaaacttgcattaccccttgttccttgtaggcatttctcctacttgcagcccacgacaccactgatgtgctttctccccttacagtttagcacttttccgaatgtcatataaatagaattgtacagtgtgtaaccttttggctctggcttttttcactttgataatgcatttgaaattcatgcaagttgtgtgtaccaatagggcattcctttttattaccgaggattatttcatcccacagatgggtcagtactgttcttcccctttctatcccactaacatctttattcagatgtaacatacataccatagagttcacccgtttaaaatggaccattcagtggtggttagtattatctcagagttgtgcagtcatcatcactgtctgattgcagatcattttcatcacccccaaaagaaaccctatacctattagcactctctccccatccccttcttctgttagtcctggcaaccaccagtctgctttctgcctctgtggatttgtcttttctgggcttttcataaatgggatcacatggtacatagcttttggtgacagagttcttagagcttctttttttatttgtttgttttttgttgagacggagtcttgctctgtcgcccaggctggagtgcagtggcgcgatctcggctcactgcaagctccgcctcccgggttcacaccattctcctgcctcagcctcccaagtagctgggactacaggcgcccgccactacacccagctaatttttttgtatttttagtaaagacagggtttcactgtgttagccaggatggtctcgatttcctgacctcgtgatccgcctgccttggcctcctaaagtgctgggattacagacgtgaccactgcgcccggcccttttttttgagacagtctcactctgttgcccaggctggagtgcagtggtacaatcttggctcactgcagcctccgcctgccgggttcaaggattctcctgcctcagcctcccgagcagctgggattacaggcgcccaccaccacgcctggctagttttttttgttttgttttgttttgttttttgtatttttaatagagacagggtttcatcatgttgtccaggctggttgtaaactcctaacctcaggtgatccacccgccttggcctcccagagtgctgggattatcttagagcttctcaatagaagtcctatcttccaggccacatctcaccctccaggggtaggggctggtggagctgttctcactcagtttgtcctcagttccttcttgagcctggacccttccctctagatttggggctgctcctctcagagtgccccagaacaaaaccccctccctgttcccacttcccactgtctgcaggactcccctaccccataaccagggtcctgccagccctaccctcagcctcccataagggtctgaagtggcaggtggatgggaaactgcactctctgacctctgcaaggggactgctgctttcccatgagcttctcctctttccgttgctggtttcttctttgttatctttgctgctggagtggccagaccctgggaagcgggctggagagaggagagaagccatcgagccacatggacccctacagcccggaatctgagctgtggtaggattggctgcgattgggattggcagacacactgggtttgtacaggaggggaccctgaaggatgggctgtggtcaaagtgggatcccttcactgtccatagtccttggatctgaaactgctgacaggtgcccctgggaactgctgtggtatttggagtctatagagacacccattgctcaggaccccagggccttaacagggagtacactggcttctgggaagcttgatggagttgttgctgcataggtgcagaaaatcccagcagtggagtaaggcctgaagtaagcccccactgggctctgtggggcctggggcagcctcctctgttgcagggccgccagcatctccagcagaagtgcagtgcttgctctggggacacaggggccttttggaatgagcatgtggacttggcttatggattgtgcctaccccagagcgttgctgtgtctctcaacacacacagcttccatgggctgctcactccaattctgatggagagggcatttatgactctgtccgttggtttgttttctcactgaagaggaacatagatgcacctgctctctgggcaagagatgtggcagctgcaagctgcacaccctgttctgaatattgcccagaccagaatatgaattacttggtcataaatcagtgtcttgtctgcagaaaacttggcaatgtgagggacggcagctttaacttgattcctgggaggctgccggcctcaaaaaggacaaggactggcaatcagatgggcattctctctaatttgggaggctttcgggcttcctcacggagtgctgctcctggggacgtaccacaagaacctcccttgtctagttttgttctgacgcttgggctcattcacctgactgtctccttgcttgtctggctctcaggaaagccttcccggagaggatgtggctgacccctgcagccatctctccacagacaatcatggccctgagcttggctgtccttggttgggtacatccaaggctctgcctgccagggtaggcactggccaggctgtgggatggcagcgttgctgacttgtgctcctgagtcctgggggccctgagtgagcctccgtgcaggagtcgggctgggctgagaggtgtggagagtcgttcccttaatggatggtcaggcacagcagctatgggctcaaattccggagggacgctgagccaggtcccagcctgtgcactgagcatgtcattcactttgagatcccctctagggtaaggcacaccgtgagtggatgtgccactaagaaggaggcagcaggctgagcgtggtggctcacgcctgtaatcccagctctttgggaggccaaggtgggaagattgcttgaagccagaagtttgagaccagcctgggcaagaaagtgagagctcgtctctccaaaaaaacgtaaaaatattaattgctggggcgtggtggtgcatgcctgtagtcctagctactcaggaggctgaggcaggagaatcgcctgaatgacccaggagttcaaggctatagtgagctatgattgcaccactgtacttcagcctgggcaacagagcaagacccctgtctcttaaaaaaaaaaaaaaagaagaagaaggaggaggaagacagtactcccagttatcattgcgagaggcagagatgcgagattccactttgaattatgttgaaatttggggaaaatgcatgcctgataatgggtaaaatacagtaagtttcctcatctgtgaaatagaaatcccactagtcgttgactcaggaacttgctgtgaagattagagatgaggtgtgcaaaaaaaagcacctagcgtggctgctggcatgccctgagtgcttaataacatttgttattctcattttattgttgttatcgtagttgctgttatgacagatagcgggagaggatgttggctgctttatcagctggctggatgtttggtttgtttttttttttttgtgagggttaaagtgggagatgggaagctgtctttttccatcagagttggaaaggcccggagtgttcatttctcagcaataattgttttcaaatggttttattttagggatagatcccttctttgccaatggtatttcagatgaccccccagtatatgaaaaagatgaaagaggagccacaggtcctgaaggctgcccagctcagcctccccacccaacctgggctctgaggacctggcttgggaggtgctgctcttggcagccccagccttccacctctgtggcctgtgccatggccaggaggacctgcatttccttcggactgtctctctgctcaggcggattatttcgtgcttcgtgtgccctcccagggtagggacggggaagctgtgaggatgctctgtggggatcggctccctgtgttgtccatgtcttcttttaggtggagttggctaggcagggaacctggcaccatttccttctcagagcagagaaacagagtcggcgtttgtgagcgtgcattgtccaaacctgcatttggaaggggtcaaagtaggctgggctttgtttttactttttctttttaaattatgatgaactatacataatgtaaaatttaccacttcagccatttttaagcatacgatcgatgcatgacattaactacattgatggtgttgggcaaccatcaccactatccatctccagaactttttcatcttccccagactgaaggtctgtacccatttatagccagtaaacaactctctactccctcctccctcagcccctggccaccaccatcctactctatgtctatgaatttgactactctagagacctcatatgagtggagtcctacagcgtttgtccatttgcatctggtttatttcacttaacataatgtcctcaagtttcatccttgccttggcatgtattagaattttcttcctttttaaggctgaataatattccattatatgtctgcaccgcattttgcttatgcatccattggtggatggacacctggcttgtttctgccttttgtaaagcatgctgctgtgaacacgggtatacatgcttttactcttgaccccttgcaaacaggtctgtcttgcacatgtgccccaggtaccactcagccatctgctcattaatgggagaggggagaaccttcccggttctcttgagtaactaccatgatcacagctttctggaatgtagcaggttacttgataaagagggcgggaattcttagaaaggagggtttctggctgcaagccccatacctgttttctgccaccttctctgccaagggagcttgagccagccatttctgggaagtggtgagcctcagatatggttcagggaagatgggaagtgttacagtgtaattccatctgctgatggggacaggcacaaacctggtggcttgttgtccttggaacagtcagtgatgaaggcagagtggcggtaggacagggaccccgcttagttatgacactgcctcctaagtggaactaagtggaaggtctagtggggccttcttcgtgggttgggacagtggttctgcacccccactcagcagctcaggaactgaagttagagcctgccttcaggggatgggcatgtgtacaagggataggggaccagttaatccaggagttagatggtgactgagactccaggaatttcccctttcctgtaaacatgggtcattttctagaattaccacgttccctttaattttgccatgtttaggaaatctggctgagctggtaattaccaagtctaactgagaaatgtcttatatgtaaccttctgtttcccttgagtgtttcggaggaagctgtgggcacgttttatggataggtgctccgagttctttccgctttggtccagtctgagtggctctgataagcgttggcaacaccaccgatttttgtggggcctggcttcagaacatgaatgtctgtgtttctgcaaaaccaagtgtactcactgcctccttttaaaatcatgctacaaggatgtctttcactttgaattctgcgcttacattgttcaagaggcatcaccatgtttataacctcagacgcagtaattccaccctagggcattttcctaaggaaaattgcttcccccttttcttttttggtagtattatgtgaaattattcattgtattcataacagtggaaagctggaaacaaactgagcatcctgtaatacaaaaggggttccattagcttggtagacgattctgtcatcatccgatggtaaggatgaaaatgaattagcaacgtggaacattgtcataagtggaaaaagtgagatgcccaaagtgtgatgatttgtatcagtcatctcttgttcggtaacaaaccatcccaaagtttagaggcttaaaacaatgcgatttaatcgcagtgccatctggcttggtatgaggtggttctgctgtcacacaggcttggtcatgtgactgtattcagtttgtggtttgactgccgctggcatccgaggtggcctaaccgttgtagctaaggacttggtagggacaccggaaggctgagacctctctctccttgtggtccgtcattgttctgcagtgaagcctgagttgcttctcatggaggctaggttccaagagcaaaggtggatgctgcagggcttcctgaggcctgggctatggaacttctcagctgaacttccaccggattctgttggtacagtgtgtcgcaagtcttgcccagatctaagcgggggtagaaagctggactctacctcttgatgggaggagcagcagtgtcatgtggacacacggcgtggacacaaggcatgattctcaggggctctggtgattgctcccaccacaggattttagttacacagtcacaggacaaggactggaagtgattgtgggaaaatgatcctagaccattggtagaggaggtgaggttgtggatgacttttttagatttttgctgttgccatgttatatagtaggttcaaagtaaaaaatccttagcatgttatccactggactcctagttcaagattgctggggtgtcagatccactgttaggtcccataaacttgcaggctcggccagtgcagaacctctgcagcctggccttcgggaagaagacatccagagatagtgaccacaccatggggtaccttcaagctctggtgctctctcttcgccttgctgaccttgatggagtggataggccttgggttcaacatgaattgacccaggccatgggggcattggttggcctcctctgtaaggtaggcgtggggctcagcctgcaagagctgaccatacttatgtaggattagggggcatcggtgggaaccctggtgtccaaggacagtattgtctggttgactgaagttagggaagtgggtggggaacatggaattgtcaatccttcaggctccttttgaaggtcattgttttcctaaacagatggttatttggactcttacaagttctctgtaagtttgtaaatgtttgaaaataaatagtggaataaataaatacatgggaaaccgcactttgcctacgtgtgggatgctcgtgagacctggagggagggcactcccatgaaggcggggatcccgggtaggcggtgatctgcagctgtggccgcctgctcggacaggaaaggccttgacgtccagatcctgctggtgggagagccgtggcccaggctcctacattgccttggggaggagagtcaggccctgcagggaagggttgtgaacctgctctgggcaaatgggcctggctcctgggaaacttcgggcctgcagtaaccctactctgaccagaggaatccttcccctgtcgcattggcatccctcccctcactgttctcttcattctggacccccttgtcatcacgatgccagtgctgtccctttggtgtggggtttgtgctctgacctgaccctcaggccctgccagtgccctggcttccaggcagatctgggcaggcaggtctgagcccccggagctgggtaagcatctggggcatgtgaggattgcaggaggtgacccgggacagtgcctcacgcccagggtgaccagaaactgtgttcccttccctaacccaccgggtttaaactttttacttgctagccatagagctcttaatcagacaatatccaggggaacccccattatgtaaggcaggtaaagctggtggaagctctcccacccactagttgtccctgctcagccttggcacggggccactgtgggaccggagagctgggaagccaccacctcagtccctgccagtctctggtctgatggtgaggaggggtctggcctgctcagtggcagggtgcggaggtgaggctggtggctgttcttcagctgtgggactcgtgtggggacaagctgaacagtgtgctgatctctgatcaccactcaagccacaagtgactggacaggcatggacctgtgtcctcatagtgaggacccatggggcttcacccaggacagcctggttcgcctgccctccgatgctggtggaggggaggcaaggcagaggggactcctgtaaagggctgtttttttctgtcctggaatgagcacattctgagggtgagtggctgtcagcagttaggaaaaattgcctgttgacttgtttcattaagaggccccttgccgagggtgaggtcgcagcccggccctgctcagggaggaagcggtgtttacagagcggccagctggtgccgggtgaggaggtggctgatccctcgttatggagctgagagggcctgcggcttccagcccattcctgccatgccgctgccctaatggctgtgacaatggatggatggatggacggagggccaggccaaccaggcagtgaaaacaggaaacctaatcttttaaaaataatccagggggaggggagaaagtgaagcagcaaagcccttaagccgacagatggccctggtggggtgtgtcttccaactgggtaggtgcttctcaaggctgaaaattccagtgagtcggtgaaagctgagcgtgcccaccaaagacacttgaatgggcggctggcattttcaagctctgttccttatgttagacgatgttgttttagcacaaagcctccccccggatcccaagcctctccccaccatggctccagagtcatccctatgtggaacccagcggggcagtctgaccttgtccctttggctgtgaccctgtcccacccttggcctctgtccctggttcttgcccaggtccactattgcatggccagattcatcctcacagggacctgaccgctgttcccttctcacaaacctctgagttgcccatgggctgaaggtcaaggtcacgcatctcaggcaggcaggtgtgcaggaccctccacgctcgtgggcactggcggtgcgggagcacagctccctcctctctgctagctctgagagtcccccgccacccctctgtgtgcttcctgcaccccctctccttgcctagaatgtcccccacaatgtctccacttgcccagctctgtcctctgtgtccagctttgaggctactttctgcagtcaccactattatcccaccccatgtagttctctgtccccgacctgcatgtaacctgtttccctcctccggccgctctcagccgctccttcatgcctccttcctgcaccatctgggctccctttggtacttgtgtgtgcaccgccttctcgcctccaagtctgcagttcctggagcattgagtcatcctgttaccattgcttctgactcgaaggacacggccccttggggctggctggtgtcatgtgtggctgcacagaggggaggggctgttctgccacctgccctttgaggctgtgtgggcacggttccctctagagctccatgtctagcagagcatgcgggggtcctgctgtgcccccactcccatagtgcttgaaccacttcaccccttgcatggggaccaacaggatctacctccctctgtcgaatgtacttctgaaaggaggaaggttacactgaagtttcacctaccgtccatgggattttgaccctgctgtagtgacagctgcatgtttggttctaggggaggaggggtgaatgacttatcttggagaagccagagccaggtgtcagggaatggcctctgtgtctgccacctcctgctgcctctctgcctgggtcatttggttcagtggctataactgtcttggagcagcatttgcttccaggttgggttcaggtatgaagtgctgaaaacatgggaatccctgagcccagccccacccaggcttggtctgctaggggaggtggaagcagggcttctgaggccctgaggctgcctggggagtgcgtttcttctccacccacttgcaagctcagctcacttcctcttactgtatacttggtgtttcattcacactccttgcagcatgcttctgggatatgatgaaaatcagctgtgggtgttgatttcggagctgggcaacgatcctctctggacccgcattcccatctgtaagatgggggtagtaacctccaccctcactgcttcctggaattgttgatgcatcagagagagcagccagtttgcactgtgggcttccagggagatttatttcatgccatggttccccttttggataaggggctagatttgctttcttcatcagattgtccccggggacacacacaggagttgctctcacgtcgttgcctcttggtatctttgaagcctgtctgttagaacccgcctctttgatggtagggcaggatttggagaggtgatggcctctttgggttgaatttctcactctaatgggctcacagtaccttctgattacctcctggttcagcttccttgacaacaaactagaattgcttcagatgcaatacttcattcttcctagtgcatgagtaattcatatccactatttgctccctcttttacaaattggaggatggcgatgcagatggaagatgacctgctcatgcatcaggccgagacttcaggcttccgaggcacatgtttgaggttgagactccctagggagagtggagtcacctttgctttgcagaggagccatgggggaccatgtctcagcacctctgaaaggttttctgccccatccagtctgctgcttctctcccctccctccttcaccctgttccccttcatcaggggtgtaaatgatggtcttcctgtcttcccatgcacctcccttaggaccagagcaggtgggagatgtcttcacaggagggttccaggatgataggtttggagcaaagggctgggggcttctggggagccccattcctgcacctccatgctgaatgaagaggccacacgaggatgctcacactgctcagtgcttcttagagaaagctgctggctctgattaggtctggtagggggcagggtccttatttctcaggactcaagacagatcctcaatcaatggcaagagtcatttttgttttcccgccaggctcactagagtttctgtctcttcccacttttctttgtgggacagctttcgggagggtggggttgtctttgttatgagaagtgacagccagatggactcagtggctcacacctgtaatcccagcactttgcggggccgaggcaggcagaatctgaggtcaggagttcgagaccagcctggctaacatgttgaaaccctgtttttactgaaaagacaaaaaattagctgggcgtggtggcaggcgcctgtaattccagctacttgggaggctgaggcaggagaatcacttgaacccaggaggcggaggttgcagtgagctgagatcatgccactgcactccagcttgggcaacagagtgagactctgtctcaaaaaacaaaaaaaagagagagaagtgatagccctccccgtcttctcacctgtcactcctcttggtctccctgtggagcaagtttcctgcagtcactatgtgctttgttcacttctacatccacagtgcctaaaacaatgccagcacgtagtaggtgctcagttaatgcttgcagagtgaacaggtgacacacctgcctggcgcgtcttgggccccttattaggcacagtaaggcatagaaaactgtctgattccggccgagtttccaggctaagtgggaaggtggaacacagcatatgaagattaaaatgagaagtaaagtgatagttcacagtatgttggtgggaaaaggttgatacgattgtcagataaattgcacaagtgctaagtgctgagaaagttcagagcaggggaagtggttcccgaggaaggaggcagaggagtgtagattttgtagagaaggctaagagagggtgggatgtggcaaagggcgaagggtagaaggagacatgacctgggagaggggagcgtggcaggggcccatgggcttcagggctgtgaccaacagcatgctggtgaacagaccagacgtgggctatgttgtctgggcctgtgaagctgagttcaagagcccaagccttcctccctcatgcccatgctgttggaaccttgaggtggttacctgggcagaattcctgtcctggtctctgggcagcatctctcctgcttctgataaagactaacaaggtgtcttagtctgttcaggctgccataacaaaatgccaggctgggctgtttataaacaagagagatttagtgcgcacagttctggatttggggaagtttgagatcaaggcacctacagattacatgttagataagggctccctgcttcatagatggcatcttcctgctgtttttcatgtggcagaagggccaaagaagctctcttgggcttcttattgtaaaggcattaatttcattcatgagggttccacccttacgacctcatcacctcccagcagccccacctcttagtattatcacattgggggttagactttaacataagagctttggtggggggtacagtattaagtccatagcacaaggggtgacaccttggagtgggtggagggtgaccacctagcagtgtgacaagaactccactaagggaattggggtgtgagtgtgagcatgtgtgagtatttgtatgtgcacacttgtgtgtgtacatgcatatctccaagtgtccatgtatggctgtgtgagtgcatgtgcctgtgtgtggcccattgggggacaggagcaggggccttgaggctgggctttgggctttgtgtacatttcttagcatcttgtagatgcggatgctgactccctcctatggtgcctctcaagatgaaatgagagcatatccaaagccctgtgtgcacagtcgctcccttcttccctcttctcctggtatcagcccccctattctggctggctgagccctaggctgccggtgcagggggtactcagggaggagggctcaggcaggcagcagaggcctggagggcctggctctgtgggatctgtgaccttctccactccagttggcaagggtccaggtgagtctcccaccctcccagtgcacagcgagatttcaggttttgtttctagaccctgattgccatgtggttttcacaccgcctctcctcctgccattgacagtggggggctttgattgctgtcccccttgtaatgggaacactttgctgaccttttccttcctttccccgctaaatgattcctggccaaggccctgcctccccatggggagccgcctcttcctgcctttcccaaaggcacaggccctgatgcccaggaccccgtgtaggacacacagggacagacaggagtgcccttatctcacccgctggtttggagggacagtttatctctcttttccacatggtctaaaggaagctggtgctgaaatggcagagacagggactgactccacaacaggaagacaggctcgggcgcagatctctcgactgtggccgccacacagtggtcactgctgttgtcctgggccacctctctgatccccagggctctcctgtcccaagtggctgcctgaattggttttttgcactggcatttatacctttacttggttaatgattcttagagttctttatggactgtagggggaggaccgaggtccaggtggtggtgatggctgctttctaactggcagtcctgggcagtgccttgaggggaggcatttcttctaaagctcagctctcacttgtgcctccaggagagtcaaactgccgccttgctctgagccatctcaaagtgaggtgagccacattctctcagcagggtggtgggttggcagatgacttgaaggaagagcccactccctgcttacccactctcgttttaatacgccaagtctgcccagagacgctggcctcctcaaaggaggaaagacaccctccaaaacctgctgagaggccgggggctgtagctcacgcctgtaatcccaacactttgggaggccaaggtgggcggatcacttgaggtcaggagttccagaccagcctggcccacacagtgaaaccctgtctctactaagaatacaaaaatcagccaggcatggtggcacacgcctgtgatcccagctacttgggaggctgagtcaggataatcgcttgaacccagaaggtagaggttgcagtaagccgagatcacgccactgcactccatcctgggcgacagagcaagactccatcccccccaaaaaaacaaaacctggacagagtggccccctgcaggccccccgcttcttggggctggagcaagtgttcttatagatgtctctggtcgtcttggccactggctcggagacagccaccgagacccggcatttggagcagctggctgggatgctgcagggaggggtgtccaagcaggaggcagccaagcctgcctggagcaggataagatgagctcccctctgagactcagtattttctgttcaatgaaaggaacagtccagtatttgagacaggagaaccggaattgacttgactggtctgtggtgcttttttttttttttcctgtgccttgattcttccatttaaatacagaggacacctgaccctaaggcgcatggaccagagacatcatctgaacccagagtagcgtgcatggtgattattttgagatttcctctctgtccccatctgggctcattttcactggatggaccccaccatgcttcttagaccctgcctgcggcaggctggccagcccaggtggagggcatgcgctttgccaaaggcgagaccgctggctggagactggactgcggggccatcctccaggctcttgcacggggacctggaggatgtggcccaagctcagtctccttcagtctgcattggtggctaatcaggacacgggtatgggggaaatccctgtaggtctggaggtggctgggatggcccagggcttgtttctcaccctttacctctagtttatatcccactgacaccgaggtttattcgcaatgcacttcagcagatagggtgatggggtagaatcacagagctgaggagtccacggtaaagaattccaggtccctgtgcttctcctgcatcccagctcttctgtcattggaaggcagtcatccaagactcctcccttttctggcctttgctgtcagggagcctgggggccagttcactattcatttcgcacagtcagtgcatcccagggcctgaaacatgctttgagccttcatttttgttttcttcccagtggccttatttttacactgtttgatttcttaaggctgctttggatccttttaaaagtaggcgagtgaaaagctacacaaacaaactcctgggcttggcaccctcctgtgcccacatccggcgccctttctttgggacctgccggagcctgggtcccctggcagggtggggcaggatagggtggggtgttgcctgagaaatggtgcaaaccttcttgcactccgtaaatgattcatttccttcaaatgtcctatgctgttttccagcagaatctccattatgtatgaatcaagatcctggctgacattttctgccttggctgttgtgagctttcccgtcagaaatatccttcccatggggcctgaagtaattattttatatttattggcattaagtgtatgagagagagagagagagtgtgtgtgtgtgtgtgtgtgtgtgtcagaagtggtgtatcagctgccacatagtaagagagcaaaggatcttcttttgtcttatggtgttttacctgtgctgattggttcttggcagcctttaaatgcctaggcagagaggaagagagaggttcctaagcttcatggtgaatttctaagtctgtgttgactgcaggaaatgtatgaggaaaggatggtggttgaggcctctccctcacatttaggccaggggttggcaaattgcagcttagtcctgtctgctgcctgtttttgtaaataaaattttattggaacacagcttgctcattggcttatgtatagcatttggctgctttcatgctatgatgacaaggttgagtagttgagacagatgccatgtggcttgcaaagctgaagatattcattagctggctctttccaggaaaagtttgacccctgctttaggataaaacagagaaatggagagacatggaatagcagagtatcttttcaactaggttcaatatgaatgaacaggtcccctcaattgcacctgaaaggggccagaagtcctataggtttgggtttgggggagattgaagttagacttgcttggttcagagaccaggccaggatcgagcatttgccattggtgacctggaggtgtctggagcaggatccttttaaataggcaagctgcttgctgggaacacagttcaccttaagctttaaaaaaaattccttcaaagccaaaaaccatgcaaatatggagctgcctgacaagccgaatgattgatagggtagaaaatagggtctgtcataaaatatttgaggaggtggatttttacagcagggagaagcaggctgacaagtgccacttgttaatggtgactaccaccttccgtacctactgtgtgccaggcatagcaatagacactttgttattgtgttccgtctagaaacaaccctgctaagtagctcccagtattccccagttaccagtggaggctccaaagatatatcttttgtgtgaattgcacagcccacgatcagggaggaagccatcccctgtggtccagccctctgcacaggtaatgggggaattagctggaattgcagccatcctgtaggacataaggaagaacatcttgactgtaagcatggttaaacactgggatgagctgtcagggaagcgtgagagatccccatctgggaggagctttggaaaggagaaacatttgtaagtctattttcagctttcagctgcatggtgacacagggcattggccttgatggcctctaggagatcttgtgacctttctgatttcagcattctctctcctgtcacatcagaccctttgctggtttagatcacaatagtactgccagtgctgcacccttttagaacttctaaggccatgagttattggagattcagtttccagggtggttcttgaacctaagaaatcttctagaagcctgggtcatgttgtgaggtccttgtgcctgttgggtcgtggttctgtctgcctcaggttactgttggccccagggctctttttcctgcaggccttagttagcaccatgaatggttaggggtatgggggtcagggtgagtggtcaccagtgggtttcaagggattggcctatttcatctaagttgccaaacttatgtgcacagagttgttcgcagtatttccctagcatcttcttaatgtgtgtgggatcagtagtgatatcccctctttcatttctgattttggtcatttgtgcctttctttttttgtttgttagtctgctagaagtctgttacttctttttgttgggtttactttgttcatcttttaaaaaaaattttagagacctttcctcttttctgatataagcatttgatgctgtaaatttgcctccaagcactgctttagctgcatcctacaaatttttatatattgcatttttattttcagtcattccaaaccagtttctaattttcctcgagacttcctttttcatctgtggatcatttagtagtgtttaatagtaatgtttcatttctaagtatttggaggtttttccaggtgtcattctgttactgatttttagtcaaaaataaatgtattagtttcctattgcagctgcaataaattgccacaaacttagtgacttcaaacaacaaaacatactaccttatagttctggccagaagcttaaaagaggccttatagggctaagtcttagttttccttcatctgagaaggtctttattttgccttcattcctgaaggatattttcattggatataacattctgggttgacagttcctttcttttaggactttaagatgtttcatcctcttctggcctctatagtttctgatgggaaatctacagttacgtgaatccttattctcctgtatgtaatatgttgtttttctctgactgctttcaagacttttttctttaactttggttttctgtgcttttattatgatatgtctggctgtagttttctttctttatcctgtttggggttcactgcatttctcgggtctgtaaatttatgttcttcccctaatttgggaagtgttcagctattgtattttccgatactgttttctgcttccatctctcctctctttctgggacacctgggacatgaaattagacatcaacatcttttgatgttgttccatagatgcttgaggttttattccatttttctccatttttgttttctctctcttatttagattggataatttctattgatctatctttaagttcactgactccattgtcatctccattctgctgttgaacccctccaggtaattgtttattttttggttctaaaattcctatttggttcttttttatagcttctattttttttggctgagaaggcctgtctttttatttgtttcaagagtctttgtcctttcttcttagagcatggttataatagctgctttaaagtcttagtctgataattcaaacatttgggtcatcttggggttgatgttagttgattgccttttcctttcacagtttatgttgcttagttctctgtcaagtaattttgggttatatcctggacatcttgagtgtaatattatgagactccggaccctgtttaaatgttctgaaaatgttgactgatttttttttttttaaacaggcagtcaacccagttagattcagatggcatatcctggctcactttctcagctctgtggttccggtatccaccctgctgttgaccactgagggatcagtttgaaactgggcagtgatctgtgctgtgctgattctaagtgttttcacacatgtgcagtttaggggtgagcccagggcttcttatgaagatttaaaggatcccttctccagctccctcttctccatgatcttccctatactctctacttccccatgtcccccctttcaggtgttctgattagaaggcagttcccccctgagggtccactgttgctgtgctggtgaagggggcaggggcttcacctatttggtggcgcttggttagtgtagagtggaaagagtccacgggtctccaccccagggaggccgctgcttgcatctgtggggagaggaatggacacgttgtttgtgctggggaaaggtggataaagccaaaagagttcaatctacaggatttctccttcctgggcttttggttagagagagcaagcttttctgtttggttcttttttttttttcctcttgtctgtgcctgttggtagtttcaagctactctagtgcccatgctgggaggcaaaattccaaaaactggaaaaccagaaaaatcactgccaaggtgtccttaaagtcctgcaatctctgctcagtcctcctgcccttatctacctttttgagtcccatgatagaggtttcatgcagaatttgtacctgtggatagtgggaaaggctgtagtgtgctttttccatcttgcctggaattggaagttccaacttctacatttagacgtccttctctctgtgtgtggtgatgttccctgggatagaccactactgcccttagacagcattctgagggtggtggcccatactgatcacctcagcccacccagtaactttcctgcggcccctcccaagacccccgccccaacagggctaagctgatacacacactgcggatgcaggcctgcctgctgggccttcctggtgtttgttttttccaggcaaagcacctctctctgcctcctgctggtttattcagcagtgtcccagggtttgctcattgtctgctttgcttcagacccttctatcaaattccattgtctctgtcttaatggtctttgcagggtaggcatggccatctgcatgttcactgaagggcctgcctgcatttccagggagagaaagccttcaggccactggtgcataaagatctttggaaatgtccagaagatcccaaacattgcctgtcctgcatgccaggcctcacttgccaccagcctgctccccagccgcacatccagctgtcatttcctagagaacccatcccacgcagttgttttggacacatagcgttccttcagggaatgtggccccggggccacaggtggagtagagggcacagtatcccgaaccatctaacggggcccgactcaccctcaccatgcaccaggccagttatggtttctttctgtgtcttatttccccctccatcaaatgagagttattgtagaaaccttatagtgctgtgttgggattagcagtaaacagtttggcatgtggtagatgctcgggaaatggaagctgcccttttttcctaatgggaaagaagggattttgtttttgagacaattcccttcctctgctgctgcatagggacacctgggtgcctttctaaaattagaccagggcatggtggcttgctcgtaatcccagtgttttgagaggccaaggcgggaagatcacttgaggccaggagtttgagaccagcctgggcaacctagtgagactccgtctctataaaaaaataaaattagctggatgtggtagtgcacgcctgtagtcccagctattcaggaggctgagtcaggaagattgcttgagccccaggagtttgaggcaatggtgagccatgttcatgccactgcactccagcctagccaacagagcaagaccccgtctcataaaataaaataaaataaaataaaataaaataaaataaaataaaataaaataaaataaataaaataccaacagcctgtgctggctggagccatggtgttaaaaggcccatggacttgggccatgcctgagctggctgtgctctgcctgccacttaggctgcccctccctgacccagcttgtgtggagcaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggctttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggcccagtagggatgataggacccaggaccccaagtgctctaggcaggcactgttctgggtgctgtaaagcacggtgcctagcacctcacagggactcggggtgtcctggctgaccagccgaatccactttttattgacgagaagcctgggtcccagagacattaagtaacgtgctaaggtcacccacctgggcagtggtagggctgggtttgaaccaaggtctgcactgcccagctcatgaattctgctgcttgggagccagcagcactactggcacaagggtagggggacctcaggcctgtcagagagggtgcctggctctttgggagtggggggtgcaccagagtgggttggagacaggacccagagcaccaccctttacctgaccagcatcttggtggggttccccacctggaaaggcaggaccctggggtccaacagagcctattgcagatccaggttctggcccagctgggatgctcactggcttctgtggcttatcagcgagcctacctgctgcacccgtgagcatgggcggccccatctgcctcctccttcaggtgagatggcaggatcagagagatggaatgaatgctgccgtgtcgcattcatgtaggaaggccttatttacaaaccatctgtagcagtcagaaggcctgatgtggtcaggccagaccatggagcccctgttctggatccatttggcaaagatgagagagaagctgggttaggctttgttgggtaaatgcaaatgccacatctgtgtgtgcacacacataggctgagacatttttctgcgaggtgggggatcgcattgagggaagaaaaggtgctctaatagcttcagcctggacttgggtccagagctttggatagaagcatctttccagacaattgggatcctgtagaaaatctgccctctgaggctcttctatgccttctgttgtgtcctgggaccccttggcatctccaggcagagcctatacagagcatccacatcagagtcccctgtgggccccagtgcctgtagttccatctcctgcctggatgctcggttcttggagcgagcttcctgagcagcctctgcaggctccaggctctggcagcatctccacgccactcctgccggcctttctcctggtggaagcagcctgcgttgcttctctgcccggtggtgacaggctgttctcgtttggaaacagaagagacaccactgcttccccacaccgacttcctaaaacatgaggctcccttctgtggtgtatgtgtaaaatgcctggctctgtgtatgcacgtggtgcacgcctggccctggggtcttcacattcttcagaagaggccaggcatggaggctcgtgcctgtaatcccagcactttgagaggctgaggcaaatgaatcatttgaggtcaagagttcgagaccagcctggctaacatggtgaaaccccgtctttgctaaaaatataaaaattagccaggtgtgggggcttacactcttgtagtcccagctattcaggaggctgaggcacaagaatcgcttgaacccaggagtcgggggttgttgtgagctgagatcacaccactgcacgccagcctgggtgacagagcgagaccctgtctcaaaaaaaaaaaaaagaaaaaaaagaaaaaaaaaagaagaacatggtgacttcacctgcccagggaggcgtgccagccaggggcccatggagaatcagatattcagccagggacaagggcatgtcagtgggcagagtgccagggtgtgggaggctctctgggtggtcgctgaccaaaaacatcacttctgggttttgtgactcagaaatgagctcagcctgtataccctgcagatgtgatgagccccaggccgagtcctctgggggtgtcattaatggcgtgtgcatgagcattttcttctggcatttttacagagaccatgtgcagctggactctccggagacagcaaacagaaattctattatgtgtcctatcagctagtaaaggaggggagcttgccttgagttgtgtttttctgcgaccctgtgtgtttgatccttgtctgcacccagtttggccaccctgacctctgtcactcccaagtccgaggaaccagtggttatgtgaatgtgaagttatttacttcatctgtttatttagatctgggccctggggtggccccatgcgttgaataagtgtgttctacagaacccatggtccctgggttctgggtgatcagtggcctgaggagggaccagactccagcccgtcctaaggagcttatgagaagttttgaggggactggtgcctggacatgggctgtagcgtaggtggagtgtcgaggaggaccctacacacggtgagtgggagaaagcacctgggagagcatcccgcagcccaggagggtggtcaggttaagtcacagcagggatggggctatcagaatggtgggctgtgaagaactgggagggccaagactcagggaggccatctggatggggaaggtgtgagccgaggcccagaatggagcacccaggggacccaggctgatcaggtcgcagcgagcatgaggggactgtgcgaagccatgagctccagactccccagtcgtgggccctgatgcgggggtgtgtgtgagctggagccgtgggaccagggccgaacccgtgtgctggacagtcttcggggcccagacaccaagggccacccggagcctacaggaaagttggggagtagaggggcatgtgttgtatggacagagccctaccatgcttagaggagtcaggctcctcccccgactctgtggccacacattgtccctcacactcttgatttctcagccacagtgagggtgaaaaccagggtcagctcgagactatgacccagttcccatttcacctcctgggtcttctccaggttctgtggggttttttgttttgttttgtttttttgagatggagtctctcgctctgtcacccaggctggagtgcagtggtacgatcttggctcctaggttcaagtgattctcctgcctcagcctcccaagtagctgggattacaggcatgcacccagctaatttttgtatttttagtagagacggggtttcaccatgctggccagactggtctcgaactcctgacctcaagtgatccgcctgccttggcatcccaaagtgctgagattactagtgtgagccaccatgcccggccttctccaagttccgaattccctgaaagcagctgtgctgttgccctgccctctggggcacaatgttaggagtaagcagcgtttaagtgcctccctgattaagagaaagatgtatattcccactgggtggcgaggacatagatgtccaggcccatgtgttccacggcataatgtggggactgcagagaggaagggacatgtttatgtcccaggtgagtcatggaatctcagaatatgagggtgtgcatgtcagattttttcaaggaggggtgtcttagtcacttcaggctgctataacaaaaatgccataaactgggtaccttaaacaacaaacacttactcctcacagtgctggaggcaggaagtcagtatcaaggagctggaacatttggagtctgccaagggcccacttcctggttcttagccatcttcttgctgtgttctcacctggtgtggaaaggatgggggctgtctctggggtttcaaaagggcactaatccccttcatgagggttccgtcctcctgacctaatcacccccaaaggccccacctctaaataccatcacattgggggttagatttcaacataggaattttgcagagatgtgaacatttattctgtgtgctgtaaggggcatctcagagtgccacccccacatctccaaagctgctggaccttgcatatgggagctgactctcttggggctggtgtgactcatggctggaggcctggcttgttaacccagctctgaggtcctctgggtgccacctcctgcacaccagccagccaggtggcctccacgtaccttctgtttcatggagaagagctacttgcttaagacaggttcctcaaacccctggcatctggtctcaggtgactctgagcatctcatggctacctcctccccacctgcagcctcatctccaccctgccgcactctatgactgagcagcacagggcgccaggggatgtttgtctgcactgctgctgtgttgctgacttatgagacctctttggaaggggctcaacaggtgaggagagtggtgtgaatccacttgtcctaatagaccactccaactttctgaacatcccaggctttcctggtacagtccccatcttccagccaagaggagagcatggctcaggtgggattcaggcgagaacagggcaacgcacacctactagccaagatacaaagcacttaatacagggaggagtcatgtgggcagagcccagtgggtctgggttcccctcatgaggaccgagaggggaccaacacctgttagatgtctgctgtgttcctgacgttggcctgggtgtgggatgtgactgggtgtctgttgctctccttggcaggtgcctgccctggaggtaaagaggctgggacagtaactttaggcagtcagctggggtctgtctgttaagcaaggagcaggaatcagccttgttctctactggcctgtctgggaagcgtgaacaaattctgtgtcttgaatagtacccgagtcagttgccagccctgtgctggctctggcagggggtagctgtggaggcaagagtgttgggcagggtgacctgattgagccaagctgttattcttccacctgaggattttccagaagaagtgccaggctcagaaccggcgtcagatacctctgagagcctttccggttgccacggttctcccaggatcgtggagttcttgaaggaaggccttttcctggcgtgtctgcagtggcatggtgatatagccacgccgcccctgtttgtgagttgaatctctgcagaactcacttttcccaggaggtgctttcagaatgcagcataccacagtcctcatcaggatctgctcatttggctgggctggcaggtggctgagttggctcccggagcgggtgtctagcagctgtgctcatggaggcaggctgggcgtgtgaatctcacgtcctcccacggccccctggggaagcaggataggagctgggcctggttcccgagcctggccgattgggagtaacaggtgggatctggaccaggttgtcacacccacaatgacagctgggattatcaccgtgggtggtaattcccacatgacagtttcgagtttcaggtcaagagctgggtcctctctctcctcttgcatctggacagagagatccttgccggctggttttctggctcgttcctcagctgttttctgtggcctgcagagtttgcagccccaggggagtgaggaaagctctgctctggcctgatttttgctggagaagagaaatgtggaagtcagggcggtggcctttgcagtgggtcagctttgggctgctgagacgggcggcgtgaaggccggcttccagagccctggctggcctttgtagtggatgagacggaccagattgccatgctagggtcacccgctgacctgcagtggcctgagcagatacatggctctgccagatttcctgaagtggagccctcagcctcacactgcatcccccagaagccaggcaagaggaggtcataaggtttttctggaaaggagcgaaagagtgcgctgctaaatgttgcaggtgggagtgcgtgaacaggtgaggcttccggtaattatgacaagtgatgcttgtgcttctcagtgccgtttcctccctctgatggggcctgcttgacacctcgcagggagcgtgggtggagagtgtcattatccccatttcattggtgggaacattgagagatgaaacgaggagtttcatctgcaggcccctgggccctctggtcatcccggtcatcctggttggtttattgtcttgttttttaagggggatgatcgaagaaagccttggaggtagggtgggggaagctgggaacagagggaattatatttccttttccaaatacttgtttaagaatggaagagttcctggccacataatccatgtgcacagattttccgggggaaaatccatttgagtttagacttggagaccgtgccacctcccggtctgttcctcaggcttttgacatctgcccacacctggaacatcttaaattctggtggagaatacaaaacgtcactcccctgccccagctcacccctagttcagccccccaggatacctgaagttggggatcctccttcttagctgtggagctcagggtatgttggttccacgtccaaaccttcaaccttcatctgtaaaatggggtactgatggctcccttgcagaggcctggggattcgaggcagcacttctggcccgtacctgttgccatttctgcatgttgtacccctggccctgactcaggctggcgtcctgaacacctgtgcatccacaaccccataagccttccaggagcactatagatcagggtgacccaggattaggccgggggtgggaattacagactacccccaggactgacccagggctatacccctccagggccggtgggaacacgagtggtttttgtgtgtgtatgtggcttgcagcttgcaaggggggtggggggcaggtggcggggttggttcgagtctcaaactcctctgtcgggtcgggtcaggcctcaaactctcctctgggccatttccttctttttctcaacagaaagaacccaggctatggaatcatgtgtgggcccagcagggttcataggcaccttctcagtctgtctccagcgttgggctcttctggtcctgcccagcttgtcgctttagtacctcagtttccttatctgcatggaagcccacctgtcagcttggatgaggggaggaaagcaaagcccctcaggccctgtgtgggaaggagagtctgaaagtgcaggggctgtgctcaggaaggagcgcagcttcaggaggggctggttggctggcagtgttgtgcaggacattcagaacgtgactgggtttctattctgatttgtacaagcataggatactcaggtggctctggtctgttctctagcaggagagtctggggtcaatctgtaataatttagcttctgagcaggtgcccggcactggaagaggagagcccaagagagcacggatacattgtgtggctgaagggggcaaggccctgggctgcctcctactctgaccttgtgggccttggtgtctgctcttcccctctgtctgccactctgagtctggaatgtggcagtgatatgggtgttgtgggcactcctggcatgtgggcagctcctcagtgctggtgtctgagctccacaatgacttcattcatgtaatagtatgttatggctgcgtaacaaagaaccacaaactgtgcagcccaaatcatagaaatttatcatctcacagttctgacgactggaaatatgagattgagatgttggctgggttggatccttataggtggcagttttcaagttcacatgacattctccctatatgccagtctgtatccaaattccacccacccacccccacttttttttaagagacagcgtctccctctggctccagtcccaggctgcagtgcagtggcgcagtcatagctcactgtagcctcagcctcctgggctcaagtgatcctcccacctcagcctcccaagtagctgaaaactacacttgaccaccatacctggctaatttttatatttttttgtagagacacgttcttgttatgttgtccaggctagtctcgaactcctggcctgaagtgatcctgcctcccaaagtgctgggattacaggcatgagccaccacgccaggccacctcttttttaaaggacacagtcacattggattaggacctaacctaatgacctcattttaacttggtaaagaccctattttcaaataagtttagaggttaggacttcagcatatgaatttaggagggaacacaatttagcccctaaaactgtacttctattcttttgttttaaatttcagagcctggctgatcgtgtgtgtgtgtgtgtgtgtgtgtgtgtgtgtgtgtgtgtgtctgtctatgtgtgaaaatatacataggccgggcgcggtggctcacgcctgtaatcccagcactttgggaggctgaggcgggtggatcacgaggtcaggagatcgagaccatcctgactaacacggtgaaaccccgtctctactaaaaatacaaaaaatcagccgggcgtggtggcgggcgcctgtagttccagctaatcgggaggctgaggcaggagaatggcgtgaacccaggaggcggagcttgcagtgagccgagatagtgccacttgcactccagcctgggtgacagagcgagactgtctcaaaaagaaaaaaaaaagaaaaagaaaaaaagaaaatatacataacatgtactgttttagccatttttaagtgtgcggttcagtggtattcagtacatccacattatcatacacctgtcactactgtccatctccagaactttttcatattctccacactgaaactccactaaacgctaactccctcctcccctcctgtccagcacctcacaaccccctttctactttctgtctctatgaatttgactactctaggaacctcatatacgtggaatcttacggtatttgtttgtttgtgcctggctgatttcacttagcataatgtcctcaaggcctatctcagtcagcgtgtgtcagagtttccttcctttttgaggctgaataatactcctttacatgtatgtggcacgttctggttttccactcatgcattgatggatgctagggttgctgccacctcttggccattgtggatggcgctgctgggaatgtggtgaatgtgcacctcctctcctaacctgccccaggcatccttcagaagcggggcagcccaagaccgagatgggggaagaaggtggtttgcctgccctcccaggcttgctgggtgtctgcccgtggctgggccctggccccgggctcagggtggtgaccgccagcagggggaagtccctcttcctgccattcccccccgaccaaccctctgtatttcctctttggaggggcagtgagtgggaagggaggacccacaggtgtgcagcggccatggcccgcatcctggctgagcacctttgttggtgtggagggactccctccagtcactttcagacctcactccccatgctgctcccacaccagggcactgttcccacgccatcctcctttgaagggcactacccatcttccctgtcttgccccttcccaccctcttcccagggacttttctggtcagttccctgctgccaggtctatacctcagggactagaagctcagcatcccctctgctcttcctccttttgcctttgtcctcttagccagacccaggctcactgtgcgtcagtgcccctgcctgcgtttttctaccaacaccaggcctacctggagtgaccatcgcagaagcccccagccctgccccacctccagtgccacactcagatgtgctgccagaacgtcacctgtctccctgcagcctctaggctcccctcttgttccagacccagacatctcctaaatggagcccaagtccttggcctgaagcctgaggctccccacaaaatcaccctcttcctctctctcctctcactgccagcctgtatcccctttcccagccgtaccccctttcccagagaccacttccagccccccttagctcttagtggcctctggctggatctagaaaccaaactgacaccaggtacattaacaagagaaaagcacacaaatgtcattagttttacaggtgcatgggaaacttcaccagagtcaagtccagacaagtggccgaagcaagatgctttatcctttttcgataaagaacaataagtttgagaagtggcaggacaagggggatctggctaggggcagtaaattcttgagcagtcactgggagatatatgaggggtgtaaacctggtggaagataagggttactttgttaaagcatatttattcaggcccactgcagcccccgattccatctcaggtgataagggctattttctcccctggttcaaggaagacacccctcccagaggaatctttatggcttgctgagtatagcaagaaacaggtcagctagccctttctgaagctgcagctcgaagtcagtgtagccatccggtgtattttgggatggcacgtccttcactctttcccagcctttctgcatttgtaagccccaggaaagccggcagctgagtcagcctgaatccctccatggggcgtctttgcagctccctgcccctgctggttgaaggctctgttggtcgcattcttctctctcacagactctgcccctccaaagcccttccagccctctcctgggggctgggttatctctgtcctcagactccatggcaccgagttcaggccatgtcttagtgtcctgtggcttccttaacagaatgccacaagcttagtggcttacaacaacaaacatttattctctcccagttctgaagactgaagtcccacatcaaggtgtccgcagggccaggctgtctctggaggctctaggggaggatccttcctttctgttcccagcatctgatggcccacggcattcctcgacctggtgacagcatctctccagtccctgcctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaatttcctgaacgatggggtgataggagcatcttttgttattcatacaagcccttttctgtgggacctgaggttatgctaatgaggtgatgcttgaggggcccctagatagctgtgggacggggctggttgccagaggaaccagccacgtgattagagggttggaactttagctccacccctgaactctggggatggggagaggggtggagattgaattgatcacccgtgtctacagccatgccagcctgatctcggctgaactgatcatcagtggccaatgatttagtcttgcctacctagtggaacctccatgaaaacactacacagtgaggttcagagagctttcacgttggtgaacacatgaaggtgctgggagggcagtgccccaagaggccatggaagctcccccacaatacacaccctgttacccagccctcttccgtttggctttcgtgagtggtatcctttacaataaactggtaaatgtgagtaaaaggttttcccgaattctgtgagctgttctagcaatttttttttttttttttttaagatggagcctcgctctgttgcccaggctggagtgcagtggcgagatctcggctcactgcaacctcccgggttcaaatgattctcttgccttagcctcccgagtagctgggactataggcgcctgccaccacgcccagctaatttttgtgtttttagtagagacgcgatttcatcatattggccagactggtcttgaactcctgaccttgtgatccgcctgcctcagcctcccaaagttgctgggattacaggcatgagccaccgtgcccggctctagcaaattattgaacctgaggagggggttgtgggaacaccccatctccactcccagctttagagtcagtaggtcagaagtacaggtggcccagacttcccccagtgccttaagtgggaacagtcttgtggtactgagcccttaacctgtgaagtctgacacttattccacatacttactggcagaatggaattaaattataggacacccggctggtgtccagagactgggaggattgcctggtgaaaggagaaaacccacacgtgtgttgtcaggagagttctgggggaatagaaacacatcatagtagtagtaattggacaatctagggtgatctcatctcaaagcctttaacttcattacatctgcaaaaagactctttccaggtaaggtcgcattcgcagattctagggttaggatatgaacgtgttcctttgggggcccactacagtgggcttctcaccttggtgtcctcaggggagccagtgtctgcctccctctcctccgttaggtcctggctccgtggtcatttcctcagggagaggccctgctgtccttcctgggtctgtcttcctccctcctgcatgtgctccggtgccacctgcctctctcccgtggccttgtcatggttgctgtgatgcccacgtcacgtgactccatggattccgctggctcccatgggcaggggctgggtgtgcggtgctcaccattccatacccagcacagtgtcctgcacgtattagatactcagtaagtacatttgtctggggctaaaccttcagggtctccaggaagtctttctgagccccagagtcctaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgactagtgcccccagaaaatcgccagcaaagttgaccttctggtgattcagtctccaaccagctcaaccttcaagcaggcagagctgtcagggctggtcgtgtgggttggactttctcctccaagaaagctcagagttgtaaatacctgtttctcatctgcggtgtctagggttgcctggggagtcaaggcatcagggagcaggacaggctcaggcccttcccgactgacattttccagcctatggggggccttggctagcctggtggctttctctgtggcatacgctgattcatgaccctgacctctctctacccgggcagctgcggctttccattcttgggtgctggcctggtgatgtcattgttggggtacggcatgagggctgggaggccacaggatcctggggtgctctctgtgtacccttccaccacagaaccaaggaccctggtggcaggcctttagccagggtgcggtggctaactggatggggcacgtctcatttataaagaattttgaggcacttggcgtggatgcaagaaggggcagctgccagcctggcagaggaggagaaagtagagaaaccaccagaaccaaccacacatctccgaaagcactcactgcatgtgggtggcctgaggttatggccaggcggtactgatgtccatccggaaggatactctcagccctcgggaaacagtggaattatgttccgggttccctgcttaggagaggaaaacaggtcagccttaaaaaaaaaaaaaaattgaggtaaaattcacataacataaaatgaatcattttaaagtgaacaattccgtggcttttagtgccttcacagtgttgtgcaaccaccatctccgtttagttccgaaacattttcgtcaccccagaaggaaacccctgcccattaagcagtcaccgacctcctttctgtctttatgggtttacatattgtggggatttaatatcaatggagtcatacaacatgtggcactttgtgactggcatatttcccgtagcatcatgttttcaaggttcatccgtgttgtagcatgtgacagaatttccttccctttgaaggcagaggccgggtgtagtggctcacacctgcaatcccagcactttgggaggcctaggcgagaggaccacttgaagccaggagttcaagaccagcctaggcaacatagcgagacccctgtctctacaaaaagaaaaaaaaaattattttagctggacataatggcacacacctgtaatgccagttacttagggggctcaggcaggagatcacgtgagcccaggagttcgagactatggtgagcaatgctattccattgaatctgatggacatttggattgtttctacctcttgtgaataatgcttctgtgaacattctggtacaagtttttgtttgaacactagttttcaattgttttgattatacacctaggaggggagttgctaagtcgtaaggttatcaatgccacatcttagaaatgccttctctttggaatgaaagttgacccagcaggcaggtcacacaggtgcagctgggcacagtcaagctctgcctgagactcagtttttcctgtctgaaaaatagcaatctaaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggttctgctacgatagccagcttcggagcccccaagatccacagcccttctcgagggtagagtctgctcttggtgggtgcatggtggtaagaaggtgccaggctatggatgagcgtggggtgcagagccagctccgactgtggactctgcacccttcatgagacccgaacctctgtcccagccatggttttccaagcctctctggaggacagtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctggggcacattggcagagggtgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccgccttctgtctctatgaatctgactactgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctgggtgtggtggcgcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacataactaggagtagaattgctggatcatgtggtaattctgtttaattttttgaaagatttttttttttgaaccagtgtagtctaggggatgtgaccgcagcacctacctgggcctgggctgactgggacctaaccaggcattattcttttcgctatattatttttattttttggctgccctttttccttttatgaaagaatagatttgcagagttctggggttgggttgctaagcaaactgcctggagagaagagggtttcagatttcactaggccctccctcttccacaccaaccctgggctgtctgcactggacttcctctccccagccccactcctagtctggttcctggttcaggtgagcagcagccagattccatgcccccaccttctaccttctagtgtttgggttctgccttggataaagctttgcaggaaggatgtggctgatgagaccatcaacctcagtcctgccaagggtgaggcggcccagagaggtttttccactgggtattcctggtacgggggcaggagccaggcctcccaattggttctggctcttgggagatggtggctttcaaaatgccaaataatgtactttatcctcaagaggaaagggccttggctgggcatggtggctcaagcctataatcccagcactttgggaggccgaggcaggagggttgcttgaggccagagtttaagatcagcctggacaacatagcaagactttttctcaaaaaatgtttttaaaaattagctgggcaggccaggcacggtggctcacgcctgtaatcccagcactttgggaggccaaggtgggtggatcacaaggtcaggagatggagaccatcctggctaacatggtgaaactccgtctctactaaaaatacaaaaaaaaattagccaggcgtggtggcgcacgcctgtagtcccagctactccggaggctgaggcaggagaatggcgtgaacccggaaggtggagcttacagtgagccgaaatcgcgccactgcactccagcctggacgacagagcaagactctgtctcaaaaaaaaaaaaaaaaaaattagctgggcatagtggcatgcacctgtagtcccagctacttagaaggatcccttgagcccaggagttcacagctgcagtgagctatgatcactccactgcacttcagcctgggtgacagaaagatcatgtcgctgaaaataaaatcacgggtggggggtggtgctttgtgtacttaggggagctcaggtgtgaaaaactgcgttttgaaaaagcaggttcctgtgtgctggttagaatggggggatgaggaaattgaggggcagtcctccccacaccatcatttgccttggagcagactggaagagtcagcagaatgaggggcaacaagtatggattggagtgatctgggtgagctgaggcaggggctgaagccctcatatggaacgtggcagggatgagcaggccatctggaatccagacttaaaagcatcagtcacccagacattgatttgagatctctgcagagggggaaacggctggggtttcagccacttggagtgtcctaattccccagcagagtctggccgtgagacctagtctctctgtctcacctggcggggtgatgtgtccacttcaaagtctcactggacacaggcaggcaaaccctcaccgggcacttgattcttgcaccaggttttagcgtggacgttgctaagccagcatgtggcttcgcacatgtggagtcttacagttactctgaagcaagccctgggaccccgaatctgaccccgaagttcttgctgggctgactccctactcggtgttgacttgaccttacacgggagtcagtgtagtcatgggcgcggaaagcactcagataaaaggtgctccacccagtgatgaagaatgtgttgatgtcttaagatcgtcttcagataaacagcaaaaccgttggttaaaagctggtctaacccaccttattttgttgttgtttgttttgttttagacgtttcgcagcctgaagctgtggttttagtctctttctctagtgataagtggaaaagagggatgaggaaggggctttgctggcccgaccaaaaacaaaactaagaacccatgagtgtattctctcccttgggcacttggacacctctgctagaacatttagtagacgctgacaattccaagctaatgtaaaagccaagtctggagggtcatggggtgggagactagggtgaggaagttgttaaaggaggccaaggggatggcacggccttcatctaatagtgacagtagcattttagagctagagggtctttatccattgtctagttcacatgcatgattttaaaaaaggaagctgaggcaggaggattgcttgagcccaggagttggagactagcctaggcaccttagcgagtcaacgtctctgttaaaattaataaatgaagtcaagaaaggtgaggcatggacggcctcagtgacctggactaactcacagagaggtagcaatggggagggccagagcctcgcttctgagggattacaccacagctcacttcccccacccaaaggccaaaggaactgagcgttaataaccaacatagcgatcttggtacctggagccccctcgatgtcccatggattaaggagaccagattcctccatacagcttgttgagggacttggtgggtgccccttgctcttggggtcttcctactttggctgctatgctcaacccagacccagcctcttcctggaattctcctttcaacacgcacagagacagaacccggcccggactttgcagccagtagttgtgtgcaatcacctgggacagtgctgcaggtcagcagccggcaatgctagacaccgggttggggtcgctcagcaggtctaagccctggctgccagctagattcccccaggaagcccctatagcttcggattcagcaggtctgtgtggatcccggtgaaatcgttttcaaagcctcccaggtgttgccgacgtgcagccagggctgaggacacctgttagagggtgctgagtcctgtgggacgagaagtggagaacctgggagagggagaggcagaggtgtgcaaggaagccggaacttcggccacctgcacccacagctagtggcagatcactccagacacacggctctccccggccttccacgtggaaaggactgacaacagtctccacttcaggattgctgggtcagttgctctgagtgcctgagggcagccctgtgcccacccagcctgggtgtgtgtggtggcagttgtaaactcctgaatgaacaccaaggtcacctctgctggtaacctttgggcagggctgcttacaggtgactcatggtgagagtgacgtcaccccatcagggtgagctctcagaagtcccatgggcctcaaagtccccctttggaaggagtggagaagggatcctcacatgagccatggattgggccagaagatccttgtgggttgacagtggtcatgatgagtccactggcttagaaaactcaggctgagaacaggccatggaggagctccagatggctaaggccttggaaacacgtgttgagctttgtcattcagcctgggaggaagggagtgattatctccaggtgcctctgggaggaatgaattactctgtataaccagatagtcccaacaggcagggggcctcttgtaggataagccactctgtcctcctgcgggtactcacattggggtaagggtggtctgggatttcgacagacctgctggaaggtggtctatgactcagccagaagctgggccagactgggggatgggggaacctgtagccccagttccctgggctggcatcggaatagcatggtaggactcgctgctcatggtggacagaacttgcaccccagccagcatgctggcctgtgctcctcaccccatcagaccccatgggcaggtgtgcaaggtgcaaggaccgttcctgacatcaagacggtaacggtaacattttgggtttccctttctttttcttttcttttcttttttttttttttttgagacagagtcttgctctgtcacctaggctggagtgcagtggtgcaatcttggctcactgcaacctccacctcccaggttcaagcgattctcctgcctcagcctcctgagtagctgggattacaggcacctgccaccatgcccacctaattttttatagttttagtagagatggggtttcaccatattggccaggctggtctcgaactcctgacctcaagtgatccacccacctcggcctcccaaagtgctgggattacaggcatgagccactgtgcccagccagggtccccctttctatagcaacccaacccccctgtatgggggagaaccaactgttttctctgtacacaagctcaacgcagaacacttatgtgaccaaatgtaggggtttttcccacaccaagcagttctctgcagacaccagctgggtgtcctacaatttcaactcagttttgacattgtctacctggagttagcatcagatcccactgttaagggctcagctccagaagactgcccctaacgtcaggtgtcagtagcaagtccaggttatctattggccgtaaattggaggttcctacagccccctccttgagtttgatcacttgctggaacggctcagagaactcaggaaaataacttactagctgactggtttttaatacaaagatacaactcaggaacagccatatggaggaggtgcacagaggaaggtctgtgggaaggggtgcagagcttccatgccctctcggggcactgccacattttcagcaacctggaagctctcctaaccctggccttttggacagccctcattgtgtaggcatgattgattacgtcactggccattggtgatcaactcaaccttcaactgtgggtcttccccagagagttgggggtgccaactctctaatcgtgtggttggttctcccggcaaccagcccccttcctgaggctatccaggagccccagccacctgtcatttactagcacacataaagacatgtattactttggagattccaagggttttaggacctgcatgccaggaaagtagagggtgggatatgcaaagatcaaatatacatttcttaagtcacaaccccctgccaggggcagacgtatctcagaaagccccttgtattgtctagggagtgagctcatgttcatcccccctcaccttgtggtctttgaccagtcagttgtgaaggggacgtcagcatacccgaggtcgttgtgagatgcctgttggggacagagatggtgtcagctgggtgcttgctgggatgggttgagtatggatgctcccttctctgtctctaacacaggatgcttctttgcacacacagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcggtgagtccccatggtgtacgtgtggcaggagggccaggtgaggctccctgaagcgcagccccatgctcaggggtatgtagcaggtaggtggtggagcagccaatggtttggaagcgagtgggtcaccaaaaactccttcctcatctctacatgtggtacacagacagcctgccagatgtgttgatcagggagatcgggggatgctttgaactgagcgtggaggaggcaggcagcatgtggtcttgaggctgagaatgtcagcaccagaggccaccaccaagacctgcgtggtggcgccggcaacactcctgagccaggtggtgtctgggcttgggtccctttgcttcatagccttcttgctcccttttaccaaagcgtgtgctgaggatggctccatccatgtgaccagagcctttcctgtgaattttcacttgaccctcattaataattcttggcctttctgtcacttccactttacaaaggtgaaactgaagtccagtggtggcttccccaaggtctcatggctagtgagtagcggcacattcagtagatgctctgccatgccctccaagaaagcagtggacccacgccccccctcacatgagaacgtagcccgggctggttgcaggctggatggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcactctgcttagcttatttctagatggtttccaccatagcctggcatggtggctcacacctataatcccagcgactcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctgacatgttagctgcacgcctgggactgctgcttacgtatatacttttgtgatttctgaaggccttggtgctgggcaggcttctcattctgaaccgagaggatgggagaggaagccagtgggtaacatgtacctgctccgtgcagcacacacaggctgctgccttaggtagcttcctatcccacgtcgagtgtcagctttttacagactaggaggccgaggttcagagaggtgaagtaacttgcttgggccacacagctccagggtttgaagccttcctgattcttcaatgggcacactttccctccctcaactgtcttgtctttcttggtgcacccctttcttgctgcattgtgagcgtggtttggtacaaagaaggaccaagttcaggtaggctaagtgctgaacttgagaaaggcaatttctttccatcattcttgagggctatctgcacccagccagtccttgatgcagttcctggccccgaaaggaagctgatctgcccactcagtgccccagtccctgtccgggggtgggggcctcccacccacacctggctctgacttggagtacagccttcacctttcagtccagggcttctcctctgtgaagccactccagatcctggtcccccgacccctgctccctgcttctgccctcacaggagctgtagatgtttctcgtggtgcacatcctgcaggaggttgcacgtctctgcctgtcaggtccagagtttccaatcccaagcacgccccttggcccagagctggtctgaagaggaggggatttgattggaggagaactgtgtgtagctcctttccagaaaccttctggtgctcttcccagtggttggggccccaggacgggtacccttcactgctctggagacaagcatagccttgacttcctggtttccctgccagccatgcaacaagccatgcaaatgtcatctttcatttctgatctttggtttgaagacatggctgtcgcttcctaggacacctgacttcccccagggagcatggtgatcttgaggccagaggcaccctgatcctgaccatccagtgggaaatgggcatcaggctgctcatccctctcctcctgcacgccacccacccctcatttggtcccagatgctgatcttgagtctttggggtgtcagtggactcctgtggcatgggtcttctctgtgaatacccactcgtagtgcagacagaggctggacagaggccaggcacccccttgcccggggtgctgtgggaaggattcacacaggctggcctgttgcgacaacctgcagccccaggaccctgtacagaggccagccccttgccctctggtatgccttgagggccaggttcttggggtgttcgccggctgggccgcaggacaatgtccagtctgttggtaatgaaaacctgcccttgcccagagcaagagggtcctttctccagcagctgtgctagctacacactcccagcccagagcagcctgcccctcgcagtaagggttttgcaccctgatcaccactgggctcccccagattagggggactaggaggagggactagaaggggcctctttgcactctgccctgtcctgaagctcagttccagctcccgccctcagttcacccgtgggcctggtagccagctgacaacagttttattcacctgttctctgttggcttttcctgcttggttgtcacaagcccagtttgttttgtgggttctttattggcttttatttagcctcaagttttgtgtttgtacccacctaggtagggtcatggtaggagggccttccttccatgtcactgacttctttttccaatttccctttacctccggcttcctacccgccccagcctccttgcctgcctccatggccctccctgcattcacgtcctttcccataactggcacaagcacagccctgagttataaatagccccaggccaggccctgccctttgctctctcgttttctctgcatggacttggctgatttctgagccatccctgtctgatgccatcagcactattcaggactctagaagattcttagtctaaggagaagtgcctcatcctgagtcttgtctccaccccaccccgtccatgccctgagccagatgttccctgagcggccccgcccttcagaacacggagggagagccagattctgccttcctgcctgtgctgtttttcctcctggctttccaaaccatgtggacagaacgagacacagtgctcccacccacgccggcacaagcatctcacactgggtggggctgtcatgggccctgctgccctagcagcctccctgggccctacaggccgcctggtactcatagtagcaagattgtccttagaacatgagcacggctggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgggcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaagtgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagttcctagctcaggcacagccgtggcctggaggctcccacccgtggagtcactgcctaccctgccctggggggacaggtgtgcatggaacctgcgtgtccttttccttggagctgctctcagcccagatcttgatggctgtcccccccacacacatgtacgtgtgtataaatgcatatatatacacacatatacacaggcacccgggcatgctgacacctcatgcatacattcacacaagtgtgcacacacttaggagattcccagggcaaaaaggtggcccaggaaggctttttagatggtcccagtgggcaagtgaggatgtgtggtccaagccccagggactcaaatggggcacagggtggggctccctccccgggcagtggaggctcagggccggagggcatttgcctgagaccatggggcaggccaggccctgggcacttcgtgttgaacctgctgtctataccatgacatgcctccctcctagagggccagggaaataggacagcagggttgggagtaggcaggggctgtgctgggaccctgattccaaattctacagataccatgaggcctgagctgacctcagtcagatccttcctcaaacccatcagttctcactggaggtgattctgctcccagggcatgtgtggcagcgcctggagacattgtggctgccacacctcgggggagagggtgttactcacatacgataggtagaggcaaggatgctgcacagaatcctgcaaggcacaggatgccacccagcccctgacagagactcctccgggcctagatgtcagcggggccaacgagaagcctgcccgcagccagtgattttccccgaaagtgggaaagtgagtgatcagggaccaccgccccagttccacgcctgtgagcccagcaaccagtggagaagtggacggggctgtcacagacaccggacctggcaccacccccaccccccgcacccacacactttcctctgactgcaggcagggccattgggcacaggcggaacaaagggagcacggcctcagcccggtggagcactgaggtgctgccatgggcatggccagcctccaacattgccagtggccagggagtaggcgggagtggccaggaagtcaggtggcgatttctgtggcctttggcatcatcatctttggtgtcatgcctttgctgggactgttgtaacaaagcatcacagactggggggcttaaagaacaggagtttattttctcctagtcctggaggcctgaaatccaagatcaaggggtgggcagggttggtttcttctcgggcccctctcctgggcttgtcttctctatgtgtcttcacataatgttccctccatttgagtctgtgtcctgacctcttcttttacaagcaccccagtcctggtggggtaacatggctcatgcctgtaatcccaccactctgggagtttgaggtagaaggaccgcttgagctcaggagtttgagaccagcctgggcaacatgacaagaccttgtttctattaccaaaaaaaaaattttttttttttttttgagatggagtttcgctcttgttgcccaggctggagtgccacagcatggtctcggctcactgcaacctccccctcctgtgttcaggcaattctcctgcctctgcctcccaagtagtggggattataggtgcccgccaccacacccggctaatttttgtatttttagtagagacggggtttcaccatgttggccaaggctggtgatctcgaactcctggcctcaggtgatctgcccgcctcggcctcccaaactgctgggattacaggcgtgagacattgagcctggaccccccaaaaatgtttaagttagcagagcgaggtggtgggtgcatgaggtcccagctacttgggaggctcagatgggaggatgacttgagcctgggctctcaaggctgcagtaagctgtgactgtgccacagcgctccagcctgagcgacagagtgagacatcgtctcaaaaaaaacaaaaaagaatgtgacatatggaaccttttggcttcagtttaccttaaaggccctgccttcagatacggtaacgttctaaggtactgggggttagggcttccacgtgaatttgagtggggaggggagatgttatcataactaggactagaaggtggcctcccaggggcatgggctctgtcccctacatcaacatccaacaatgtgtcagcttcatcatttggagacaaaaacagtagagcttccctgaactttcagcagggacgctaatgagaaggggggactttgtcatagcccacatgtaagagggtccctgccagtccagtgatgtcagggtctaaaaagcagggtcaggggacacaggccttgagccccagggacagggttcttctggggcagatggtagcagtccctgtggctgggagggagggcatctggagaaggcggtgctgcctgggccccgtcaatcgaagggtcatgtggcggcagcagtcagagaatccaggtgaggcgggccccaggtgagcagtggggagtggagtttggctgcagcagaagccaggtggccatgctgtgggctctgacgccccctcaggtcagagcctccttctccttccctgactgtgtcaggcagctgcccttgggttgcatgcagaagcgtggagggaggcctggcccagcctgctccgcaccaaactctgtttcgtggtctggcaagagtaagggtggccctggtgttgccagatgacccccctccccgggattctcagtgactgtgagtgtgtggcttagtatgtgcggagggtcccctgcctccctttaattccatgtggagcctttgtgggggcaggggtttgtccagaggtcaacaagctggccctcctctctcagagggccctgatggaagaatccccctaccacccttccaggctgacttctgtctatttctcctgcagagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagataggtatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtggctgggactacaggtgcacgccatcacaccctgtgtgcaccatcacaccctgtgtgcacacactttccctaaagcaggcttcctccgctgggaaacaagtcctctaggggcaggtgtggccagaggccaggcccccctctaagtgtgaagagcatgtgattccttaaaagcccttcccccagcacttctggactaccgagacacacagctctggcctcgggcctccccttggctggtgctgggggctgagttttctgctctgaggtgtggctttcctgtagggggacccctccctctgccaccctgtgctgcagacccccagactccaggccagagctaaggcttgaggaacacagaaggcacttaatttgttccagttcttgctccctggggctctttcccccatggccagagagcaggaggctgtattttgatacatgctgccccctccatctttgaagcccccccacccccgtttctccgtgtgtgtgtcagcagttttaaacctagtggagggtggtggctcgggctgggctccgcgtcgggctgccccgcagctgctcttgggcagccagggccgctgggtgtggggccgccgggaatggcgggcccgggtgagggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaaactgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaaaaacacacatccagagctctttgccagataatattccgaaatcactcagagacttttttaaaactttaatatctgaggaacactggaatttaactttggaaggtttccgctggctgccctggaggccttgagctaccttcatgcgtcagatgatgcagccggaagactcggaggagaggctggcgttgcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcctcctgtggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcacaagaagttttccccctgaatacttcatttgctaagaacaaggacattcctataactcacagtagaatttgtcaaattcaggaaatttcacattcatgagatactattatttaatatgtagttcatataaacttcccccaagttaacaattacattcttcacagctgttttcattctctgattcaggacccggtttaagatcatgttatgtacttggttgtcccatctctctagtctccttccatctgtaccagttccttagactttgcttgtcttccatgaccttgactttttttttttctttttccttgagatagagtctcactctgtcgcccaatctggagtacagtggtgcagtcttgtctcactgcaacctctgcctcctgggttcaggcgattctcctgcctcagcttccctgagtagctgggactacaggcacgtgccaccatgcccagctaaatttttttgtgtttttagtagagacaaggtttcaccatgttggccaggctggtctcaaactcctgacctcaggtgacccgcccgcctcagcctcccaaagtactgggattataggcatgagccaccgcaccctgcctttttttttttcccttttggagatggagtctcgctctgtcacccaggctggagtgcagtggcgtgatcttagctccttgcaacctctgcctcccaggttcaagcgattctcctgtctcagcctcccgagtggctgggattataggcatgcgccgtcacgcccgtctaatttttgtattttcagtagaaactgggtattgccatgttggccaggttggtcttgaactcctgacctcaggtgatctgcctgcctcggcctcccaaagtgctaggattacaggccgccgtgcccagacaaccttgacattttttgaagggcacaggcccactcgggtttgccagtttcctcaggaatagcctcacgttctgcgtaacagcaccacagcagcgaggctgtgtgcttctcagtgcatcagatccggaggcacatttttgattagtgaaaaatgtggaaaggaattgcttagaactttgcacaagccacctggaagatgtgagctcctggagcaggagggaggagaagtcttgaaaggagtcctcttcccaagacccctgagaccctgctgagctgtcacctcttctgagaggctgtcctggtcctgaccacattctcaaaagcagtctccttgctctcagtccctgtcctgcttataaccatctgccattactttgcttgtgtgtgttcatgcatgtgtttatcaggcactgtcctgttagaacaccagcttcagagggcagcgccgtgtctgaattgtttaccactgcggtgacaaggcctaaagcaggcccttggctgctttgtaccaaggctgggaggcactcagtgacttgcaaaggagggaggagggaaagaaggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaacataaaattcaatataaatgcaaatgcacatggaaataaaatttaggtttgacacaaaacaaacaccaggagccgtgaatgccttgggcttccagcttgcagtcagctacagtgggagtctccagccctgaccagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtctccccccaccaggtgtgtagcatgacacctgagcaccctcaccaggcccaggatgggcttgtgtctgtgcagtgggaggctctcttctgcaaagacggccggacttggcatttcttatgtgtctgaagggactggacatgcgtggaacaccatgggtgggaaagggggtgacctctgtgtccagggtacactcttgcagccagaatgggaaagtgctgagcacagacacttgtccagattcactgacaacctcaaacttcagctgccgctcatggcaccatttcagcgaatggggtgggaggaataagtagctctggaagggaactgttacctgcctggcgccgtgagtcacttctcagcatgtcattttgggagcgggaagtgtgctgggtgcgtggggaggggagcaggtgggagggagcagcacggaagcgccgaggcctctgcagcctgtgtgccgtctgctgtccctggagtttctgcagagctgtgcacgggagcctgctcttcagaaagatgggggagcagcagcacctgtcccactctctcttccttcctccccctcaggccagccagctgggtgtgtaccgggccttcgtggacaactacggagttgccatggaaatggctgagaagtgctgtcaggccaatgctcagtttgcagaaatctccgaggtaatgccttgatgccgttcagacaggtgcaccgctgactcccacctgtaccctccacctcccgaggagaacagagtgcaccagatcaagatctggtcgtgaaccccagctgtttccagattctgttgggttcgttgcgtcagccctgtgctggggatgctgttgtgcgcagaccgaaggagcagcccacagggcgtcctgcctccccgggggcgagggcctgattctgggggttgccgagttccggggacactctttgcactgtctgtctgcagtgaggggtgtctgtagttctgcctgtgagcagctctctccacaagagtcctgaggctgactttgtacctggcactggaggcgaggccggaggtggcccactcttccttttctagcctgccagagaccttgagagcattgaggaagcattgaggggctagcgccgtggggcgagggctcatggcacctgtgctctgtggacccatgtggggagcaaagcgacaggttggagctgcactaacccaggccccaggtctgagaggctgctgactccctgcctgcatttagccccaggaagctgaaacctcaaaccatgtggtgttagcgcccagggcctcgaaagagtcattcagaaacagagaccatgaatgggccattcagaaggctggtggcccagccagaaccagaacccagccacacccctgggtctgcactccagactggggttctttctgcccttctccagcctgtgtctgcctggtggtcactctgcgacattttcctctttggaggcccttgcctcttcatgagccccccatctcgctgtagctttgccttctgacttggctttcccccacccagcaagggttctgagcagaaagccctccgtgtgagaaccgcagggttagaaagaggcatgggcactagaaatagggagtgaatgcggtcacccttgctgggacaccctcagctgtcacccctgggctttgttgctgaggctttgtgccgtcttattgtttatcaccggatggagcatcacgggcttcgctctgatgtctccagtggtgacagtacctgccgctctgttcttccagagtctgtggggcaccctgctccgccaggtgctgctggtaacaggctctgcatgtatccggggctccagctccctccccactgccagcctccctctggaccattcaatctgttctcttttcctttttcattaaatgagcaaccctcctcccccacagctggaatggtggcatcgaatttcaagtgaccttgacaaatcagggacctgatcttttaagaacaggttacagttaagcgggcaagttcaagtccacccagacaggtttctgcagaggagggaggaaacaccatgggacgccacctggggatcacgtggtgccaccaaccatgcaccagtggattctgagccatggttgagatgcagggagtgggatggggctcaggaccagctgcaaaccgacccaccgtgaaagtttgtggcacctgcaccatcagggcgacatgcactttggttctctgtgtttcaaaaaagacccagaggaattggagccacccaaagaaagcagagtcaaacgcaaggaagagaaagcagcaagccctgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaataggaattacatgaaaagggctttgggagtcaggccagtttgggaaatgcagggttaaaccaaactcacaagttttcttgaggcaggttttcctggagctcctagataactcccaagcatcacactgtccacggacacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggcagcgtttggccccagtgagctggaaaacactttcgtctggtcttgagatgtttcctgcagcacaagaggttggcagagcaacctcagaacctcttctgtctctgtttatgcttttgttcagaagcttagtaccaggaattaatctcagctccttcccagaggattttaggcacacagggatcttttattctgcacttctccagtgatgctttcaacacaattgtatcaaaacagcctaggctattcacttacaagccctgcttttgccctgggaatcttagcacctcattttttagtaagtacacttgcagatccggagagggcaggtggaggtataatccagtgtcagtctgcagtggtgggcctgccctggccgtctccaaagatgggtgctcttcggaactggcagccccctgcatgctgtctaattgccccaagaaaacagtgacgtgtgtttaggagcatgctcctgttggcctccatttacaggatcctctgtgtcagaggatctcagccaggcgtgattttgttcacaagggacacttggcaatgcctggagacattttggttgtcaaaacagcaggaaggcagacgtgctcctgtacctataggtagaggccagggcagctgctcagcaccctaaggtgcccaggacagctgctcagagaatctgtagcccaaaatgtcaacagtgacctggctgagaagccctgtcccaggtggaccgcagcatccagggcatcctgcgtgctcggcttgctcgtgggtccctgcacaccctgtgacttcattatcagctcagaatgcacctggggtttgttgtagtgagggaaagctgaaattgttgccaaagggggaactgtctgcatcatcaaagctgcttctgtcatctgtgtgaacatgcgcttttctctctgcagaacctgagagccagaagcaacaaagatgccaaggatccaacgaccaagaactctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatcctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcagagcacaggctttaagtggctgggcaggaattgagtccagagttgctgggaaagtgctgtcaggaattgtcagtcacttcttattttcagttgttagggtgttgtgaatagttacacttgcaaagaacagcagcccccggagctttgtcctccaagcctcagtttccctatctgcaaaatgaaaatagcgatgagtgccttatgctggttgtgggagtcttgtgaagaacatacttggcatgtctcagaacacacctaagcgtctgtgcctgggacgggccacactcactgtcatcatggagaagcacgggtggctgaggctggccagggctcccaccatgccagggagttgctcccactgcagtggggctcatgtgcctctggagtccgggtgtcctcgggcaggtcgccagagaacctgtcaaaccaagagttgtattggcatctgagtaggtttctgcttgtctcagagtcaggtgtctgaaatgtcctgggatcgatggtaagagcagctaagaggtctgctcagcttaccctctgggctggggagcaggtctccctccagaattggggcccaccccagcccgtccttgccagggtgggttccctgacctcaggctagaggagcagcagtgctgagccttttcagctgttgccaccgagccagccatgcaggctcgggtctgacagccgctctggactctgcatgcagtgaatgtcctggacttaaagtgttcctgttgggtgctctagccttgcccttgtcactgcgcagaggggagatggggcctgtggaggctggggcagccccctccccactcacccttgcaccgagggtggtcaggcagctggtgtgcttctccatgtgcaacctctctcacctcccctctctctccacagctctgctctacaagcctgtggaccgtgtgacgaggagcacgctggtcctccatgtaagtcacagcgcccctctggaccgggaccaaaactgccccctcgggcacacacagcaacaatgttctgagacctttttttagttgtcatagctgcagccaagggggtgctactggcatctaatgggtagaggcctggggtggtgttggacattctgtagggaaaggacagctctctcttgtccctccacaaagagttactccacgcaaaatgtccacagtgctgaggttgagaaaccctgccctagatccttacagaggagtccttcttggccatgtgcatgcagcgtgagtttgctggaacacatgtaggacctgcttccaggatggtgctcacacaagctctgtccacaaagctggggcccaagtgagagagactgtggtgacactgagggagccggcgctctgggctccgtccacactttgtgtctgcactttgcacacagtggcaggtgccagtgctcctctgtgtctaactcaagtctttcttcctggggcaggacttgctgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggagccagtgtccagggggaacagcttttgtcagaagcagcactgaggcgaggggagctgacccccggcctcaggggtctcatgcagggacagaagctgtctggcccaggcaggacacaggctgggcgtgaacctgactgtagttgcctcagaaccacctcatggctgggtgcggtggctcacgcctgtaatcctagcactttgggaggcctaggcgggtggatcaggaggtcaagaattcgagaccagcctggccaacatggtgaaaccccgtctctactaaaaatacaaaaattaactgggcacggtggtgggtgcctgtaatcccagctactcgggaggctgaggcaggtgaatcgcttgaacccaggaggcggagtttgcagtgagccgagatctcaccactgcactccagcctgggtgacagagtgaaactccatctcaaaaaaaaaaaaaaaaaaaaaaaagagaaccacctccttctctttcttctggttcatgggccaggtggtcggcactgtaccaaggacacgggccctgtcctcagggcccccagggtggacctgcccaacacatggggcttgctttcctcctcctgccctgggccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcagggtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttcccatggcttctcctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccgaggcaggcggatcaccaggtcagaagtttgagaccatcctggctaacacgataaaaccccatctctactaaaaatacaaaaaattagctgggcgtggtggtgggcacctgtagtcccagctactcaggaggctgaggcaggagaatctcgtgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctccccaggacctcgccctggtggaggggcacttgctcattgaggaggggtcacctgggtgccttagctgcaaagcaaggtggaggactaatgactctagaaaagtcaccgtgagtctgaccagcaccccttcactcagagctttctatccgaggcacgttaagggaggtggcttgatggtggctaaggcaggatgatagatgcctgtgctttgcccctgcccctgccattcctggggcagatgctgctgatcagttgggcactccaagcctggacatccacctcggtatcccctggcactgcccaacgggtttgcagtccttgatgcagaaagaaagatgccagatgggcgaagccccgtcagggtccgctctccctcactgctaccagtgtactgatttggggacacccttttgcttccctgggtgtccgtgctctctgagggcaatgatgcagggtccgtggcccctccactgggtgttgagactgaaaaggtttcacagcctgcgagggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctcccttttacagatgaggaaactgcgactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggggctgtttctgtcttccctggcatttgatgtcaagaggaaagctgcttctgttggcctgggtgtttcgaggttctcctgcagtcactactgggcctcctgggaggtggcccattgctacctgctgagcctgggcaagtctggcatcgaggagaggcccaggtatgagccctctgcagggtcagccaccccagccccagacccccactgtggctcctataatctcattgcccttttcagccacatcccatggctccagggctgtgctctttggggaacagtgactttgggctgcattccaggtagctccctgatgctgaacggtggccggcaggtgctccagcttcctggcatcctggcccaagcacacctgggggccgtgagccacaggtgctgcccaagagaatgccctccttagccttcccaaaatgacaggatcaaaggatcccgcaggcacagtttctttccaggcctgggttctgagggctggtgggtggcgctcatttgtttaggtgaattaacttcacagttagataaccaatccccactgctgggtgacttcccacgtggttgcctctctgtctactcggagccttggcaccatgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagacagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccactggacaccaaacagaagctgtaagtgcaaggctagtgcccatgtcgagggctgggcctttctgggcccttcataaacattggcaaacaaagcttgggttctcggcttgtctgggccaagttctaattccttccaggagcgtgggcacgttgcttacctcttagctgtttcttctccaggaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacaggcagtggcagccagttcagtggcactcagccaggtctccaggggtgtgcgctttgctctgggggcagggtagcgggggctgaggccactggctgcctccagggcccccccaccagccagcagctggaagctccaccttggtcttcacttgggccgtcttccttctccacttcctcagctgctatgtgggcttctttggcaacttttccttgtctcaccagtcaaggccctgctgatttgttgatgatcagactgtagttcgtgtacctggggaagttttccagcatctccatggagccatggtctctgattcctggagcatgtcgtagtcggttcaggctgctgtaacaaagtatcatctgctgagaggctcacacacaggcctttacctctcacagtggtggaggctggagatccggcagggtgccagcagggtcaggttctgatgagggcagtgagaagcacggccaccctcccactgtaccctcacatggccttcctgggagtggacatggagagagaaaaggacctctctttttttccttcttatgaggacactcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgatgcgaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgtttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacacctggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactcgggtgggctatgcaggaagcctgtgctgatctcaaggccaactgtcctgtactccaggccggggaccaggctgctgagcgcttccgagagggacatctcctgggcagggagtgacataggccacgccatgtgggcctcccagccatgtgctggtgctgtgtgggctgggagggcaggcaggggccgagtgacggggactgcagagcggggcctgagatgctgtgacatgctgggctgcctgtggctttcgggcttctctcagatgagagttgcacaggtgggtggggggttggggagtctgtggcagcatcaaaagagtagcccagaaaccgccgagtccactgttcgagcctcccgggcctgcagcccgcaccccagaggggccacttcctccccacagtcaggcctgtgtgtcctctcaacgtggcaagccggcatgtgggtgctacaggtccccagtgtgacactcagtagccttgctgaaggccgagggtgccccttaggtgggttgtgggcagcctctgctggagagggagctgcgtttcttgaccgcaggcagagtgggctgggtctgcagtttctgagctgagcatggggtgccctctgctggtgatggcgagaagctcactgcctttgtatggagaaggctgccatccagccccgccactgccccagaaggaaggcgcctgagacccctcctccttggccgggaggccctttgctgtgtccctgccaagaggacctactgcagtccttcccgaaggacctcagtgtcctgggaccctacccagatctggtccccactgcagacccagcagtttgggttacccggcttcagcgctccagctctacatgatgtttctccaggtgcacatgctgtttcttgcttcccgtgggtgccgtcaccaggcagccgtctgccctcggcaggcggggtgtgggtgagtgccgatgagtcatggccttggcacgccggcagccttcctacccttccacttatgggcaccagcagcccctgcgtaattcattggttccccttcgcaagagccggctgcctgtcgtgagccaagctgcttatgatggtgacatgaagcctccacctctgagagtgtcggaggactggcccaggctgttcttgcaaatggggagctctgttgcctccggccccagaatgggggaaaagttcagagagaccgaggctccccgagaagaacctcaggctgcaggtgacagcagggcaaggtgcctggtctggccccaggaccagcctggctccctgagagcacaaggcctcatcacttctcgagatgaggacaggtgcaccgcctgcggggagacactgggttttcacactctctgttgtatgtgcctcccctgccaacccttctgactctcagtgcagggcgggcgtcgtcctccctgtgagccttccctgagaccaggtgggctgggtgcccactaaacacttggcctctctgccacgaggttgtggactcctgagggtagaggcctgtgaatgttacccctctctttctgcgctgcctgggacagagggtggacctccctgaagctctgttttctcattaaggacctgcctacagcctgttgtggggattgggtcaaataattcaggcgatgtgctcgtgcagtgcgctggtcccagcgtggggaaggcttgctgcgacagcctctcctcctgtccctgtaccctcggcacagcgcccaaccctgtgaggtaccaggcatgggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccatagaccatactgccacatctgtacctcgggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgccccttcagacccacacccattacctccccctctcccccatcctcccaccctcttccaaaggctgaacacacaggagggattgggaaatttgttgaacaaagaagttacacataagccctgatgtgttagcaggacagtgagatgaacaaaacgttctggaaagtgggtgtgagggtcagatgtggagggagtgaaatcttcccagggagagaatgtctctgggtcaacctgctcctgctgggctgggagggccgaacaccccccacccatcaccccaggctggccctgaccccagccttccctgtgcctgcagcaccggcagctgctgaaggacagcttcatggtggagctggtggagggggcccgcaagctgcgccacgtcttcctgttcaccgacctgcttctctgcaccaagctcaagaagcagagcggagggtgagtgacgatgtggcccctgtcccagcagtgaccccaccctgactctccaggtcatggagggtcttgtcatggcggaggtcagtggtgatgtagctcgttacattccgtttctacttgggcacaatgccaggctccaggttaaagattgtcactagcaatctggagacgtcatggggcatcagggtgaccagctttgactcctgtagtgaggggtaaacccgaccgtggcttccggcactattgcagaaaggtcacctcaggacccatccgggaagcgtgagatcaggggctgcaggcagtgctgggtggtggctgctccttgtctccccgagcctggtggtggctttccgagttatcctcggcataggcgtgcacacactcccctcctccctcctccctgggttcacccaggttgcaccaggttggaatggagcaaagagggccacactgggaaggaccagcacggggctctttcctgcatcctgccgttgccctgctgagtgggtttaatcagtcaactcagaggagagccttagttcccccatctgtcaggcgaggggatgacgccagctagatctgtagtccctcaaactttacggccctgggggtggatttcagtcctgtcctgtcattgtgcagccttgatgtgctcccacatgagccttcaaccttagagccagctcaggacaaggtggatctagactcctgagatgcctggggcctgcggtcacatgttcagagtgtctgttcccaggaatcctggcacctgccagtggcctcatcccagtctgtcccatggaacacgtgctgggttttaggtcaggtaaaccatgtatggccgagaacactggctcttgggctcttgacagcagtgacatcagccatagaaggcagtcggtgcatgtgaacgttcttctctccccatccccagcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaaggtgcacaccaggggagcaagggccgggtttggtgtggtcagagtggcagcagcccccgcacacggccagtgggtgctttctccgtcaggcctctgggccccaggtctggtctctgggacccctgtaagctctcagctcttggagggctgggcatctgggcacaactaggtgtccagttgttctgagaacccccagctaaatggggagcaccataccagagcggctgccaacccaaccctccagaaaaatgaagggaactggtcgtggtctctacagtgcgcctttcacgggatacttcttagacctggtggactgcctcatgcttagttgtctgacctgtgaccaggggtccctcacgagagaaacttgtttaaactgtgtccagtttatgcccacctgaccattgctgtggcactgggagcctgattttgtgttttcactggcatccccggggaaaacttaacctaggcaaacacctcctagtttttcggaaacacagcaccacaataggaaacaagttcagagattttacctacaggttttggacaaggaggtgccatgagtagggagggcagtcttctgtccctgggtcatgcaaggcagaaatgaagagttagcgcatgacagctagcagtatttataagggaacagggtgtgatcactttaagttcacaggcaaatgcctggatggtccttttaaggaagcagcaggaatgcgggagctcagtcagccgggcgggagagaggcttccgggttctcacctctggccacgggcttgagctgttcaagtgtgtggtctcctgatacccaggctgcgtcctttgccgtgtggttccattacatgggtgaagtactgagtcaccagagagaaagtcacagccagacagtggagggcttggagtagtccaggatgcagggttgggggaggtgctggctgtcccccatacaagctaccctgatgggggccaggcccaggtggcagtgccacccctctaggtgttcaggactacctgcccttggttttttccagagatgtttgaagactgtaaaaatggtgaggacaagcccctcaatcaaaggttagccaggccagaggaggcgggtggcatcaaggttaggcctgggtccaggtatgcccaggtagggtggacgcagcaggacaggaggtcctcagcccttgcccagctgcccagcctgctgtacccaaacccagcacacttaggaacacagggagcttcaagactggggtgaacattctattgtcatccttgtgggactgtgacctccagggtagggtgtccccacacagagtgggagccagtgctcagggcagctgagccctattgactgttactgttgcattctccatgttcagctctttgggggatgggatggggtggggccctacctggtgacaggcagcacagttttctcctccccagggatagtggcttctagagtgaaacccatggctcagcataggaagggccttcccatccaggttctgttgacggtcgtctggtcttctgctggcatctccacaaacatgcccaggggcccgatgctgaaacctagttggattaggaagagggtgagggaccctgtaggtcacagcagcctcctggacattgtctgaatttgggaaaatgaaaggcagggatgttggtaaaagtttcttctctccgcccttgtgagaggaaagacttaattcctccaaaaaaggtttactgagcatgtcctgcagcttatgccatgccttgaccctgtaaaaaagctgtttctgtcctccagaggccaccagcaactgcggtctggggccctggtctgtgctgagtggagagatgggattcttgccctctgcaggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggatgcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctgtcaatgtccagaatggcttgttttctagcctgaccaggagaggcagctggtgggctctgcagaagcctcacctctgggctagtgtggggcttgtgaattgaatgcaggaggtcaggtctggatcaacgttcacctctgcagatcccacctggttacctccatgtccctaagctgtgcccctctgccagcatcacaccctgacccatgtagttcgggtgagagatggtgtgccagaggtgctgtggcacccagctggcaggaagggtagggagtgccggaagcgacatgccaggccgtgagcacacctggccactgggctccagccggctggagatacgagttgtgtgctctaaggtgccccgggcctaccaggcatttgcgtagccagggcggagataactgggtgtgttcttcttgcccaccctagagttacacgttcctgatctcctctgactatgagcgtgcagagtggagggagaacatccgggagcagcagaagaagtgtgagtatcctctgtcctgagaggggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagtctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgctccttccttcgggtcctgcctggcagtgtcggtggggaaggcagacccggttccctccttggaggtttgggattcaccctgagctggggctctgcatgcctctggcctggcctgacctcccgcgccctcaggctcatcattctcacctatgcagagccacctctcggcccccaatgccaccgtggcctgggggatcaaggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcatacgctatgcacatgtgtccacacacaccccacccacatcccacatcaccccgaccccctctgctgtccttggaaccttattacacttcgagtcactggtttgcctgtattgtgaaaccaactggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggaggagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccaagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcactgagctgcttcctgtgccccacagtggcctggagtcccctttgccttaactctttgccccatagtacagcggggtctgctctgattgtaggggcttcccacatcccccaggatggctgccctctgctgtggcatcactgtgtaacaatggcgtgtacacctctctgtccccaccagtgcagggcccttctcatcgtaggggctttagctggggtttgtggatcgactgagtgaacgaatgttgtgggaagtcccgtttcccagccgcacccagggaaattccacagagcgggcaggggcatcgcatgaggtgctggtgttcacgccagaccacaattaggtgtttaatttttaaaaagaaagttacaaccttttttttttatttttattttttctgattctgcaaataacacctgctcttacagaccatgtgggtgatgtggaaaagacctgtgaccttctccatgtccacttctccccacagatctgtactgcaccctggaggtggattcctttgggtattttgtgaataaagcaaagacgcgcgtctacagggacacagctgagccaaactggaacgaggtgaggaactgattccacaagggcccagcctgccaggtggggcacaggatattttccactggagataatctaaaccttcaggggctccctgagggcttcccccgaaggcagtgctgctgaattccaggaatctcctggggggccagtaggtgacgtgtccaagagattttatctccttgttcctgaaaaccttacccatccctgtcatcacaaagaagccacctattttgctggagaagtgtttggaaagagacttaaaaaggctttttgtctgcctttgttagcgcttatgtttacttggtaggtttccatagtgtttttccgcagaagttggaatgagctcccgtgaccctcttggcttccggaagcctggggctctgctggtggggctgggacagggactgtagggtcctgcttgcttgtctcggggtgttgggtttgtattgtgtgtcgccgtgccttcctccaccttggagagctgctgtgtgagtcacttagccatttggccctgcaccttcgggagtaggggaatgattgcagagaggcccgtattgactaagtcccagatccatgagaggtgccatttcccagcttctgcagcagctgtgacctcgaaggtctcattcttgatgctgcaggtagaggccagctgggcctgcagagagctgcctcccacccctgctcctgcgaaggaggaagccaagagcccccaggctgcttggtctacacgggtcacgaggctggtggatggagcagtggggctggaacccaggtctcctttctcagcatccactactctttgatcattttagacatgttgcttgaatagtacaagggcacaaggagctcagtaaaataacctggtcattgtagctctggacatccctgcagaaagggctgagtggcagctgtgatgagagggggtataagagccacaggggatccatcgaagaagcctttgcagagaccaagagtgccacgacccagcagagacaacaagagagggtgccaggcagtgtgcaaaaggttcaggtgccaggcagccacggaagctccggggaggcatgaagacatgagggttagattgtagcaggtcacctccaccaccctcactgtccatgaagatctggacttggggacactcacatgttcctggcgcacccacacacccaccccctcccctattcaggttcagaaattcctgctgcttgcttcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgccccccatctcaattatggacatcccactccagggtgggacatgagttacagttgatgagcctgcattaacccatcattaccacccagagttcatagttgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaatgcagtggcatgatcttggcttactgcagcctccgcctcccggattcaagcaattctcgtgcctcagccttacaagtagctgggatcacaggcatgcaccaccacgccatactatttttcgtatttttagtaggatggggtttcgccatgttggctagttagtctcgtactcctggtctcaagtgatctgcccaccttggcctcccaaagtactgggattacaggtgtgagccaccgtgcccagcccatagaaatatcttaacaagtaccctggcgattgtgaggcaggtggtgtggggatcaccctttgagatgctggtgtaaggagtttggattaagtttgaaaggcagtcggagcttctggaagcatccgggctgggccacggtctcatgccaggggtgcttacaaggaatacttccatgtgtcccaggactaagggaggagggtctcaggcattggtccctctgggccagcaagggcagcagggagagccccggttcagaggacccttcagccataacattgacccgtttgttcacactggacttcccttctcccttggggctgcaggaatttgagatagagctggagggctcccagaccctgaggatactgtgctatgaaaagtgttacaacaagacgaagatccccaaggaggacggcgagagcacggacagactcatggggaagggccaggtccaggtgaggcagccatccctaccctcccctgcccgatgcatggcgtcctttttcatgcagcccctggggacactgagatggtcatggccttgcacccagggtggggtggggtgggcagctgtggctctgaaacatccatcgtgggagacctgagccggtgcctgcatgtatcttgatgggtcttgacgtaccaccctctgtctgcgtgtctgttgcgtcggctcattcccaaaggaatttccattcaacttggttttgcagctggggcctcagttcctgcccggccttaggagaacccaaggtggaacagttagatggtgtcctaggctgaaattggcccatcctgtgccagtcttcttagaaaagcacaggggtcccagaggctgcctgcaagcacaggggtcccagaggctgcctgcttggcatcccctatctgtggtctagacccaatttctagggtatagagctgtatctctgaacagggtgcacacagacaggtctcctcccaggctaatctggaagcccccaggtgagaccgagaatgtgtccatacaggaccagcaagggggccctggttcttaaggagactgcctgggccctctgtccttcagaagcttgtctagcccctgggagcacgccaccagggtttcctggaggatcatagctggcgccccaggccctgtttatcctgttcccaccctcacaattgcgcgggggtagctgagaggaagccctgatcgtgctttccttatagtgcattatatcagtgggttgtgggtacagctctctcttcccaggaccttccatcttcacaagaggcctctagagggagtgggtttggctttccacatgcccctagaagcacagggctcctcaggaagcccagtctccctccctaagcaggaagtaaaaatcctcttgtggttaaataccaagtgccaggctgggcgtggtggctcacgcctgtaatcccagcactttgggaggccgaggtgggcggatcacgaggtcaggagatcgagaccatcctggctaacaccgtgaaaccccgtctctactaaaaatacaaaaaattagccaggcgtggtggcgggtgcctgtagtcccagctactcgggaggccgaggcaggagaatggcatgaacctgggaggcggagcttgcaatgagtcaagatcacaccgctgatctctagcctgggtgacagagcgagagtccgtctcaaaaaaaaaaaaaaaaaaaaaaataccaagtgccaggaagaatgaagggagagggtggctcttccctgagtcacctgtcatctttgctgatggatcccacattctcattcagatcagcaaatctttaccaagtgctggcctcacccccttctgccaccctggcctggctggccacatcttcggaggtgcagctactgcctgtttttctaccttggaagcttataagggaactcagtggctcagagcctcctggggctccctatactttgagatcaggtttaaaagcaaaaagactcctctggcacatgcctgtattccagctactcaggacgctgaagcgagaggattgcttgagcccagctattcaagaccagcctgggcaacatagacccctgtctaaaacaaaataaattaactaaaaattgctctcagctctcctgtcgctgtcccactgcactgtcttgttcactctgccagcctttgtgtggattctcatggtgggagattgtaccacacagatgggccacaccactcttgatggagtacttagtgctggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttgttttttttttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgtgctcccatcgctcccacttctctctccctctccatgttttctgtctcccccacccagcctagggcattcctcccccacagtccagcctgcatctggcacagtgtcactgctcagcccagggatactcacagcctgggtgcctggctccttttttcagctcatcaaaccaggtaaagggaggttcagattctgccaaccattgactcaattcatccaaatcttcaatcactggaatcctgggagtggctggatttgaaccaggacctctgagtactattgctaagtaactgggggtctcagtgaaagagagaaaagagctgataggcctcttcctgtgttatcatgtcaggccatcttttgaaactcttttctgcaatgctactgaagtatttatgcacgtgacctgtgctcttctgtcagtctaggggtgctggctgagcaccccaccccatcccggggaagaggagagcagtaagtgtcgaagaaaaacccgagctggacagcagttaaagtggtaaaagcaggttttgtttagtaactattgtgatagggaaaagactagaaatggaaggcctagaaatgggctcaatgctgaagtcacttggatgagtggggacttgcagccaagaagcagggtaggggttgatggatggaaaatgatgaagtaacatcagggggaagagggattctggtgaaaccgacccgacaggattcttgctgaagacaggccaaagtgatcgatctcccccgggggatggcgtggggtgaggaatctgatcagatagcaagggcagggggttctggctaaacggacttagcaggattcttgcaaaatttgggctcctgagaacatgcccaaggatgggatctagctggaataaaaagctggagggaccagatgagttccgtcaaggagagtctttgtcactcccccaccacactcagtgtgacctgggtgaattactgtcccactggcccaaatgtgtttcctcacttttccttcccttccttccttcccttccttcccttccttccttttctttctttcttcctttcctttttcctttttcctttccttttgcctttccttcttcttcggagtctcactgtcttgcccaggctggagtgcagcggtgccatctcagcttactgcaacctctgcctcccgggttcaagcgattctgctgccgcagcctcctgaatagctgttattacaggcatgtgccaccacgcctggctaatttttttgtatttttagtagagacggggtttcaccatgttggccaggctggtctcgaactcctgacctccagtggtccacccgccttggcctcccaaagtgctgggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactgcaagctccgcctcctgggttcacgccattctcctgcctcagcctcccgagtagccgggactacaggcgcccgccaccacacccagctaatttcttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccaggcacatcacagacccccctgcacgggtgaatggctgtgtggacgagacctacatggccctgagataatccttgaaatacaaatgaggattctcgatgccttcgtggccttacctgaccatacctcccccaactcccatcacgtcccccgtgacgtgatctttattttggcttatgtttgtctctgctgctggaaagtaaacgtggaggacagggctttgtccagttcattctctgtggtatctccagtatccagacagagacataaaacatacatctgtatctgtaagttatttaatacattgtttaatggatctagagtttatatatatatatagtaaaatatatattggcacaaagcaagtactgttacatgcactggaaattgctgagccaggcacctgccctctcacagatgaaggtgctgaagttcccaggggtggctggggcgggagccagccaagcctggggcttctccaccacgctgtgcatgtgcccagtggtggtcggggccttcatggtgagggggtcggggagttcagagtttggactcccacgtgcatccctgcaccatgggcagcctttttatcttagccagaaggctgagaagtaattccttcctttttaaaaaaattgtaaaataagcacaatgtaaaatgtcccaggtgtttttaagtgtgcagttcagtggcatcaggcacattcacattgttgtgcagccatcaccaccatcatctccagaacttttttttcatcctctcaaactgaaactctacacccattaaacaataactcccaggggggcaggtgcaaaaagaataactccccattcctcctgcccccagctcctgttaacctctagtccactttctgcctctgtggatttgcctactctagctacctcatgtaagtggaatcatacagcatttgtcttttgggtctggtttatttcacttagcagcatgtcctcaaggctcacccatgttgtagaatgtgtcagaatgtccttcctcttgaaggctgagtaatattccattgtatggattaacagacattcaccagcaggtggacgcctgggttctttccagtctgaggctggcatggtcagtgctgttgtgcacatggacataagatccacccaacttggtgttatctttgcattcgcaagctgttgccaggcacatccatgggctctcggggggaacagctgctgcagagtgggcagtccaacagggagaccgcccgaaaatgggtggacctcactgcgtggtggggacttgagagcagctgccagggtgccaccaggagggccccagtcagacctgctggcttgtacctggtcaggtgcccacataacccaggctggcagagaagtctgggaaactccagccagccagccagagcaccagcttcaaatgaagcagaggctcacagtccaaatctcatccccgaggctcacataaaacattggcaacaacaaaaatgaactctgatgcccccactggaacatgagttgtgagcccagcaagacacataaatagagcaggagaaatgggagaagacaaaagtctatgacttgatagaatgttgccctctaaggagaatagacagggctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttctctgtcccgtgacctcacttcccaagtaaccgtgccatctgagccaccagtcaatctgggccaaagcctgccctggctcttggcacatttgccacatccttcctttccagcttctctgatctagaccatgaaggctggggagaggggtcttcttgttcttggggacccccccgccaggcatggcacacaggaagccttccatgactagggtggcacagcgggttcctggtgtctgaggatggaccaggatggcctcgctcactcaaatggctcattcaggctcggggctggcttggaagggacacccgacttgggtcctcttgcacctgcccacacacaaggacttcaatttgtgctgtcagtggctcttttctggactgtgggcaccaccacagctttgtccctgctgtactgtgtatccccttgcctttctggcttgtggctctgaacaaagcaggtcacccatcccaatttctagagcccccccaccgccacccccaccctcatggagcctctatcgtgcaagaagggaggtggggacctggcaagtcatccaggacaggcatttgaagagcaggagccaaaatctgagactcgggcaagtggttcctaaacccagctcatcagcaccattaaggggagcaaaaaaccagaccgggccaagcccccagcccagaagatcccgactcctgctgcccacagacaggcacatgagcagctttgctgaggactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcagtgtgggggctgtaggcccctgtagctggctgcagagagccaagcgcctcccacacggtacagcacagaaggctcctggtgtcactgggaaaagcccagattcaaaaaggctgggctccggagtcatgcacatcctctctcaggtatccctgtgcagaaaacagtgtccacgggggagaaagaggccaggctggtgtcgcagagcgccaatggcatagtcaccaccactcctccgacttacttcctcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggagagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatgagcaaattcttacacagattccacgggattcttcttgaagcacaccgccatcaacatggatagtgatacaggtcctccttgctctattgagagccacttttggaccctttatttttaacttttgtaccatgaaatgcatccatttttataaccgaatgattttatagtaaatttacagagctgtacaacttttaccaacaatccagttttagaatatttctatcaccccaatttccttgttgccttttttttttttttttttttttaagacagggtcttgctctgttgcccaggttggagtacagtggtgcaaccacactcagcacaaccttgatgtcccaggctcaagtgctcttcctaccttagcctctcaagtagctgggaccacaggcatgcgccaccatgccaggctattttttttttttttttttttttttgagacaaggtcttgttttgctgcccaagctggtctcaaattcctaggctcaagtgatcctcctgccttggcctcccaaagtgctgagattacaggtgtgaaccaccgtgcccagcccctgttcccagttatagccactcccagacccaagccgatctgctttttgtctttagagatttgcccattcttcacatttcataaacgtggaatcatactagagtgggcttttttgactgatttcctccacttaccattatgtttttgaggtttattcatgtggtagcattgtttggttcctttttatgataataattttccattgcatacatataacatgtttttatttctgcatttactatttgacagacacttggatcatttctagtttgggctgttaaggttgatgcagccacgaacatgtccttggtaccagtctctatatggacgtatgttttcattcactgagtaaacacctagtaagattgctgggctgtgcaacaaggtgactatttggggaactgccctacgttgtctggagtagctgcaccatcttacatccccagtggccatgtatgaaagcccatttctctacatcctcaccgatgctggttatagtgtatcctaagggagaagggtgtgttccttttgaagtgatgttagagactggttgggatcagagaagagaagcaaagagttaaaagtgggatagaggccaggcgcggtggcttacgcctgtaatcccagcactttaggaggccaagttgggtggattgctttaggtcaggagttcaagaccagcctgaccaacatggtgaaacctcgtctctactaaaaatacaaaaattaaccgggcatggtggcaggtgcctgtaatcccagctcctcaggggctgaggcaagagaatggtttgaagccaggaggcagaggttgcagtcagccgagatctcgccactgcactccagcctgggcaacagagtgagactccgccttaaaaaaaaaaaaaaaaaggtgcaggatggatctcaggagagcagattgtggtcatagactacagcaggaggcctgtaatctctctcctggtgaacacagaggttctctggtggtctcagcaaagacccacccccgggagtaggttatagtgcagacacatggggcccagacaggaacaactggggttgccctgctggaccatccaggctggtgacgatgggcgtgaaggaagctgttgtctacaaggagctaagtgaacaagcatttcctcctttggaaggtttactcatagccccctccctgcccctgctgagggtgggtgagaggatgtcctccggctgcccattggtgactcaatccagccacactgactacaaagcaagcagggcagtgctgggcccccagcagagccaccatgcaaagtggtcagtgatgcttcagggcagcacacagcacctgccccagttgggcttcggcctccctcagcccccaccccaccacttccctgggatggatgtgcacgatagttttctaggcagacctctaggccaccatctgccaggcccgctgaccatagtcattctttcaaggctcctgccttacccagtccagggggagaggagcagcaacctggtccatcctcctgagaccactgcatgtgagcagacagacccctgcctgcccagtccccggccaggcagcaggcatgttcctcaccaagaccttgcaacccagggggaccctggacagcatccggagtgcctcggtttttcccttaagggaaaactgtttcccccttggtcatctgtttttccaaaccccagtcttttgcttgtttacttctctggtgctttaaataactgcacgagagagcgtaccagccttgagcaatgtttgggattggctgagctgaggcacaggcctcattatcatgctattctttatacggcttccgctctgcggcgcacactctgttctttggaacagagccagccttgggacagcctttcccactggagctgccagtcaggaccgccgtgagagccagtgcctggaggccaacaccctggtcttcagtcactgggagtcacagagaggggcccgataaagagccctcctggcagcatcagtaccaggttggagtgggcgctggacaccaccaatgctggggagtggacgctggctggagccccacccagggctgcacattgctcagccagctagctctgggggagcaggacctgagcagggtgtcctccaccctgggtccatcagaggcactgcatttgattattggggttacctgctgggagtggtgcagattctggacagtctggattgcttccagcacaaggcaggctgaccagtcatactttactcagtctccaaacttgggcaacaggaaactagccacttgagaaggaagctcagcttttctgggctttagaggagatggagacacgttggaaattcccgtaaccaataggctggggtgggagggtgttcttcccacacacagacaaaaaagtggaacccggaggtgatgggaagctttgaccttggccagccagactgcggggtggggtttccctcaaagcctggtcaaaaggccttggaggctggaagctctcgtttagccccaccagcttcccagagcagcaaggccaagcatgcaagagtcaccatccaccctggccatgatgcagggcctcctttggtacttccaccccagccgggcgggccggagccgggcggcctctgctgaaaagcacctgtgggccgtggttccaggggggctttgaggggcagccgctgatgtctggacagcttctctttctgtctcttcttacctggactctgggttgcttgttagctgcttctgcctgttctgggttttcaaggggagaggggcccagtgatggctgttctttgaaggaaaggtaagaatgtctcctgcttaacatgtttctgtgtttccagttacttggttggttagtagagccagggtctctcgctttgttgcgcaggctggagtgcaatggcatgatcatggctcacagcagtctccaccttctagcctcaagtgttgcccccacctcagcctcccgagcagttgggactgcaggcacatgccaccatgcttggctaatgcttttgaaaattttttttttatagagacagggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccgcatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtagggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgtaaatcccaggtcccactcagattatgagtcagttctctgcaggtggaacccagggaggtgttttttttgtttttgcttttatttttgagacgaagtcttgctgtgtcgcccaggctggagtgcagtggcgccatcttggctcactgcaacctccacctcctgagttcacaccattctcctgcctcagcctcccaagtagctgggactacagacgcccaccaccacgcccagctaatttgttgtatttttagtagggacagggtttcaccatgttagccaggatggtctcaacctcccgacctcgtgatccgcccacctcagcctctcaaagtgctgggattacaggcgtgagccaccgcacctggccagggaggtgtatttttaacaagatggtactgctcattcacccagcccagccagtgatcttggcatacccaggaaccgctgacatagaacgtgctccccataaaacgggagacagaggcttcacggatgggggacatgtggcttggtcatgacagggtgttacataccaggacagactgtgttcgggtgacattaaggacaagctcctgcaggctagctgtctggatagtgccgggtgggggtagaagttagaggggtcacagaggggcttcctcccggccccctcatcagctgcttgatttagggcttgtttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcacctttcactgagctccacatagcacccgtggtgatggaagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcggcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccgcaggccctgcaggacagagactggcagcgcaccgtcatcgccatgaatggggtacgtgtccgtgggactctcctggtgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttagaccttaaaagcaatgacacacccaaaaaggcccgggtataaatggtaaaatgttaatatttgagattcttggctttttcttacattattctgtctttcctacttaatttttaattgttactaagaaagagaaagccaggcacagtgcacctatagtctcagctactctggagtctgaggcaggagaatcactggaacccaagagttcgattacagcctgggcaacattgcaagctcctatatctaaaaaaaagcaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccctactgtagatcgaagtaaagctctcggtcaagttcaacagcagggagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccacctggcttggaagcagtaggctggctccaggaactgcccaagtgcagggttttctgcccttgcttggaatttatcacggtcccagattcctgttgaatggccgtaacccctgcccctttgtcacgagtcagttgccaagagaagcctgtttggtttgagagcagttcatgcagacatagaccacttcctctgagaattcatttgcttccccaggatggaatctggctgggcctctgaccttgctggtcacgtgggccggggcctccatcagtcataccctggactcctatctgtgtctaaacaccacgccccacccccaactgcacggcagccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagccgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcagatagggagcaggtctcctgtgttatggcccaagcagggctgttaggacactgagaacattccctcctcccgcaggagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccaggcatgtcacatccttctctgtgtcttttcttcatttactgtgttattatttttaaaaaagagaagacaagagttgtagaaaaagcctctgtagaaaccagtttttaaaccatcctagccatgcatgccacttgctggggtaggccaggggtttctgcagggccttggccttcctgccttggggttggacaggaggtggaagcccaggactcagtgcagtctgtcccctgccatgtgtgaggatgcggcaggcagagggcactgatgaaattcagcccaggctggggctgcagcatctctgcctccatctcaccaaccctcacaggctatgaaggacctggaactgtcacaaatgccaggggagggcactgagaccccagagggtccctcccagcatcttcaacaggattttgtgcctgcagacccttctttggggcacacaccaccaaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccacgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagcatggcagggacggtgctttagccaaggcagggatggtgggtgactcactcaggatcttcaaggaggccgctgcatttccgtgctctttccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcggtgagcactggaggccttggcctcatgggagacgtctcctccacgtgcactgctgcccttggaggctgtgaaaagtgaggtgtgggaacccaagctgtgccccctctgccatggtcggcattttaacccaacctcaaaaagcaggggaccagaaccgagcctgtcctggaaggccttgcccatccctagagggctccctgtccctactcctcaaggagaccaagaggctgaaatagtcagcactgctgtgctgtggggtcctaaagtctgctgtcctccttcctgcagaccagggctgaaggagggtgcctgggtgctcttgccatgggtcctggtccagccaagcatggtttcaaacatgacctgacccttagtcaacctggaggctgatgtctagagtgggtgctggtgtgtgcagtacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgttcctcactcccctgtttcattccatgctgagcctcccctgccttgggctcctctggggagggggtggtggcaggagttgtccaagggcagctctgcccatgagcagctgctctagcggctcctcctgctgctgtttgccgggtgctgctgacccctgcgaggtagagaaaaggcgttcaggtggttcacaccccacacaggtgcccctcacagggtcctcaatgggggccagagctgtgagactgaggatgatgacgagcctgggctgtgcagggacacaagccccaggtgctccatgtgaacacctcgggagaggtctctggctcgttgtgaccccaaggagtaacccaccgccttctgcagctctttcagacccggttgcaaaggagagctgcatgctcaacctgctgctgtccctgccggaggccaacctgctcaccttccttttccttctggaccacctgaaaaggtagcccagctctcccatggcagcccagggctccaggtccccaggccgcagagtgcccctctgctcccactagacccccaacaccgaggaccttttctcctgacccttgtctgcagtcactcactgcctttggcgactagtgccactgccacccctgccccagcctctcttctttgccaccctcctctctctgcactgtggccttaaaaaagagctcagagctttggccgtggccagcagtgcacttggacccccctcttccctccgagtcacatcaagtaggagacctccccaccagcccagagctggctccttgtcctgggccactgagacccagaagtaccagggctggagtcagcttgcagcacagccagggtcgaggtcactcccttcctgagaactccagcacagcccagcccctctgcctctctcctgggggtggcgttgaaacagcacccgctgctttggtcctctacagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtatgggaagacaggctccagcccatgcaaccctgacctgacagaggtggcctctgcctgccccacccccagtcctgcccatcttcttacttgcattgtatgtggtgtggccaacattcacagagagggacttgcctaggtctgcatggatgggagtgatagtgggggcccaggccacctcctggtcctgctagtgcactttgctggaagcttaaaactacctcaagtgttcgggtgtggtggctcatgcctgtaatcccagcactttgggaggccaaggcaggataaccaatcccaggtgtttgaaaccagtctgggcaatgtggcaaaccccatctctagaaaaaataaaaagaaaaattagccaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtccccagcacctgagatggacttggaggcttgggccccaaagacctcccaccagcagctgtgagccccgctctgagccactcttctcttccctactctgcccgggcaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttcttctttttctttccagaaggatttttgtgcagaaatgggtcttttgttgccgtgttagtcctccttggaaggcagctcagaaggcccgtgaaatgtcgggggacaggacccccagggagggaaccccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttttaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaacatggcatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgaagcaacgaaacaacccatgaaccatcccgggtgaaagagacgtccgccggatcggtgcgaccacaagcagccaagcggttggcgctaaagcatgctacacagtcttcgctaattatgcctaggtatacactgttactagcacataacctcggcccctctctcatgtgctatgaatcggacggtccatggtacaataagtggggtcggactggatttataaacggaactttcagtggttaatgccgtgcacctgcaggacccaacttgtgccaaccgatgtctaagaaacacaaaatacgccccaattaataagatcaag

SEQ ID NO: 17399 - DNA, 33349 bp, Human
taagtcgccagaggccacacaacctgggagaggcaagcaaggcatgaaggatgagaccaccctgagagtggtgggggtaatatcagggtctgaccaagggaaagaggcggcattagagcctctggctgtcagaggctggcagggctagggagcaggtgtgagaggccaccaccactgccaggagagaccagaacctctgcccagggagaggacagcccaccaggggcctgcttcaaagcaggatcgccaggactagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgtgagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcaccacgtgcagcccccagctccttggtctcagcccaagcccccctctacctccttctgcaggagtgaggcagcccctgcccactgtgcttaggcacctcacggtgctcccacagcctgaagcctccaccttgctctggtccctgcctatctgctggctcctgggctggcccatcagagtgccctcaagggaaagcaggggccaggtctccctcctggtgcttttcctccctgtgatcagaagtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagagagtgtgaggctccgccgggcatccatgatcaatccatgtgatagtttggcaaatccatgaagctcctgccagcaccagtctcctaccagcatataggtccaggaacagcagccacccctgcaaccccatcttgagtctgcaaatctggcagagatggggttaagagctgtttagaagggataatcccaggtcctggtggaaaggggacgacgtaaaagcaggtgttgggattctttcacagtggcatgggcgcagcccgagggagacctggacccagtgtgaagcggtgggggcttgagagtggagttgctggagagggtggggagccgggtgaagcagcagggcagtgtgctgaggcccagccaggacagaaggtctagcacacgaagggggccacagccaggagtggcagcggtggaggccgtggcaggcaagggaggggctgtcttgcccagcaggattccctgagcacagatttcaagtctgcccttaagagagaggcctttgaccctggggatgggggagtgggggcaaacaaggagtcacgaagttgtgggtaccctggggctaggggagggtgatgctgggagacaagggctcagcctctccacttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgacggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcaccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcagtactgctctgtccagccttaagcttgtaatgatcctgatccctgcctctcgtacccctgcccttatcctccaggtctcatcccaagtggcgcctcctgggaggccttttctgacctagcccggcacctgcttactcctccatctagtgatgtgtgagtgagctcctcggggcaggccctagatgggctgggtggcccctgtggggcctcacatctctagctttccctctcccaggcctgtccctggggagagccatggtgggcagccatgggcagggacagcagccactggcctggtctcagggatccctgtgaggttccaggcattcaaggcactttctaaagggaggggctggcagccaggctggcacacccaccaccatcaccctggtttctgcaggcctggggaagtggttgttcaccagaaaaggaaattcttgatgagaaacccaagcgaggctggaaattcactggattccaaatgattctgacctttcatgctctaccagtaatatctggagatggaaaacaaacaggctgcagaggaaagacaatcccctcccgcgattcctcccgcaggctgggctggccccggaggtgagctggcccccagagtggtgccggcagtgaggacagcccgtctccagccgggccagggccagagccagtgctggcacgggctggcacagggctgccactctgctctctccttttggaacgtgctgaactgtcctccctgggccctgtcaaaggcaaggcagccaagaacaggccatgctcgttttcacaaaagccgaatgaaccttggggcccagtgccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatggccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacagctcctgagaggccatgtgtcacaggacccaccacgggcctcccacttagccagagccatggcagaggctctgcccctcgtctttagtacattcacacaagggtcagtcagcaaagacagtcactctgctgccctaggagggaaaggcaaagtggagaagctggcacctaccagcccacactgagggacagacacaggtggctgtgaccagcagagcctgggtcttcactcggccccactggaggcacctgagggggtaggtgggcacttgttgcccaacctctgcccttgcggatcagctaatggactctgctggccaccaaatggtgtgggatccttcagaaggcaagattaaaaggtctagttgtaaagcatcaaatgttctcatgtggaaacccacagggagctcactgcccatttcccgacggagctgtcagcattcccagccctgtggcgggtctgttttgcacctgtgatggacctgctgtgcaggctcaaggctcaggctggggccaagtatgagggtgagcacaactctcccagcagcacagggaactgggggacaaggaggaggcagtcacaccagcccagctacagcttcatttccacaaagcctctgctaccagggatacctgccctgtctttctagagctggcaggcagcagttcccagcagtgtccccattgtgctttcatctaggacccacagtagtcacttgggccccacaggcaggctgggtcacagcagggttcaccgtgggaggcctggtgtctctgccacttatctgagagacagctggtcaacatgttatcagtgagggtatccaggggacgggggacataagaacatgccttttgtggggcaagttctgcaggtggcaagtgcttgagcagccagcctccaggcaggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctggtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccagcataccagggcttagattgagaagggaccttatatatcctttagtgttcctaaccagccggctttgcagatgaggaaactgagcctcagagaggttccttcacataccgcagggctgagactctggctctcagggagggtcctggcactggcccctgggaattccagtggcccccctcttcaccatactggtcccacatcctgtgggtgctggggttctccagcaagggccttgggggtatagactgggttccacccttggagctgctgtgtagccagccttccctcaggagagtggaggacagtgacacctgggcttgggagaggtgagtggctgtgaaggttgacactcccctcgtccccttgtctcctggcctagtcagtggcaggaccacagggagccctagcagaacatggcctcactctgcctcctgttcctgacctggtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcccccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccacaacaggaggtcagccagcgtgggctctgctggggcctcctttatgggaaggcaggagtcagtctcttgccctagtgctggtaagccttgagggaggagggaggagagaacaagagagttctcttcggcaccatgccaggcagggctgcttcctgcagaggagagtgctgagacccagggctagtggtggcagagcctccctctctgcatgccagggcagtgaggggctagagctggctcatactggctcacaagagctaatttttcaattttcaggatgtttgtgagctgtttgacattatatttgtggcttcaaagcagccaggtaggagtaatcacaccccaggaactggcaaatactacaaaacagttctactcctccccagcccccgcctccatgccagttgttagacctttaccagtgcaccacagccagtgactcccaagcatggcggggagagtctgccagccaggctcagtcactggtgtatggcaggattgatccgctactgccatcttactgaagaacccgacagtgtccttgcctgtcagtctcccactgtgcttccccagtgactcccagctctgaccctgtggccgcgtgggttgcatctgttcgtgtttaccccgctggagaaagggaatttgccagagcggctcttcacttgcctgcctccctcccgctcttcctcggcagatttaagagaatcctactccacagagagcaaccttgcattggctaacacgagaccacaagctgggggccatctgatgttctccatctgagaacaagccctgtggcatccttgcaggaagcagtccttgttcacccagtatgtgtgggccctgggcctgacaaactcagtctagggacagaggcagtcctatcccttcctccctcaggtcagctggggatggcatcaagcaggccctggaggacctgtgtagccagggctggcctcaggctggcttccccagtgcctacaaatgctggccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcgggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagtgggtaattaatttcctgagcgcattagctctgctcagtacacacacatgagaacagctctgggttttaagacacagattactattgttttaagggatttgtataatccagtaactgaaaaacaattttccactatctagaacagactccaaggtggaggctaagagtgctgggggccttgctgacttggggatccctagtaaccagtgtagatggggggatctgccactcaggggagtcctgtgactggccatgaacaagacaagcagtgaggacaggatgcagcagcaaggctctgtgctgaccggatgcatagccctcttcacctgaggccccactggctcagtctagtttctggagggattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccacggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtatcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaatgctcccaccatcttggaattttctgtcccaggactgggagtctttgagcattgttaaggcaccacctccagtcacgtgactcccgccacatatcacacttaccctggggctctgcctcctcagcaactttgaccaacacccttgggaatacagaggctcccatttggacctaagaccctgcaagtcagtgatggttgagatctggtgagagcaaaaaagcaaaacagagtgacatgagggtaaggggggtggcgccttgggcctgtgctggagaacagcagccacccacctgcagggctggacaggggtgccaacatcctggaggctgcacacagacttctgggagagctctgcccagtgggtgaagcccagctgaggcatgagaaagtgctctgtgtacagcaccgtctccatctcacactgggccctggcactgtgggtggggccctggcctggctgtggcccagggtagtcatgtggacttgtgtccatctggactgcccaggtgaagactggcccagcagcacagttcctgagctcctgcccctcccctggctagtgaggaggtagggcagttctggaagtactctgaaggctcaggctgtaggataacatgtgtgtgctggctgacaacagaatagtggaaatggaaggcccagagacgtgagcggttggcagagcctggcgcagggcatgctggtgcactgcatgcacaacctctaagcctcccagcccgaaggggctccccaccacacagatgaggaaactcgggtttcaggaaaagttgtccctgtggcaaagtgggggccttctgacctggacatcccgctgctgcccaggggaatgggcagggctgggaagcagccacccttgccattactacgggtcaccccaccccctccacactgcacacacagggaaaccagggagggcagacaggactgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctgatccagcccatctgtgggccaggagcaggtgcatctgtgcagaagggtggggccaggggcacacaggtggggagcagccaggcaatcccaacccctgcccctgtacacagctgccacaccaaacgcctgcagcatgtgccatctggccttgcctgccatccaccccgtgctgggcagagcaggggagagcggtccccaagcagacagcactgctcataggcaggccatgggcaatgagaacaggggccaatggtgctaaaagctgtgcagcaaattaaaagggttggggttgtgactagggcttacttcaagtgaaggagtctgatagctgaccagctacacaaacccaaaagagcagcccatgcagggtagcacagcaaaggcctcgaggtgacagagacggaagcaggagtcaggagacagccgggagaggcctggattacacagcctgccatggaaggcactggagggtttgcacagggggcaaccccagagcagaagcaggtagatggatcctgaggagacatgaccatggtagaatgggaaggagattgtccaggaggtgccctcatggggcagaactcagagccatagcccaaaactggaccctgcatgcaatgtcccagggccccagcttcctgcctcataagctgtgtcatggcctaggacctttcttcccaggcaggagtcagctccacctgctctctggctggcacagcctggtgctggccaccccaagtgttagcatcctctgcctgctggagaggtggtgtccctatttggggactcagtactctgaagtcagggttttgccatgctcttctctgtccttcgaggcaggagacatgctgtgcatgctacaggagcttaggaattgtctgagggtgaccagtgggggtccagaggaaaggtgctaggaagacatggaggcttccaggggaggctgggcctgaagctcagctccatatccgatgtgtcatcgtgggaagagcagtgtcttcatgaggcctggacagtgcctgggtgggagatagctccagcctccttggaagacctattgaccacgtttctcttgtgacgcacttcactgtcacccagaataactgctgtctcacagctaccaggacccgagcctctggggtaaggtagagttcaaggagaaccaaggcagcccaagtgagcctggcagcagagccgagggcagccccaccaaagccacggagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttgagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttcctgaggctggccgtcagcaccatgtgccctgtgctgtccccgcagactggctccagggacagacaggagctcactgagtcattaaccctcaatccaattctccaatctgtcaaggtagcattgaggtttgcgggaggaagagggaagcactaaccagattggactgtaagtgaccctggtcatccagctctgtccccagacacctccccatttcctgaggctagtagcagtgggaggatgaccaggcctgaggggtggttcgggctgtctggtgctttccttggggcaagggtagtgggccaggcaaaggggcctaggcaagccaggtaacccctctgagcaccactttccacatctagaatggaaatgttttgagcctcgtgagcccaggagcctctcacagtcacttctcggaggtgaacagaactggagggcatcacggcagcccccacacaagaggaagtccagactgacgaggccacagggtgacaagagcgagccacgttctggggccctcccaccaggaggcccaccccacccatggtgctccagccaggaacaggtcaccagaggtcctcccctctcccctgcccactgccctgtctctcagggcacagcaaggcaggtccttaaagagacagagggagagcagggtaccctcgctaccagagaccctctcccaccacctgagcagatgggcagtagacagtgtttggccaaccaggctgtgtgcccctgtgggcacctgccccagctcaagggtcagcagcttcacctgccactggtctgctgtggtgtgagactctgagggtgagggtgtccaccctggttgtcatagaaacagcagtgcgtctgcagagagttcatgccaagctcagcagagggaggaagcagctggcctgggaggcagctgttgtcattgactcctgagagctcagtgttgggaaggacccaagggcccaccacactctgaggctggcgagcacacggggcaactcaggcctccctgcccaccatctttctttgggcagctgcaccatgttgtctgtcctcttgtccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctctcccagcaccaagaaagaggttcccagctgcatttctggtttctgaggggcccttctgcttccccagctgccacagccccaggccctgcctgggggtctctggaggaagcagaagaggcatccttcggccccgccccaagcacaccaggctctagggcccagtgctcaccaggccgtttgctctttgcctcccaagaccgtgggaggtccagggacctggtcagtggcaatgccttccaccaggtacatggttgaagaggtgcggggagcatgccagggtgcagccaggaggccagatgaccacaaccaggggtatgacagccctggacacagcaggtctgtggccacggcaggagggcgagatggacacttagcaggaggctgggctgagctcctggtggagtcagggtgggactgtggcagggagacccccttctccagcaaggacagggccacttcctgagaaatggagcatcggacaaacaccagcggggtgggaatggcaagtgctcaaggtaagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagctgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccccaaaagggaagtgaactcaggaattcctgatgaggattccaggactggctggggaagcacggggttgcaagcgaataagctatttcctttgcgactgataccatccttggagtggatttcctctggtgccttccctgttccacagctgcagaggcatctagcacagggggccaacaccacaggcccctccactcggtacacctgccaggacctcggcgcatcatcagatggtggggcccactcgccctctccccactagagaagtctgggaatgcctgtgtcccagaccccctcggcagcactcaggatggcccaggcaggttgcagaggctcctgcccaccaggcctgtcacacagagctctgggaaatggagatgggcagtcagtgccagccaagggcaggcacccgctaccgatggaggcatgttggtcactgtgtcagcagtgccccatgtccctccagccacaccctgcccagcagacaggcagccccaccaaggtgtccccaagcttccaccacaaagggaggcccagaggggtgagaggcttggccggtactttgtgaaaggtgacagcatgaagctcatctctgtatgaaacctctgcctcggcccctcagtcagggtgctgccctcagagcctggtactcggtggccctggtcaggcctggtggctcagctgcaggctgggtggccgcagggctggcctgtccatggtgaatggagcgcattcatgtctacaaccccgccccacagctctgctctcggcgtgaaaaagctgaattcacggttcggatgaacactcccagcttttctacagtgggctgacttgagcttctcagtctgtaacagaactgaggacttgctctacagatgaggaaactgaggcccagggtgggacagaccggccccggccccacccttcccagcaatgcggctgcatccccatgcctctgtgcctctgccagcccctcctgcaatgccttcccttcccctcagcccccagaggtccagtcaaaacgtcctgctcctgtatcacccctcgccccctgcattcctgtggtgtgtcacctgtcagagttgtagctggccagcactatctgcagcagtgccagctgctcacagtcacttgtgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaggggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtatgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctgagcactgctggccacccctgcaaatggaggggccccacctgaagttgggggccggggctcatgtttgagccattttgactgggtctttttcagtttattttctaaacctcagtttatttgaagcacagtacatgattgctcacttcaggaaattctgttcaagttttcctagcagagttactcattccttcatctgtgcaaggggagggtggtggtcataatcaccaccctgatccccctaccccctgggccctgtgtgaagatgacaaggcagtgcggttggctgagggcctgggccaggccaagcacaccaggaaggtgccgcgcatgtgccagatgggccctgaggccgctggggtcccacagcaaacaacaaaacagtcaaacaggtgccagcctctgtcatgtgctcaccacgtgcccaggaccacgtctgtgtgtgcgtttgcctgggtaagccttgcttcgtgaagctgccatgacctccgtctcctcactgaggggcacagggcaacaggctgccaggtgaggggctgaggggccttctgggggccactggcctactcgaggcacagtgagttgtgggaacgaggagtaacttggaggtggagctgcgggtgcagagggaaaaagacacctgggtcatgaagggctggcctgtccgcctgaggggcccagaagtgcagtgaggggatgacgtggctacgcgcctgtaacagggcacctgaggacatttgcagtgcaggagggagagcgcttcagagcaggccagtgtccctcccacccggcccagtccctggtccctgggtagtcactgagctacctcatgcaggaccatggtcttagcaggacacctgtggtggcctgtgaggcagggacaggaaggatgccccactctgggctcctcagggagctgcaactacagtgcaggatgggctgtgatactcagcactgtggatgtctgtcaaggcagggtgtaatggactggaggtcagaacgtgtgaggccctggatgagcctctcacctccccacccccagcccaggcgcttgtcccacacagctgccttggatgtcattagctggaaagccgtgagtgcctgatggggaaggagtggggtgtggggaggtgtttaggctgtgacaaagggatgctaactccaaaaacaggcccccagtccagaggcctcttaaaatgcaaatatgccgcacctgggagggggacaggcccctggctgagatgaggaagcctggaggatgcctctgttccctctcccaccgcaggcccatgagctctcagaccagcaggaggctgatgctggaatatgcgcgcacctgctgggggatctgtgcgcctcagctccaaagtacaggagctagactccagtgtccatgtcaggtcccatccagctgggatgcaggaaaccaaaggcagccctcccatgacccagcactgagggccagacctgttaccaggaacgttggtaactggaagagcctggtacttggggctgttctgtgccccacaaacagagggaccggctgtaaggagactggcctgatggggaatgagagaggggctgagccagaggtgccgacacggtatgttttaagtaaggtccaggtggctgcaggcgggatggaaacacatccaccattcatcacatcggccattgcatctccaggctaaggggccacaggagcctcccaaagagccaggctgacctgggccctgtggccagcaaagaagtgttgctggctgaatccccatctgcagcatcgagacctctcccactccgtccggctgagctggccctgcatttgggtagccttccctcagctgcctcatgctgggacagagggaagcaggtcttccgatgagacctcgcaggtgagaggacgtcccagtgccaaggcgaatcacagtgggtgtggcgtggagagggcccactggggtgccagtggtagccacagggcaaggcccagcagcttggggttcttcccatgtcagcacctttgtgccttctcacaacagtcccagcattgtacagatgaggaaactgaggcccagagaaaggaaatgacttgtccaaggtgcagcatgcaccggcagtgagtaaaccccagaccctgtgttcatggccagggacatctgcccctttgtgtcaccaggagaaccttggtggagaatcaggagtgagaggcctcaccacccccacaactaaccaggcgcaggctcctctccactccctaccttgccccggccgctgacctgggaatgtccttccaggtgccggacctggtctggccagcagtctggcagccacgttcaggggaaataccccagacccgcaggccagcaagctggaagccccttagggatgggctgtcagctcccctgctgtagtgagaaagccacggcctggggcagagtcccttccacaatggcaagtctatttggacctgtctgagcaggagctctcttctcacaaatggccaggaaatgacttccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccgccccccgcggctgcctttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggtgcagggccacatgactccaaagctgcatccagctctaccccagtggcccacaggtgggctgcaccaggacaatgtttaaccctgccaggccagggagggcaaaaccccatgcaggccaggccaggccaggaaggagaacagagccacatccaccaagggcaggaggacccaggggagcccacaaaggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccggggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccggcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaaaccaggcgtctacacagagattttgttattatttgaggcccatcatctcctcggtgcccactaaatattagtcagtgtggttcccatggtttgtctcaaggaatagaggaaaccaggaagcctgagcctgaaatgcctgcaaagcaaggggagtcctgggcacaagcaggggcctgagctgagggaagggcccacactcgggagatgtttgtctgtcctgatgaggctgccgcagtggcggaatcctgataagagtgtactgtgaggcaccgtgcccacctccagctgccttgtgagataagtacctgagtttccatgacctctaagtcaggaacaggaggctcaaagaggtgtccagggtccccaaggtccactgagaggcatcagcagggaagcagtttagacaccatggaaggggctcctagtgcattgggacagcttgactcaccccaggactcacgggggccacagtcaggagtgtttcatggcgttggacaagaagagtggctgccttggccttggagagagggggtccacgtggtctatcggcccctcccactgctgccagctgagctctccctacacacaggtgccctgcagaggaccagtctggtttagatctgaggcttcagatgaccagtacacgtgaactgtttccgcatcagtgaggtggccctcctgctcctcctcttacctaaattccactgcctgcccaggaggtgatgggctaagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctgtgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggttccagggtaatgacgggtacctctgggtatccttcctttctctgcacagatgctgccagagctgttcctcagagaactcaggggctctggagagcagggtttctatgcagcatcctcctgggcacccctgccctcaggcagcctcctttgggcccaccctgtaggagcagcaagccagagcacctggttgtggggcttggagcacatatcctgcctctctgtgcctcagtttcttcatctgtaaaacaggagtgggcagatgtgagaacagactggcagctcgtgtccagctgtggttaccagcgtcattgtcactgcagtcattggtgatgctgttgcttcgtgcctgagtcatcactaccagctgcagttaccacttgcattaccacggtcactggtgatgtagtctagtcagaaaagttcctttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactatgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttcttaaaagcccagacccctggctataacacatcgaagattctcagaagagaattgaggagcggacaggcgccacactccgttgtggtcactgcctcttcctggcccaccacactcctgtcctctgcatgtactgagagctctgtccaggatgccagggtcctgcctcggcagagaggcggtgccagatgccccacagcagctggtgggagtgcccacagctggagggcaggggaggagcctggcctctggctggtgtttccttcccagctctcaagaactggagactttggttacagaagtgaaggctgctccctcacagacttcctagtgtccgatggtaccacatggaaggatcagagttttgaaggactgggccagaacccagatagagcacaaggctgccagcgcctgcattgagggagctatgatgtgacgggggctcctgcagaagatggccttccttgtacaggtgtggggcagcctgtggatgggcagtgggaagatggggggtcctcggagctggaggtgcccagcggtttaggaggctgtgcttggcacatctgtagccccaaagctatatgttgagatcactggcacccagaggagagacccaaaaggggcaagagaacatcttccaagcacttgccactggcaaggagggtgctgccggctatttccgtgggaggtgggtgaagacatttaacctgggcttccccagcagaaggaggtgccattgcagggaccagtcttgggctgagaccctagcaaaggcttcctctggcagggctgcaggtctagggtctgtctctgcctgctgcgggcctgattaacgccagtactttcctttccccagagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcacctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacatttttttttgttttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctctgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagcccagcattgtcccagtgtgctatgtgtgtagctgacctgtggctggacttggtgccatctggaagggcagccggggacacctccattctgaggtcccatattccaaaccccacccctatacctccacacatttaggtagagtcattttgcaatgaacatcacaaataaacatcacgagaggaaagaaactgcaaagaggggaaacctgccaggtccatgcagtcctggtgtggaggtctgggggtgatgatgactcctgcccctcccgctgcccccaagaccccacccaacactgacccaggctgtgccataccctggacccctcccaccatgtggacacctcagccaatgtcagagtcatcctgcagagtggaagaggtgccctgagggcctggagggttcctgtgcccccagtagtgtagggcaaaccttgtagggttttggagaggaggggtccctgagcatgcagtgctcgctgactggcttgtgtggttagaggtatctggatatagtggaaaagtgccgatcagaagtcaacggagtgcattcaccgagggcctgctgcgaaccaggcacggagccaggctccttactaatgattttatgtaacaccccacctcagcaggttgccagaggtgcccattttacagatgaggaaaggtgcctgaggtcagggagcagtcaagccaggattcaccaggccagggagctgttgctcccactgcaggggcagagacgctgatctttcctcctgctggagtccttgcctggcttggcacctgcacaggatggaagcctacagggagcagcacagaaccaccctgcagcctcctcctcaaagcaggacctcaagcaaagtggggggtcggcaggcacacacacgcatgcatgcacacaagcacatgcacacacgcgcagatacgcacgcagccctggtgctgtcaccgccccatccctactcctaagcccacgcagggactcccttcacaccttcctacgtcaccaaacagccagaacccagaggggcttttgtttctgaagaaataacgtgtgacttaaaatcgttgagacttattttgtgcttttaatgccaactgtgaaaagagcagtaatttcgccgtgagcatctttaatctaaaaatacatggctaaagggagaaagggattgagcctcccttcctaatgtgtgcaaagatcagaggaggccttccctggagggaggtttctcccggttcccagaacctagtcaggagtctccagttcccccataggctgcagagaaacctcaggcgctgtcgacctctctggccccgtccccccctgcagttcacctgcactggttctcctcctgagcctgccttgttccgctcttgcccccaatgatccctttgcctagcatgtccttccccatcctcacagctcaaagtcacctgggcagcttcttggaagtctcctccttccctgcattccatctgtcagggctccagggtcgagtgggaaggggtgttggaaactccattgagcagctcaaggccagcgcctctgacccacctcattcctccaaacaatgccccatggagaaggcgcatgctgagctgggatggtccaggagtcttagccaacgggaggtaagcaccaggactcaccaaggttgctggtgagaggaggctagagtaggtggcagggtgcctgaaggggaggacctggggatggctgggccagccctgcccactgcaggtgactaatcccgccttgtcctacttcacgcagccccagcctcctttcccaggacccaccatcatgtggctccctgtgggatattgccatcctcacctatagcccacgtggtcaccctggtggtgcaatgggtcaacaacagtggtcacgataatcccagctctcctcagtgactgctcactggggggcacactcatgggaggccaagatgcttgattccatcctacagaagtggaagcagagaccaggagaggcgatga

SEQ ID NO: 17400 - DNA, 25041 bp, Human
acacacagctgggcccatggcgagacgcccaccccttccaccccgggctcagttgcagctgtcccttgtcggccgaggccgccacgaaccccgcccctcgacttgtgggcttgtccccgaccccctccccgtcctggtagcggcagtaaccgcaggtcctgatgtgacctccaagtctcaatccaaacgcctgactcccggtcggtggagctcggctcctggccacacaccgggttgggggcaggagacgggagagcttccggttgcggccgaacccgtagtgactggggcggcgcccgcgggggctgatgcgcccgctctccccagccacgctggcggtgactgtggcgtgcatggtgctggcggtgggtgtcggcgtggtgggcatggtgatgggactgcggattcggtgcgacgagggcgagtcgctgcggggccagaccacgagcgccttcctcttcctcggcggtgagactgcagaccgccccaggcgggcaggcaggggcgggccctgggtgatggaggggcctggtcgccaggggaggggcttgaggtactcggccaggatccgaggggcagggctggaagaagccgagagaggtgggcggggctcgagacagagttcagagcgggaggagcaggaaggggcctgggccaggggcgggctgagaggcgataggcgtggtctgatagaagggggcgggtctgaaggggcgtggcctgggtgcagcccccaccaggcccagctagctcatcttgcggctgggcggggcccaggactgctgctgctgaccgccttgataggctacaccgtgaagaatgcgtggaagaacaacgtcttcttctcttggtcctatttttctgggtggctggccttacccttctcaattctcgcgggtaaactggacagcgggaagagggtggaggagactgcccagaagaccctcaccccagaggctccccagctgccctcccaggaaaccccggggacctctcggggactccccaacacactaacgactcccgcagacccggcagagacccccttggagccccaaaccccagtccccggggccctcccggccatccgccccagggcccaccttcctctccctgctccgcacccccgtccccccaggcttctgctttctgctggcagacatgatcatgcagagcaccgacgccatcagtggattccccgtgtgtctgtgactgcagcctgcctggggcagaataaaggaacggctttttttagcgctgcggctccgcgtgcttttctgcgggtcgtggggacgcaggcacggggttgcatagaggctcagggaagacataaggacatgaactcatagggaacgtggagacagggagacacagacatggagacacaagtctccatggattgggatgggaacagggacatgtgggaggggcggggccaggaggggacgtgggcctttggagagggtgtggagaggctgtggggacgacatggaggtgaagtagagacacggacaggggaggatacggatatggaagggacagggaacacggggatggagagagtggagagaccgacgcgcgaggattcagaggcgtgggaatacgagtaccgcgacttggagaggccgggaagaagtgggggatctggagagggagagcagatccggggataccgggaagtgtttataggaccgggaggatctataaactccgggcgcgcttccctccagtgcacgacctttcccctagttctctgccctgccctctccgccaggcctttccttctctctccaggtcccgctcgctccccgagatccgcttcccattggtttgcattgcttgccacacctcccttccttccggcctctcgattggtcctctgtcggggaggcgggctctgcagcggttgactggctgaccgtgctgcgcgcaggcgcagagaggggcgcggggggcgggggtggtggggcttctggactgagccgctgagggtgcgggctgaccctgtaagtggctgcggcgggaagatggcggagctgcgcgtgctcgtagctgtcaagagggtcatcgactacgccgtgaaggtgatcgggcccccctctcccacatccctgagtcccgcagccgtgtgcttccggggccacgagcgcacactgggtgggggtcttctcgtaacccccgacctctgccgctttaacccccaaacgtcaaagtcacctgagggcaaaaatccaagagtgaagttctaacatccgatcccttcggggtcacggccatgttctcttttccctcgttctggattcactctcttgataactgttcagagtgagttgctttctctatttcttacccactggaagaagtcacggtccctgtttaatgcacggagaaactgaggcacagagaggtcacccagctagagaagggcagagccgagagttctatccaggttcctctgactgctttcacccactaggctgcattacttaccattgtactcttatattacccgaaatgtgctatagagggagtcagacagggtcctgtggggccccagaagctgctttccaccctccatagccacagggtgagccaggaggctctagctagggagagagaagtgtgtttgctagagatgaaagttcaaggagccaacctgactgagctgggggtagctcacattctccatgaaagaggtgggggagggtgctctctgagcgcctggcttgttgtccccagagggaagctggtgtggacagaggtgaatcagacacggtctctcaggcccgtttctctcaatgcttggcctgaactggactgaagatggtgactgtctgtccatgtctgtccttcccatcagcctggggacttacctccgtgtccacagcattacctagcgcagggcctggcaccctggaggcctcagggtgggcaaaaccagggtcacaaagttgacactgatactgcccctgcctgcttagggagtgggctggggaagagggtacaggagccagacttgagcatgaaagtgtcagtgatgatagcagccagcatttagcgggtacttacgtggcaggcatcgttccaagtcctttgcagagattaacccattcagtcctttcagtaccctttgtattatttattatttatttttattttttgagacggagttttgctctttttgcccaggctggagtgcaatggcgcagtcttggctcactgcaacctccgcctcccgagttcaagcaattctcctacctcagcctcccaggtagctgggattacaggcatgtgccaccacacctggctaattttttgtatttttagtagagatggggtttcaccatgttggtcaggctggtctcaaactccagacctcaggtgatccacctgcctgcctcggccccccaaagtgctgggattacaggtgtgagccaccgtgcctggccgaccctttgtattattaattccattggatagatgaggaaactgaggccagtcagatctcccagccagtaagtggcagagttacgatcgaaaccccgggcaagtctggctctagactctgctctcctatctccctcaatgccccctgtcctaatgatgcctctggcagcacatgacagggatgtcacctgtagcccttttgagacacattcctcttggggtcctgggacccaacacttggtttcctccctgctctgactgttcgttactgtcacatctttggagtcctacagctccctgggcctcttctctccatcccagccctggccttccccgcctggcatgtctgggattggatccgtctcccccatggtgcaggcccacgtttgactcagctctggtcccagcatcactcagcacagagcctggcacatgggatgtctctggtgtgctcagggagagaacagaggggaagcgtgaaggccgcgttgaatcagctactgtcctttccagagggtgctgccttcccctcccgcagtgccccagggctccctgcattacatcctgtctcactggatgtgtctgttgatgtccttttcagaacaaataaatgattcagaccctgccagcttcctaaacaccagattagacctgggtactgtcccaccctctttcccttctcccaaagctgtcagttctccaccccccacccttcttgccctattgtctcttggtgtcattgtctcacctggaccctcacccgggtcctccctcactcccagtctctccctctcagcccacctctacccagccttaggggcgtttctgcacccagagctcaccctgctctcccctgctcccagcctgcctgtggctccccagcaccctcaggacagagtcgcagcccctctgcctggcatttgggatgctttgtggtccagcctcctcttcatggtctgcttcagccgtccacttccctccttggaccctcccataccctttgtgcttctgccactgtgacctgctcctcctgtcctgacagaccaggccgcggctcgcccgttccatgccttcttccagcaccaccctcctacctctgctttctgtcctttgtcctgcccatctccaactcatggattatatcaaaatctagtgattctctgccaggcgcggtggctcacacctctaatccctgtactttgtgaggccgaggcgagtggatcagttgaggtcaggagtttgagaccagccaggccaacatggtgaaaccccatctctcctaaaaataaaaaaattagccaggcatggtggcacgtatctgtagtcccagctactcgggaggctgaggcaggagaatcgcttgaacctgggaggcagaggttgcagtgagccaggattgtgtccctgtactccagcctgggtgacagagctagactcagtctcaaaataataataataataatttagtgattctccctggcatcgcctcctccaggaagcccctgaccctacaccctcaggttgccttggtatatccctgggggcttctgcagtccctagatttgcttccatcagccctcgccagactggattgggatcctctgtttaccccatgttccccactgccctactccatcatccccaggctggtagctccctgcagagaggggccatgtctgatccacctctgttcccagaatcacgtgctcactccctgacctctttcacctccttttcaaacatcaccttctctgggaggacttccctgcttgcctccttaaaatcacaggccccaggtccctgtgttttgctgtgttttcccctatacttagcaactagaaagggagaggaaagtatgtttgctagagatgaaagttcaaggagccaacctaactgagtggagggagtgactcacattctccatgaaggaggtgggagcaggggcaccctctgagagcccagcttgtccccagagggaagctggtgtggacactttgtaatccacagtgttgtttacttattgattgctctggtgtctgtcgccccttctggaatttgagctccaggtgtgggggagacagtttgatgtggtcactgcttcctgagacagtgggtgcactactagaatagtgcagacctcagactccaagcccagcgcctgcgtccacttcctgctgtgtgaccttgaggaaattgcttcaccactctaagcctcatttttctactctgtacaatggggatgatggtactatctactttattgagttgtaatgaaaattaaataagcccttggaacagtgcctggcacacagtggtttgttttgttttattttttgagacggagtctatctctgttgcccaggctggagtgcagtggcatgatctcagctcactggaacctccacttcccaggttcaagcaactctgcctcagcctcctgagtagctgggattacacgtgtgagccaccacgcctggctaatttttgtatttttagtagaaacgaggttttgctatgttagccaggctggtctagacctcctgacctcaggtaatccacccgcctcagcctcccaacgtgctgggattacaggtgtgagccactgtgaccagctgcaataagtgtttttattgggagtagtagtaatggatgtttagttagtcatttattcaaaacataacaaatgctgtgctcagagtgtattcgtgtgtgtgtgtgtgtgtgtgtgtgtgtgtgtgtgtgtatgtgtgtccggctgtgtgtatgtttctgggtatgtgcgtgtatctaacattttaataggtatttggcaactcagtaacaccctgtcctgttcaggggcacattttacaggaagctgatgaagcttaaccttcagggcctctttcaagaccccaggagaaaggctgggcctggtggctcacgcctgtaaacacacactttgggaggctgaggtgggtggatcacgaggtcaggagttcaagaccatcctagccaacagagtgaaactctgtctctactaaaaatacaaaaattagctgggcatggcggcgcgtgcccgtagtcccagctactcggggggctgaggcagaagaatcgcttgaaccagggaggcggaggttgcagtgaaccgagatcgtgccactgcactccagcctgggtgacagagggagactccgtctcacaaaaaaaaaaaaaaaaaaaaaacccaggagaggctgggcaattttgtattcattatctgggattcattttcttagagatgaccccacaggatagaaactccaggcccagaaaacgtgtttccatctcggggcccaaccccgaccagccacaccctctcgtctgggagcgcctggtgtttcttcaggttttcctctttgggctccacgcacttgcccctcctgctctcagcaaggccaccttgtctgacagggcacacgtggggctcacatgtcacctcagggacgagttctctgtctgccccccgccgagttagtgatctgtcactggggtggctccctggccttggctgtcctgcttgctgagtgccctagcgcgtgcccagggactcgcttgacagaaaagcctagaggacagaaccacacaagtccttgagctgtgtcaggggttcaggaagagctgtcgaaaatcactttataaaatccctcttgggccgggcgtggtggctcacacctgtaattccagcattttgggaggccgaggtgggcggatcacctgaggtcaggagttcgagaccagcctggccaacatgacgaaaccccatctctactaaaaataaaaaaattagccaggcgtgggccgggcgcggtggcccacacgtgtaatctcagcactttgggaggctgaggcgggtggatcacaaggttaggagattgagaccatcctggctaacacggtgagaccttgtctctactaaaaatacaaaaaattagccaggcgtggtggcaggcgcctgtagtcccagctactggggaggctgaggcaggagaatcgcttgaacccagaaggtggagtttgcagtgagccaagatcatactactgcaccccagcctgggcaacagaacaagactctgtatcaaaaagaaagagaaagagagagagagagagagagagaaagagagaaagaaaagagaagagaagaaaatccctcttgcctgcagtggacaacaaataggaagactggctctcctaacaccgtgggcacacgtagcctctttcagagtctcacagttcccaagacagatttggggttagacccgtggtcctgccacttccatgctcagtgaccctggccaaggtacttggcctctctgtgcctcagttgcctcatctgtaaaatgagaggtaatggcagtaaccaacctcacaggctactaggatggtcaaacgagttaatgcatataaaacccttgactcgttgtctgcatgggtcagtgctgcttttaaaaaaattttttttttcttttctttttttttttttgagatagaatctggtctgtcacccaggctggagtgcattgatgtgatccctgctcactgcaacctccacctcccgggttcaagtgattctcctccctcagcctcccaactagctggaattacaggcatgtgctaaaacgctcgactaatttttgtatttttagtagagatggggttttaccatgttggccaggctggtctcgaactcctgaccacaagtgatccacccacctcagccccacaaagtgctgggattacaggtgtgagccgccacgcccagctttgaggctgtttttgatattggtggatatgtcgtctctttaagagaaagccagcacttaatgctgaatgatttacctcaattataaaactttttttttttctttttgagacaaggtctagctctgtcacccaggctagagtggtacagtcacagctcgctgcagcctcgaccctcctgggttcaagccgtcctcccacctcagcctcctcagtagctgggactacaggtgcacgccaccatgacctgctaattttgttttttggtagagatgaagtctctctatgttgcccaggctggtcttgaaatcctgggctccagtgatcctccttcctcagtctcctaaggtgctgggattacaggcatgagccatcattatttaaaaaacaaacaagctatcatttttcagccctaccattgtttcctgacttatgtaatataactaaactgtttttgaagcttaaaatcaactcaagcttaattgagaagatgagctagtttgtttcctcaggtgtgtgtgcgtgcgtgtgtgtgtgtgtgtctggaaagttcttaccctttctcctcaggagtcaggagcctgggaatcaggagcttagggctgggagttctgccagagcaagagcaagatgtggcttgaggcccttcagaagcctccctgactcacagcaagaagcttggggcctcttactgatgggtggatgaggttcttttctgtcttaaaggggcaactcctatgttgtgtttttttttttaagaaaaaaggccaggcactgcgactcacacctgtaatcccatcactttggtaggctgaagcaggcggatcactttaggccaggagttccagaccagcctgggaaacacggggaaatcctttctctacaaaaagtaaaaaaaaaaaaattagcccggcatgatggtgcccgcctgtggtcccagctactggggaggctgaagtgggaggatcacctgagcccgggaggtggaggttgcagtaaggcaaggtggcacctctgcactccagcctgggcaacgagagagatgaaaataacagttctttctctttcctctcctcttccagctccttctcctctttctcctttttctttttctttttcttttttgagatgaggtcttgctctgtcacccaggttacatgtagtggcatgatcacggctcactgcacccttgacctcctgggctcaggtgatcctcccgcctcagcctcctgagtagctgggactacaggtgtgtgccaccatacctggctgggttttttttgttgttgttgttgttgtttgtttgtttgttttgaggcggagtcttgctctgtcgcccaggctggagtgccgtggcgcaatcttggctcattacaacctccacctcctgggttcaagcaattctccctgccccagcctctgagtagctgcaattacaggcgtgcactaccatgcccggctaattttttattttatttttatttttagtagagatggggttttgccatgttggccaggctggtcttgaactcttgacctcaggtgatccgcccaccttggcctcccaaagtgctgggattacaggcatgagccaccacgcccagctgtttttgtttttgttgttgttgtttgtagaacctgttgcccaggctagtatccaactcctgggcacaagtgatcctcccaccttggcctcccaaatttctgggattacagacaggagccactgcgcccggtctcagtcctccatcttttaatgttaccctctccatgaggcacagccagagtgggaagccccttatgggtcccaccttctcatctcggattctgtcctgcctgtgggaggaacagttacacccacagccccagagaaaaaggggcagggaaatagcaagagcatcccagtgtcctcaccaggctcagctgccacccgagatctgctctggccaagccctgggtggcggccacatgggagaagaggaagagggcaggctccaggccaaatggggcagctccctagcaaggcttctgtggatgtccctggaggctttttaaaaatttgtgccccaaaccaaactcgccgtcttcccggctctggctgatgtactgactggaagcccctttttggtgtcatcttcccatcacgaaccatggcctgtcagttgcacctccagaaacctcttgcatctgtctctgctgttacagctgtctgagccactgtcacctctcactttggtgacaaacagccacccagctctctccccacttcctctcatccttttccaattttctccaccaagaatccagaatgaccttataaaaactcaggttgggccgggagcggtggctcacgcctgtaatcccctgcctttgagaggccgaggtgggtggatcaccagagatcgggagttcgagaccagcctggccaacatagtgaaaccctgtctctattaaaaatacaaaaaattagctgggcgtggtggtgggcacctgtaatcacagctactcaggaggctgaggcaggagaatcgcttgaactggggaggcagaggttgcaatgagctgagatcatgccactgctctccatcctggacaacagagcaagactccatctcaaaaaaaaaaaaaaaaagaaagaaagaaaaaaaggattgtggtgggccaagaaataaaatagccctccaaaacagccaggtttcaatccctggcacctgagaaggggaaatcacttagaaacagggtctttgcaggctggccatgttggcttatgcctgtaatcccagcactttgggaggccgaggagagcagatcacctgaggtcaggagttcaagaccagcctggccaacatggtgaaaccctgtctctactaaaaatacaaaaattagccaggcgtggtgatgcatgcctgtaatcccagctacttgggaggctgaggcaggcaaattgcttgaacccgggaggcagaggttgcagtgagccgagatttcaccactgtactccagcctgggcgacagagcgagagcccatctaaaaaaaaaaaaaaaagaaattagaaacagggtctttgcagatgtgattaaattaagcatcttgagatgggggcattatcctggattatttaggtgggccctgaatgccatctcaagagtccttataagagagagacagagggagactagacacgcagagagaggagaaggccacgtgaagacagagctgaggatgctggcattgaagataaagcgatgcagccacaagccagggagtgtcagcagaagctggaggaggcaagaaacgtgttcctcccggggcctgcagaccccttggtctcaccctggtgacactgactttggacttctggcctccagagctgtaagattctaagccaccaaatatatggtgatttgttacggcagccgagagaaactaataggagagtggttagtggttcacgctacaccctggtctacaccggaagcctctctccctggcacatgatggtgtccccaggatccagctcagagccaggcacacagtggggcccaggagagacaaaaatgatgtgcagaagcaaatgggtggggtttgccacccacctcccttacctcccttgtctgtttagcaaagaggtctttcatgctggtgttttccaaattaggttgtgaccatgtgtgatcatgacatccaggcagagggctggcatttttccgaaaaagggtagaaaatgtcagagtatggtgtgtgtgtaggcagggtcagtattggtcactgacccttacactgcagtggcatttgtgaaataggtcagggtcactggtcacgttgtctaaggtgttatccgagctcgtttcacaaccaagagaattaaagagcatagaccacccaaaaggtgaggttggagcgaaagtttaataagcaaaagaagaaagctctccacagaggagagggaagcccaagcgggttgccatttttacagttgattccaaaagcttttttttttaaaaattatttatttatttattttttattattatactttaagttttaggatacatgtgcacaacgtacaggtttgttacatgtgtttacatgtgccatgttggtgtgctgcacccagtaactcgtcctttagcattaggtatatctcctaatgctatccctcccccctccccccaccccacgacagtccccggtgtgtgatgttccccttcctgtgtccatgtgttctcattgttcaattcccacctatgagtgagaacatgcagtgtttggttttctgtccttgcgatagtttgctgagaatgatggtttccagcttcatccatgtccctacaaaggacatgaactcatcattgtttatggctgcatagtattccatggtgtatatgtgccacattttcttaatccagtctatcattgttggacatttgggttggttccaagtctttactattgtgaatagtgcccgcaataaacatatgtgtgcatgtgtctttatagcagcatgatttataatcctttgggtatatacccagtaataggatggctgggtcaaatggtatttctagttctagatccctgaggaatcaccacaccgacttccacaatggttgaactagtttacagtcccaccaacagtgtaaaagtgttcctttttctccacatcctctccagcacctgttctttcctgactttttaatgatcgccgttctaactggtgtgagacggtatctcattgtgattttgatttgcatttctctgatggccagtgatgatgagcatttttcatgtgttttttggctgcataaatgtcttcttttgagaagtgtctattcatatccttcgcccactttttgatggggttgtttgtttttttcttgtacatttgtttgagttcattgtagattctggatattagccatttgtcagatgagtaggctgcaaaaattttctcccattctgtaggttgcctgttcactctgatggttaaactaaagagcttctgcacagcaaaagacaccaaaagcttttataagaaactcctttcatctctgtagctgtttgagtatcttatctgtaaagctatctgcataactctccgttatctatgtagttgtgggtacgtctttaggcaagcacaaagctccgcttctcttgtttctgtaaccgtgggtttgttttaggtaagctccgcccctccccgtgcaagttcccacagagaccaccatgtacgtgcctgaaaaggggagggaacttttcctgggagcctgtcagtcacgcaaagaacaaaaggcttctgtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggtgatgaaggtcttggggagggggctggactcctgggtctgacggaggaggggctgggacctggactcctgggtctgagggaggaggaggctggaagtctggacccctgggtctgagggaggatgggctgatagcctggattcctgggtctgaggaagaaggggatgggggcctggactcctgggtctgaggaaggaggggctgggggcctggattcctgggtctgaggaaggaggggatgggggcctggactcctgggtctgaggaaggaggtgatggaggcctggactcctgggtctgagggaggaggtgatggaggcctggactcctgggtctgaggaaggaggggctgggacctggactcctgggtctgagggaggaggaggctagaagtctggacccctgggtctgagggaggatgggctgatagcctggattcctgggtctgaggaaggaggggatgggggcccggactcctgggtctgaggaaagaggggatgggggcccggactcctgggtctgaggaaggaggggatgggggcctggactcctgggtctgaggaaggagggcatgggggcccggactcctgggtctgaggaaggaggggatgggggcccggactcctgggtctgaggaaggaggggatgggggcctggactcctgggtctgaggaaggaggggatgggggcctggactcttgggtctgagggaggaggggctgcgagccagactcctaggtccccctgaggatagcagccaagtcaagcccctctgtccttggcaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggtagctgtggtcagccctccctgtgcccccttgctcatccctgctcgggaggagggtggtggagatacggggtgagacagcagctggccaggcccagggcattcaccactccaggctgagcagcttgggactttgctgacccttctgacagagagtttgagcagggaggacagagtccctctgggtgttagaaagatcctcttgggccaggcacggtggtttacgcctgtaatctcagcactttgggaggccgaggccagtggatcacttgaggtcgagagtttgagattagcgtggccaacatggtgaaaccccatctcttctaaaaatataaaaattagccgggtgtggtatcacctgcctgtaatcccagctacttgggaggctgaggcatgagaatcactggaacctgggaggcggaggttgcagtgatacaagatcgcaccactgcactccaggcaccactgcactcctgcctgggagcagagcgagactctgtctcaaaaagaaaaaaagaagaaagatccttttgggtgagtttagaggctgggaggccgaggtgatggtcatgtgggggagaatgaggcctcagccaaaggtgacaggacagagcagagacatgatgtggcaggagagactgggcttagcatggggagggagggcagggaggaggcaaggacagtgcctgggtctgccttggtaacacaggtaggaaacccaggaagaacaggaggttagaggaggatcctacaaggggagtgtgaagagcccaggagacatcgatgcaggttcaggagacaggcctgggcttgaaacaaagacttgagaattttggagggcactggggagctatgggagttctatgagcagaagaggggtgggatcagcactaggtgcagaaagagcccccctgggctttgagaatggactggaatgggaaattggaggccaggagttagggaaggaggttagggctgggtgaggacccgaccagaaccttccctgccacactggtgctccccactgagataggggtacatggagctcatctgttcccccaggagaccctcgggcaccacctctgctcaggggtagctcatctcatttgagggcaaacctcatggcctcaaccagggaaggggcagaagagggacgtcagaagagccacaggcagatgggagtgagaagaggcagggaattagggatgaggctgagaaggaaggccaaagactgcaaggtatgtcaagcagagcacggagacagcagagcacagcaggctcaggtagagctggggcccccggagagagatggggatcccagggccaggtcagttctgggacaaagaggaggctgatgggtccaggtaggtcactgggtgtcctgcccagccctgagaaagtcagaagaaaacagagagagattatcaacagcaggggcatcagagtacagatcagtcaactgtggccgaagggcctacccggagaacaggccaaaaaggcagggcctgggtggggctgcagaggccgaggtgctggaagcatggcctttgcagccccctgcattgctggtcgttctcagactccgatgtcctacctgtcctgggccagggacagttcctggggccagggcctccagctggggaaatgccggatgaactggtcaggatgctgtttgttctaggaagcagattcacaactcaaactggcttaagccagaaagcgaatttattatctcacgtaaatcaggggcttcaggcacagcttgatccagggtcacatatgagctgtaggctcccctctaccttgtcttcactgtctgtatctccaggctcagatcccaccagcccagtgaccccagcagaaagaaaggagcatctttcccaagggccccagcaaactcccagggctgactcttctttggtgcagcttgagtcatgtgcccctccctgaaccaatcactgggctggggctagaatgtccttgctggcccagaccctgttcatgcagctgcccaggggccacatagggtgggactcctgagaggctttatacagagggcagagacttgacgacagggatgccagatggccccacatgtccctggacaagtggctgcttatctctgggcccaagtgaggggatcgttctagaccaaaagtcagtgaactatggcccagagcgacctctgatttgtaaataaagctttattggaacatcaccacatacattcatttacatattatttatggctgcctgtgtgctacaacagcagcgctgagtcaccgtgacagagaccgtatgacctgcagagcctgagatatttactacatctgttccaccatagaaaaggtttgccaacccgactggctgcggtgactcatgcctgtaatcccagagctttgggggatcatctgaggtcagcagttcaagaccagcctggccaacatgttgaaaccctgtctctactgaaaatacaaaaattagctgggcgtggtgttgggtgcctgtaatcctagctactcaggaggctgaggcaggagaattgcttgaacccaagaggcggaggttgcagtgagccaagattgtaccattgcactccagcctgggtgacagagcaagactccgtctcaaaaagaaaaaaaagaaagaaaaagtttgccaacccctgttctagacagaggcctgaatggtccatgagctccactgattgtcatacagtcttctgtctctccccattcaggccatcgatgatgactgtaaccagacagggcagatgacagctggatttcttgactggccacaggtgagactggagtggggagcacctgctgagggccaggccctcatccctcaaacttcatttctgcctcaaggcctttgcatttgctgttctctcctcctggaacactgttccctcagattgcctcatggctttcttgttcccctccttgaggtctctgctgaggtatcacctcttcaaaggggccttccttgccatcctacgtgaaatactcatgcccacccgctcaactccaggttccccagtccccatctctgccagtccaatagaaatgcaggctggggccaggcatggtgactcatgcctgtaatcccagcactttgggaggccgaggcaggtggattacttgaggtcaggaggagtttgagaccagcctggtcaacatgttgaaacctcgtctccactaaaaatttaaaaattagctgggtgtggtggcgtgcgcctgtagtctcagctactcagggggctgagggaggagaattgcttgaacttgggaggcggaggttacagtgaggcaagatcgcaccccactgcactccagcctggcaacagagggaggctccgtctcaaaaaaagaaaaaagaaatgcaggcttggcacagtggctcacacctgtagtcctagcactttgggaggccacggtgggaggattacttgagcccaggagttcgagaccagccttggcaacatagttagaccccatctctaccaaaaaagaaaagttagctgggtgtgatggcacatgcctgtagtaccagcctcaggaggctgaggtgggaggatcccttgagttcaggaggtcaagactgcagtgagctgtgatcataccactgtactccagcctaggtgaaagagggaaaccctgtctcaaaaaaaaaaaaaaaaaaagaagcaaggcacatagacaaatttaaaatttttcacagctacataaaaaagtaaaaagaaacagacaaaattatattttatctcaccccattatatctaaaatattattttaacatgtaatcaacataaaaatattaagatacatatgctctacaagcaatggggttacgtcctgataaatccatcataaattgaaaatattataactgagagaatgcatttaatattcttaatctaccaaatatcatagctgagcccagcctaccttaaacatgtcacaacacttaacgttagcctacagtggggtaaaataatctaacataaagcacattttataataaagtgctaaatatcccatgtaatttatcaaatactgtactggaactaaaaaaacggaatggttgtacggacactggcagtatggtttctactgaatgtttatcactgtcacatcatcggaaaactgaaaaatcttaattcaaaccatcacaagtcagggaccatctgtattttacgttttttggattttctttgtactaaatcttcaaaattcagcatgtattttatatttacagcacatctcaattcaggtgctaaatttctatgagaaacacattcctaaagatgacagttgaaatagatttacacacccaagttgttcaaaacaaacttaaaagttttctagtaactgcatttccagtaactgcattgggtatctgtgtttttttgtttgtttgtttgtttttgtttttttttaaaacagcttcgttatttacctacaataaaccgcacatatctaagttgcacaatttgttaagtttgcttttcttaaactcttttatttagatagagatgggggtctcactatgttgcccaagctggtctttaactcctgggctcaagcaagctgctcacctcagccctccaaaatttaagttttgatatgtgttacatccatgaaatcatcaccacaatcatgataatgtgtcttgaattctcagtatttatttatttttatttttttgaggtggagtcttgttctgtccccaggctggagtgcagtggcgcgatcttggctcactgcagcctccgcctcccgaatttaagcgattctcctgcctcagcctcccgagtagatcggattacaagcgtgcatcaccatacctggataatttttgtatttttagtagagacagggtttcaccatgttggccaggctggtcttgaactcctgacctcaagtgatccacccgccttggcccctcaaagtgctgggattacaggcatgagccactgcgcctggccaaattatcagtatttaaatttaaataaaatgtaaaaattcattcctcagctgcactggctggacagccacacgcagccagtggctactggatgggacaacacattcaaaaccattatcctgttttatcttcaaagcatttaccactgtctgactagcttctccaacgtgcgcccttcttgctctcatatcatgtgtcttattttcttcttattccttctgattggaaatgatctcatttgtgtgtgtgtgtttttccctggtgactggttgtcttccctggcagaatatgagcccacccaagctggtgcttcactggtcgtgttcacagtgtgtctccaggggcaggttcataagggcactaggaggaggttgtgaatgaagggaggtgatgttcacactaagacctgaaaaatgtgtccagttaataagtggacagggacaaaggtcgttagacaaagaggagtgtaggtggcatcagttaccaggggaggaaatgttgattcaggactgagaggcaaagggacctggctagaggacggggtcccagaaggtggtttaaggactggtgtggacacacacagttctgttgtctgcccagcggaggggcctcacggggggccgttgggagccagattgtcagcttttggatttaccagctgtgggtggcagtgggcgtgtaactcagcatcttgctgcctcagtttctctcatctgtaaagtggggataataacatttacctcataaagttcctgcgaggattcgatgacttgatacatcagttgcttagcgcagggctcagcactcagtacatgttccctgtcaggaaggcagggaggcctcactggcagcatcaggacatgggacatcaggacatacaccgtggctctcagggaaaggaaagagaccctctcccaggtgtacaagctcgattctaaacctcatgggaccctgcattgttcgctccctcattcattcactagtccatgcgtgtactcagtagtggcataagcagactgctcgggtcggacctgaattagcctcacccactctcctcctacactgtccctccccagggcacattcgcctcccaggtgatgctggagggggacaagttgaaagtggagcgggagatcgatgggggcctggagaccctgcgcctgaagctgccagctgtggtgacagctgacctgaggctcaacgagccccgctacgccacgctgcccaacatcatggtgagcccctggccagcgggcactgagggcctgggggtggcaagcacattgccagcccagtgccccccggtggtcgcacgtggggagggaaggatccaaaggaggtctcgtgcacaggaagccgtcacctggagtttggctgatagagagagtttgctgggtcatctctgccaatactgagagttcatgggggctgctttggctagcagggagggcttgctggtatgtaggccagtagaaagccttcgctgggcagcagaaggtgttccctttgtcattccagccagtggaacaagttcactgggtcatctaggttcattagggagggtccccttggtaatttttgccaatgtgaagttaccatgtagatcatcttagttaactaggaagggtgcatggggtctcttggctaacaggtagagttcactaatcatcatggccagtaggatgggttcgctgggtcatcttggccaatattaacagtttagtgggtcatctccgccaatagagaatattcatctcagccaacagggagggttcactggatcatctcaactaatggggagggttcaatgagtcatttcagccattacagagtgttcactacatcatctcagcctatagggagagttcagcgcatcatctcagtctataggcagggttcagcgcatcatctcagcctatagggagggttctgcgcatcatctcagtctatagggagggttcagcacatcatctcagtctatagggagggttcagcgcatcatctcaacctatagggagggttctgcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagcctatagggagggttcagcgcatcatctcagtctatagggagggttcagtgcatcatctcagcctattgggaaccttcagcatgccatctcaaccaaaagtccactgagtcattactaccaaaaggatgggtttgccactctgttgcagccagtgaagggcttcctgatttggttacctaaaggaggactgctgcagtagttgggccccccagggccccctagccagcaggagttgtccacaccaggtgtggccctgtgagaagtttcgcgtgtcctggccagtgggtgggtccagagggttcagcccatgggactggtctgcaggcctggcacccatgggaaggaggtggcaggaagggtggcaggagttccacagccctgtgaacaatggcttcccatgtgcagaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctctgttaacttatttcctagagacccattatttggttcattcaacatttacttgagtcttttgtgtgccaggccctgtggatccagtccctgcccatgaggagcctctgtattgatgcgggggacaatgaggacaaaggcagctgtaattcggggtgaagtatgctagacgtggaggcacactgggcccttgggaacccaactgggggacctggcctggcccagccggtggggtcagagatttcccagggagatgacttccaagttgagtgttggaacacaaatatcagtgaggtgggtgagaagaagggcttttatccacgatgtttgcaggacactcattctctcttgtgtccccagtctcagcagggacacaggagagaatgaggccagaagctgtggttctggtgtgagacagacaagccacagagaatcaaaacttagcgttgcaatgaacagcctgggtctacagtcaggttaatttttttttaattatgttttttgagacagagtctcgctctgttgcccaggcttgcaccaccacacccggctaatttttgtacttttagtagagacggggtttcaccatgttgcccaggctgtcttgaactcctgacctcaagtgatccgcccgcctcagcctctcaaagtgctgggattacaagcgtgagccacagcgcctggactaattttttatttaaaaaattgtgttccattcctctggccttctgatagagtcagatatattgatttcatatgctcactcttacctttgccagctagatcttgggtgagttccttcctattttgagtttcagttgcctcatctgcagatgaaaatagtaacagcatcatgtagaggttaagggtatgggttactgggtcccagggccctgggtcaaatcccactggatccattcctggatccagttcaggatcagttcatgtgcctcaaatggggccaggggattgacttccaagagggctcacccacatagccagcaagctggctggggctgctgaccaggggccatgattcccctccatggggctgctgatcctcgcagtgtggcggctggattccatgagggagtgtcctatgatacagaaagtggcatatgccggcctagatgcagatcctggcacagggccacttccacgtcttggtccagcagtcacacagcctactcagatccaagcagaggggacatagaccccgcatcttaacaggaggacgctcaaatttgcagccctctttaagctacatcatctactccatggagttttgaaaggttaatttatgtagcacccccataaccacacctgctatgcaaaaaatgctaaatatatattattaccaatattagtccgggcacggtggctcacgcctgtaatcccaacactgggaggctgaggcgggcagatcacttgaggtcaggagttcatgataagcctggccaacatggcaaaaccccatctctcctaaaaataacaaaaattagcctggtgtggtgatgcacacctatactcccagctgctgcagaggctgagacgggagaatcacttgaacccgggagatggagcctgcagtgagctgaggcactcactgggtgacagaacgagactccatctcaaaatatatatatattaccagtattattactggtgagaactgggccagggtaagcttagaggactgggagctgagcagaggccctaagctccacatgggatggtgggaaaagctatcagaaggagtcaatggtctgaccatcctggtcccaagtccagcttctccctctggctgtgcaacctcctgcaggtcccttgacctctctgagcctaagtcccctggcctgcaaagtgagtataatgacactcagcttatagggtgtttagaagtgttcagcctgatagtgcataggaaacatttagcgtagttcctggctcaaattaagtggtaattatggttcttaataaggtgagacctgaaggac

SEQ ID NO: 17401 - DNA, 14862 bp, Human
gagaaacacatacagagatagagccttacaaagagataggtgcggtggctcacgcctgtaatcccaacactttggaaggccaaggcagatggatcacttgaggtcaggagttggagaccagcctggcctacatagtgaaaccccatctctactaaaaatacaaaaaattagccaggtgtggtggtgggcgcttgtagttccagctactcgggaggctaaggcaggagaatcgcttgaacccgggaggcggaggttgcagtgagccgagctcacgccactgcactccagcctaggtgagagagtgagactccgtctcaaaaaaaaaaaaaaaaaaagagagagatggggatgcagagagacggaaggaggatagagacagagctagagagggagggagatagagggaaaaagagacagagagaaagagacacacacacatggacacacagtgagaaagtcagggagaggcactcagaaagaaagagagccacacaagaagaaagtcagggagacttcagaaatgcaaagggacagacactcccaggtaaaagcagagagagaatggctgtgaggggggatgaggaggagaaacagacaggaatacacagaggcagagacccaaatagagggaccgagaaacagagatggggtgacagatacaaaatgacagagatttggggagggacagacgaggagagagaagcacgggggaatttctctctgctgctccatgtctttcagcctgtcctggagctggcccgtgccagacaccaaaaggtcgttggagtcacaggcagggagaaaagaacgaggcagctaccgaggcagctaccaaggccgaaagtgagacatcaatagttcacagtaagaggagcagagagaagaacagaattagatacagatagtttttttaaaaaattcatggaaagaagggcatgtaaacagacatttatcacagatctggtcctgaggggctggggttcgggcaccccaggtcccgcatctcttttcacccttcctctgactcagtttccctgatgggtgacagcactgacagaccccggctggctccccagggtcagctgaccgacaactctctgtgttcatccctgagtccctggggatacaaatcccagcgccccagctctccaccccagaccctggtgcacacacgcagacccacgtcagttaggcgctgaatggacagatgttcactcacagctccggttccaggcagccgtgcctcgggccagcgtacacacaggcacacccacagcacgcacgtgtgtgagtttcgttccatctgccagttgctgagacatgtccctggggggcccaacccagagatggattctggggacaggagaggcggctgtggggagaagcagggcgggggtgactggggaaggtgagaagggggaggtggggagagctttaaagcaagaagagaaagaaatgagggtgagaggaggcaagagaagtggagaggaagaaagggatggagagaaagacagaaacttggagaaatgtggtaatggggagagagatgagggtaccaacaaagagatgaggagaaatagtgggttagggagaaagaaagggatggagggaaatacagggataggggatggggggatgaggggaacccccaaaatgcaagtgaggtggaagagaaaaatcaggggagacaagggacgagaggggggaggaagagagaagaagacatagaggagggagggagaggagggggagtgatggcagagaggactagaggaggggcgcgggtagacatgggggcctgggaagggaggcccgtctggctgaggggggtgggagtaatagcgggaagcgggtggagctgcccggctgggccgtgacctcagagcccctggcccagcttagcctgactgacgtcagcgctcgctcccgcccccgcctgcgctggtcttcaaatgacccccctccagctctctggccacagagaggctgggagagcaagccggagagaagagagagcccggccagacccactgcgatgagacaggtgtgtgtgtgtgtgtgtgtgtgtgtgtgtgtgtgtgtgtgtgtatacagccatgtggggaaaactactgccatatgtgtgaccacgtgtgttggggaactgtgtgtgcatgatttcatgtgtgtatccatgtgcctgacagtgaccatatgtgtgtaggggacagtgagcatgtgaggctgagtgtgcaggtctgtgtatacattgccctgtgtgagcggccatcccaagtacatgtaggtgagacgtgccatgtccgtatttctgtatctgcgtatcttgctacaaacttgtgtatgtctatgttccctgggaggcagagagaaagagggagtgcgacagtgagcgaatgaaagagactgagtgagaaagagagttggatttgcctgtggcacatgggaatggatttctgtttcatgcgttcaatagctattaagttgaaccaaatgaaatcgccgatactgagccactctaaacttggaagaatagcaatttcatctggttcagtatcagcttgacagtcacctactatttctcttgaaatcttccctgtgcgtcccattgccccagactctcagttggggctctgtgtgtttgtggccacgtggacatcctttgctggtgttgctttttcctgctgaggggtgtgtgtctgcaggttcacctgtgtggccgtcggtgggggtcacgggatcgctgtgtttggcctgagtgggtgtctcgggtcatcctgtagaacacgagtaatttcattctgtgtgtcactcatcatgtgtgagttcacgtgtgggggagtgtgtctacacgtgtgttcatctgtgtttctggaatcaactctctggatccccagcatgaattgagccatccctaggaactcaggcaaggccaggtttgaagcaaaggaagagagaagggggattcgagaagaaagaataatgtttaatgttgagagtttaaaagctgtacctcagttttgtcctctagaaatgtaacgaaaaccacaatatctaatttaaaattttcttgtggccacatttgaaaaagtaaaaacaaacaggtgaaattaattttaataatatatttttatttaacccagtgtgtcaggggccagcacatttttttaaataaagggcccaatattaaatatttgaggcttttgggggccatctggtctcttttgaaagtactcaacttcgatgtggtaaatgtagaatcagccacagatgatgtataaacaaatgaatgtggttgtatgcaaataaaacttcctttaaggacactgaaatttgaatttcatatttttcatgctccacaaactattattcttcttttggctttcaaaaaccatctaaaaacacacacacaaattcttagcctgcaggctgcagcaggtcttagcatgccgacccctgctgcatataagatatgatcatttcaatatgtaatcaatacataaatgttaatgagctattttactttcttttccccagacttggccttcaaaatccagtgtgttcatagcacttctcacttagatgctaccttttcactggaaatacctaatctgtgtttagattttataagatttacaattataaaaggggcatcgtagatgcaacttgttccagacatatttaaaatctttccaataaccgaatcaagtaagagtttttaaatttaaatgaattaaaattaaataaaatttaaaactcagttcctcggtgatactggctgcatttcaagtactcggtagacacatgtggctgctgacacctgtgttggacacaaagatctacatcttaacgacgcatttaaataacccacagtaagccttgaggcaggaactggtggcataggaggcagtttagcgtagaggggacgccagagccagactgcctgagttttacttctgactctgcttattacctgagtgaccttgggtaaaagtatttgcctctcagtgtctcagtttcctcatctgtaacagaagacagtgaaggtacctgccttataagattgttgtagagaccgggtgcagtagctcacgcctataatcccagcactttagggggccaaggcaggaggatcgctagagcctgggagttcgagaccaacttgagaaacacagcaagaccctgtctctattattattattattatttcgagatggagtctcgcactgtcacccaggctgaagtgtagtggtgccatcttggctcactgcaacctccacctcaggggttcaagcagttctcctgccttagccttctgaggagctgagactacagtcgtgcgccaccaagcctggctaatttttgtattttgctttcgccatgttagccaggctaatctcgaactcctgacctcaggtgatccacccgcctccgcctcccaaagtgctgggattacaggcgtgagccacagtttctggctccctgtctcaatttaaaaaaaaatttatatatatatattaaggttgttgtacagtagtgtctggcacacagaaagtactttttcctctgattctgggctcttccagcaacatttactggggcacctggctctgctggggagttgggcagtggaaaaggagaaccaggctatgcctctggaaagtcagagagaagagtcctctaccatgggctgctgatcttgtgcaagccactccttctggccaatcagtcctcagtttggccacctgtatggtggcagagcactatctgtcccccagggctctcccgagggctagaggtttagagattcagttcctagggttcaaatccaggttcctctgctttccagggacgaccttgggcaaattgctgaacctctgtgtgactcagttgcctcatctgtacaacggggataataataacagtacctaccttacagcgctgttgtaaagattaaaataaattcattcatcttaaaggcttagagcagggactggtacacagcattttggttttttagtatgtgttattattattactgtctcaaccctaagaaaactttgattgggagataaatcctcattgtatgtgccactaagaaagaggagggaaacgccctagtaattaaattgtgacactccatcgcatgcaatcatcctcacggatttaagagatttcaaaacgtggaaaaaagttgtattggaagaaacaaaatcaggctgggcttggtggctcatgcctgtattcatagcactttgggagactggggcctaggagacatagtgagacccctcctctaattttttttttttttaattagcaaggcatagtgactccagccttgtggtcctagcttcttgggagactgaggtgagagaatcgccagagcctaggagttagaagctgcagtgagctatgatggtgccactgcaccccagcctgggcgacagagcaagaccctgtctataaaaataaataataatgaaaagaaggaatctaatcagcatgaagcctagatagctatttgctccaattattttcgttaatgaaaataattttggggcccggcgaggtagctcatgcctgtaatcccagcacttaggaaggccggggcaggcaagtcacttgagcccaggggttccagaccagcctaggtaatgtagggagacccccggctctaccaaaaatttaaaaattagccaggagttgtggcacactctttgtagtcccagctactcgggaggctgaggtgggaggctgagcctgagctcgggaagctgaggctgcagtgagcctagatggcgacactaggctggagtgagaccctgtctcaaaagaaaaaaaaaacaaaaaacgaaaggagagagaaagggagagcgagagcgagagagagagagagacagcgagacagacacagagagagagaaagataaagagaaggaaggacggagggagggagagagagagggaggggagggaaagggaaggagggaaggaaggaaaggatttttaatcttctctcggaggaggctcatgcgcccgggactcatgccccttcctttcccctctcgctcccagcaggacgcgcccaagcccactcctgcagcctgccgctgctccggcctggcccggagggtgctgaccatcgccttcgccctgctcatcctgggcctcatgacctgggcctacgccgccggggtgccgctggcctccgatcgctacggcctcctggccttcggcctctacggggccttcctttcagcgcacctggtggcgcagagcctcttcgcgtacctggagcaccggcgggtggcggcggcggcgcgggggccgctggatgcagccaccgcgcgcagtgtggcgctgaccatctccgcctaccaggaggaccccgcgtacctgcgccagtgcctggcgtccgcccgcgccctgctgtacccgcgcgcgcggctgcgcgtcctcatggtggtggatggcaaccgcgccgaggacctctacatggtcgacatgttccgcgaggtcttcgctgacgaggaccccgccacgtacgtgtgggacggcaactaccaccagccctgggaacccgcggcggcgggcgcggtgggcgccggagcctatcgggaggtggaggcggaggatcctgggcggctggcagtggaggcgctggtgaggactcgcaggtgcgtgtgcgtggcgcagcgctggggcggcaagcgcgaggtcatgtacacagccttcaaggcgctcggagattcggtggactacgtgcaggtgagtagaggcgccttcagcccactcgtgacccgaacacccaaatcccactttcctggggtctttccttcaatgtacagatttgaatgactctctccctttctttattctttcatccatgcagtggagagattctttccttcactcattctttcatccatccatctatccctttatccaatatggagatcattcgttcatttattcattcatttacccattcaatgtagaggcattctttccttttttcattcacctacgcattccaggaagagacaatttcactcattcttgactcatccattcatctatccatccattcaatatagagattcatttgttcattcatccactgattcagttatccatccattcaatgtaaaattaagcccttccagccggccactttgagaggctgaggtgggcggatcacctgaggtcaggagttctagactagcctggccaacatggtgaaaccctgtctctactaaaaatacaaaaattagccgagcatggtggcgaatgcctataatcccagctactcgggaggctgagggaggagaatcttttgaacccgggaggcggagggtgcggtgagccgagattgcaccattgcactccagcctgggcaacaagagcaaaactccgtctcaaataaataaataaataaaagttcttccttacttcattcagtgtagaaattctttttctttactcactcatggatataccatctatccatccaatatggagatcatttactcatttattcattcatttatctattaaatgtggagatttgttccctttcttctttccttcttccctccttcctttcccctccttcagtgttgagattctttcattcaaccactcagccatctatctatgtattcaatatacagattaatttcatttatttatctcattcatccatcccatttggtgtagcaatctttttttttttttgagatggaatctcactccgttgcccaggctggagtgcaatggttgaatctcggctcactgcaacctctgtctcctgggttcaagtgattctcccacctcagcctccccagtagctggtattacaggcacctgtcatcatgcctggctaatttttgtatttttgcagggacagggtttcaccatgttggctaggctggtctcaaactcctgacctcaggtgatctgcccacttcagcctcccaaagtgctgggattacaggtgtgagccaccacacccggcctggtgtagcaattctaatgcattatattagttttccattgctgcataacaagttaccatatgtttggcagcttgaacgaaacacatttattatctcatagtttctatgagcccagagtcagcacagctcaactggatccttttttcaggatatcaccaggttgcaatcaaggtgtcagctggagctgggtcttttttaaggcttggggttatctttcaagcgtatgtatttgttggttggcagaattcactttcttgcagccatagaactcatggtagcagtagcttgcctcttcaaggccagcaaggagactctctgacttctaggtctgcttttaaaggttctcctgactaggtcaggcccacccaggataatctccttttgattaacttatagtcaagagatttggggacttaattacattgcaaaacctattcaccatttccatattaggtaatataatcatggcagttatatcccataacttctgccatattctattgcttagtagcaagttaggggtctcactcacacaccagaggagatggtatatgtcttattgttcatgttcatacaaggatgtgcatcttggagtacatgttaaactgtgactacacattgaaaatgactttaaaaaatctcaaaattatgttcagatcggttgcagagtgccccagctgcattgcaccccttgatgccttcctctcaagcatcagcctgatgcaggggtctgtgctgatcctggccccttccaccttacaggtctgtgactcggacacaaggttggaccccatggcactgctggagctcgtgcgggtactggacgaggacccccgggtaggggctgttggtggggatgtgcggatccttaaccctctggactcctgggtcagcttcctaagcagcctgcgatactgggtagccttcaatgtggagcgggcttgtcagagctacttccactgtgtatcctgcatcagcggtcctctaggtaagcaggggcagagattgggagggctgtggatggggtggaaagggagaagggaagccggatggggctgaggatgtgactggggttgggaacaaagatgcagcagggcaggaattggggatgggataaaactggaagctggcagtgaggatgctgcttgggctcaagctgagtttggtgtggggagtgaggttggaaaaaagatatggatgacgattggggctggggctggggaagaagatgggataggcttggagtcaaagacagagttggagccaggttagaggttgcagtgggttttggatggggctgagaatggatatgggattggtgatgagactggggtgggcaggtttgcagtcacagtgggtatagttcaatgacaggcaagttggagtgcgtatgaggttgaggacaggattcgggctggagatgggattggagatagtgctgagattgagattatgatgactgaggatggggttggaactggagatggggttggggctggaaacagcattggagttggtgttggtgacagcagaggctgacactctttcacacctcccctccacccaggcctatataggaataacctcttgcagcagtttcttgaggcctggtacaaccagaagttcctgggtacccactgtacttttggggatgaccggcacctcaccaaccgcatgctcagcatgggttatgctaccaagtaagctgaggggaccaggtggtcgggtatgtgtggaggccaatgaatatcctagcgtgtgtgcatgctgagagttctccaaatccaaagtaactcaccagacaatgggctctatcaagtgagactttagaggagagaggaggataccataatgggcagaggggccatttgcattgagccaatggactctaccaagtgagatattagggaagaggggaagatactataagggacaaggctggcatttgcattgaaccatggaatgcggtgaactctaccaagagaggcaaggtgagggtagagaattccacctagaattgagatagggtgagttggttctgtcatggagaccaaggtagcacagtggggagtgaagtaggaagggcaagagacaaatggatagagtgggatctaactagtgagagagccacggagaaagaaacaagtgagagaagaggagcacctgaactctagtaagttcttcaagagaagacaagtaattccatgagactcaggggaggatgatctagaccaagtgaagttcaggggagagtgatttctgcaaagccaggtccactgaaatacccagaggaaacttgggataatccaagggaatccatgcattaattcactcaacaaatattcactaggtgcctagaatgtttaagctgcggggatacagcaataggcagacaggacaccaattgattacatcagttggggagacacacaagaaataaataagtagaacatacagtatgttcatgatatgtgttatggagataaataatgccgggcaagggtggtggataggaagttttggggttgggggtgaagtgttaagtggagtgcctgaggtaggatggggctcaaggctgagaatagtgtggctggagcactgaactgggggagtattaggagagcaggatggagagttaaggagtggtccactcatgaaaggcttataggtctaaggactctgactaagatgagggagccatgggagggttttaagcagagaagtgacacgttgtaatgggatccctctggcagccgttttgggtacagactacaaaaggcaaggtcggaagcagggaggccactgaggatgccaagtgacacaggggaaggagtctggacactgtcaagtaatgcccaggattctagtcttgtgtgggcttggctggaaaccatgcagggattgattaatgatgtctgccacaaaacaggaaggaggcctgatggttcccttgagaagttctaatacatagactaccctgggtagcaaccacacccatcttgctcctccctatagggcctgccagtaatagtaagcatggtagtattagtaatatgttagtgatagtattagtaatagtgtcagtaaccaacatgatattagtaacagcaatagtaatggtaacagcaatagtcatagtaaaaacggtagtagctaacatttattgagcaaatactatctactggtcctaagcacttggcgtttaatttcattcaatccttacagtatccttgtcttatgagagcctttttttttttcttagatagagtcttgctgtgttgctcaggctcaggctggagtgcaggggcacgatcatggctcactgcagcctcaaactcctgagctcaagtgattcccccatctcagcctcccaaatagctgggactacaggccaccacgcccggctaattttttttttttttttttttttttagagatggggtctcactatgttgcctaggctgatctcaaactcttagcctcaagtgatccccctacctcagcctcctaaagtgctgggattacaggcatgagccattgcatcccacccattggtgcttatttatttatttatttatttatttagtagagatggggtcttgctatgttgcccaggctggtcttgaactccttatccctcagcctcccaaagtgctgggattacaggagtgagccaccgcgtccaggcctaggaaccattatccaccctattctacacatgagaacactgaggcctagagaggttaagaaactcgcccccagtggccgtccacagtggtcatttctgcctccagaatcctgcccaggccccagggagcacgcgatgatgccctcattcctcgcccccgtgcaggtacacctccaggtcccgctgctactcagagacgccctcgtccttcctgcggtggctgagccagcagacacgctggtccaagtcgtacttccgtgagtggctgtacaacgcgctctggtggcaccggcaccatgcgtggatgacctacgaggcggtggtctccggcctgttccccttcttcgtggcggccactgtgctgcgtctgttctacgcgggccgcccttgggcgctgctgtgggtgctgctgtgcgtgcagggcgtggcactggccaaggcggccttcgcggcctggctgcggggctgcctgcgcatggtgcttctgtcgctctacgcgcccctctacatgtgtggcctcctgcctgccaagttcctggcgctagtcaccatgaaccagagtggctggggcacctcgggccggcggaagctggccgctaactacgtccctctgctgcccctggcgctctgggcgctgctgctgcttgggggcctggtccgcagcgtagcacacgaggccagggccgactggagcggcccttcccgcgcagccgaggcctaccacttggccgcgggggccggcgcctacgtgggctactgggtggccatgttgacgctgtactgggtgggcgtgcggaggctttgccggcggcggaccgggggctaccgcgtccaggtgtgagtccagccacgcggatgccgcctcaagggtcttcaggggaggccagaggagagctgctgggccccgagccacgaacttgctgggtggttctctgggcctcagtttccctcctctgccaaacgagggggtcagcccaagattcttcagtctggactatattgggactgggacttctgggtctccagggagggtatttattggtcagggtgtgggatctgaggagtggagggaaagggtcctgctttctcctcgttcttatttaatctccatttctactgtgtgatcaggatgtaataaagaattttatttattttcccccagcctccacctttttgagaactaaggggaatggatgattgagaattggggacgctgggctcagtgctgggtgctagccgtttgaacctggacaagacactctccttccttggaacctggggttccctcttttgaaaacagggattattaatcccctggggcagggttggtgtgagggttaaattactcaactcattcacgggtacttaccaagcacctgccacctgccgcacactggcaggtactgcagatggtgcttttgtctctggtccgtctacttagaagggtaacacatcccttttctcctcaaacctccagcacctcctcccctccctcttagctggcttcctatctcactgagaaaataggggttaaaaaagaaaacttctgctggagtccccatctccacgtcttcccactcacttgcccctgtgtccatacactccaccttcttcctgttgctgagggtgacctgtctgtgctccaagccagtgccaacctcttccatcagggcaccagaccctatgtcctctctgtctgctcaaagacttcactccagcagttcttcccacctgatcctccgtcagttctcctttcgcttcggagcctttcccatcagcatctgaacatattgttactctcccacttttaagacccccactcttgacctcagtttccctgtaaacaactgttccatttctatttcggttaatagcaaatttccttgggagagttgtccatatttgtctccaatttatctcgcacagagttcactcactcaaagtgtacaatttggctgagcgcggtggctcacacctgtaatcccagcactttgggaggccgaggcagggagaccacttgaggtcacgagttcgagaccagcgtggccaacatggtgaaaccccatctctactaaaaatacaaaaaaaattagccaggcatggtggcatgtgcctgtaatcccagctactcaggaggctgaggcaggacaatcgcttgaacctgggaggcagaggtttcagtgagctgagatcgtgccactgcattccagcctgggtgacagaatgagactccatctaaaaaaaagaagtgtacaagtcaatggtttttagttaagtttacaggtttgcacagccaccaccataatctaattttagaacattttcatcaccccacaaaaggaaccccatatccattggcagctcacttctcctttctcacccctttatccccctaagacctgggcagctgctcatctgctttctctttatagatttacctattctggctatttcatatcaatgcaatcctgcagtatgtgcttttttttgtgacttccttcatttagcatatcaaggttcatccatgttgttgcatgtatcactgattcattcctttttatggccaaataatagtccacagtatggctatattgcattgtgtttatgtatttatcagttgatggacatttgggatatctccacctcttggctgtatgaatgatgctactatgaacattcgtgtgcaagttttggtgtgggcacagctttttaattttcttgggtatatacttagaaattgaattgctgggtttatgttaattctatgtttaatttttttgaggaactgctagcctgttttgcacagggactgtaccgttttacattcccaccagcaatgtatgagggttctaatttctctacacccttgctacattttgtattacccgactttttgattacagccttcctggcaggtgtgaagtggctttcattgtggttttgatttgcccttctctaatgactaatgatgttgacttccattaactcttaaacccaagccaatcagatggtcatgctttcccctagctctccatagaaactgctcttgtcaagttcatcaatgatatccacgttgctaaaaccaatagccaattctcagccctatttcatgatttggctgtgtctgacacagttgatcactcttccttgaaacgc

SEQ ID NO: 17402 - DNA, 84425 bp, Human
ttagctgctaaggaattttccagcttcaaatttatattttcatggcagatacagaaactgtggagtctctgctgatatgtgccagctggcgaaggaggaagcatgtggcattaccagtgcatcctaggtctccccatgtttacacactatctcctcctccaaatacacacaggggctatcaatatgtttcctgggcaaaaggcaaggcccagacatagagagttgacacattaacgcctcctctctctctgaacccatctgaaggttctgttgggggtagattggggtggtggtgagaagatggtcaaatctgcttgacttggggctggcgactgaagtaggacatgtagcctcttgtcctggctcagccaccactggcttctgtgactttggaaaattcctccttagttctcagcaggttttttgttttttgttttttgtttttgctcagtataagataatggttcagaattcagatcctagaattggatctttcctttgtcatttactaataaagcacttatccactctgaatctcaattcttcatctgtaaaatattattatgcatcttaataatatgaagattaaaaacctagctcaaatgtattccaaatatttaatgaatgttcactgatttttactactactagctctcttattcttttttatttttaattggctcaatttgtgttactttgaagccaaaagcaagccctcccccatatttcaaaagtagtatctgagaccatcctggccaacatagtgaaaccccgtctctactaaaaatacaaaaaattggccaggcgatggtggcgggcgcctgtaatcccagctactctgaggctgaggcaggagaatcacttgaacctgggaggcggaggttgcagtgagccaagatcgagccactgaactccagcctgggcgaaagtgcgagactctgcctcaaaaaaaaaaaaaaaaaaaaaaaaaaaaaaagaaaagaaaagaaaaaagaaaaagaaaagcagtatctcctattaacaaagaaagttgagcaaaaactgacctgggaccgctttaataaatacggactccaggaaggagatactgagaccagagtcggtcccacagtatattcgtatcagatttggggcttagaaacttctaaactctgagcgcccataagcaagatgagattctgccttgtacatggtcgtagctccaggggacagaataacggcttacacataaaagtgacagaatactgaacattagctaacggatgctacgctgcctgaaggtaagtctagtgctatttccaatatctccgagacttggtttttccaccggaaaatggagattaaaaataatgcccataggtatgagctaagaggagtgtaaacaaaacaaaataaaaagcaatgcccagtgattggaggatttgatgagatgatgcccgcgaggtgcttggcacggagtttgacacaagaactcagtgttggtgaatgcacgaatgcaggtacccagcgacagggaggtgctgtgggtggattcaccctggcttcgctgcggctgggagtgggcgctgctagtaagagatctcgcctccaagctccttccgtgggcaggaaaaaacggaagctcccagaaagaggaaagacaggacccgagcggggtttcaggcagatggagcgcgtcggtagcctgtggccagggatcccagcaccgacgggaaagaggaggcctgggtaccctgcgccccgggcgcgcgcggcgcgtgaggtgagggggagggcgcggctccgcaccagccagcggccgcctggcgcccagccgcatctcggggggcggggttgagcctccgggccgcagtgcgattggcggaggcgagtgggtgacgccaacggccggcgcgaggccccgcccccggcttgccccgcccccgcgcgcgccggcggcggggcagcctcgctctggctcgcgccgcgcccccgcgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagagtaagtggagccgggatccttccagcaggcggggactgcggctcccgaggagccccgcgcggcccctgccggcagcgcccaggcctccgagcgggctgccggccctgcgccccgggcctgaggctcctggtccgtggggtcccgttattcaggcgccgcccgcgcgagaggaaggcttgccccgctctcccctccctcacctcatgtttcaccccagccctccccctgcagcccgccctcctccctcgccatcctccttcctcgcggtccctgtctcccttttccctgcatcctccttcccctccatccctccctccctctcttcccttcacccccatttctctcccctcgccccatccttcccccttcctccacccctccctcaccccactctctccatcccgcctctcccccatcccaccctccttccccctctttcacccccaacacccgtccctctccttcatctcgcctctaccccctgcagcccgtcaccctcccccgcacccccatcctcacccccgttaccttcccctcagtcccctctccccttcctcgtctttattccttgagcgcccagactccgctcccttttcctgcagtccctcctcctccccaccctcctgggtgagtcgtgacgagcgagatcctggcctgcgtcctcctcccccgccccgggccgcgccgcggtccctggctgcgagacccacctgggagactaggcgcagtggcttggcctggggaggagacgcctgttttccggaggctgagctctgctgggccggggccacctcactcctccccttcccggggcttggcttccagggcggggacttatcaggatcctgaacccctgaaatcactcgggagatgaggagagcttcggtgtccgccgcccagcgccgcagtctgcaatctccctggttgcggggctctgccctgccgtggccgaacgcttcgggagctcagaccacggtggcagggaggaaatggttgtttatgggtttggatgaaaggcaccacatgaatggatttttaaaagtgggtggcggcgagtggcggccgcagcggagcgagggctgatggtgggtgacatttgcaaaacggcatccacagtgctaaataagattggtgatatgtgtggaaaaacagtgccttgtcaatattttgtccatttctttataacaaaaaaaatgtgtaaggattgctgtggcttttgctatctctttggggattaagtgaagattaaaactgggcttttctctgtaggagaggataagaaaggaaaaagaataaaatggtggaaatctagtttcctttccaatgattctctcctatcgtagcgcgcgctcgctgtggaatgcttttggccatgtagtgttcttgttgggcaccatagctgttttatttcccctctccattcttttcattgatatataggaaatactcctactgaggaatctagttgtaaaaccttatctcacctattacatcagaagaaaattgttataaaaactgaacaccaaatgaaacaaaattttaaaaggtgctcatcgtaacaccttcattgtacccatgcagtacgggttctgatacttgtactcgagatgtttagggctaggaggacccatagggatcctctaatgtcaacatctcattttacccatgaataagaaatggagacttagagcagttaagtgacttgacacaatcagtgttaatttggtgaaacctggtgggcatttccttgcaacattagtaaaaaataactttcttcattattctgtatgtatcttttctttccaatatccttttaaagcgtgaaatatagaatagaatgttacaggttgtattctttaaaatgttacatttgtactttgggaggctgaaatgggaggattgcttaagcccaggaattcaagatcagcctgggtaacatagtgagaccccatctctataaatataaaagtaaaataaaatggtatatttgaacactacacattgaagataaaatcctcaagtgttatagaaatcaagttttgcatcattttgctggaacccttgtttatgcaagtggctccataatccccttcccccacctttaattagaagcaagcataaaggtaaaaaaaaatcaatatgcaagcatggtcagaatttactttctgaaataaagcaaacccattgtacacaaagataacaaagcaattttacataaaattggtgaggatggctaggtgcagtggctcatgcctgtaatctcaggactttgggaggccgaggctggcgggtcacctgaggtcaggagttcgagaccagcctgaccaacatggtgaaaccctgtctctactaaaaataaaaaaaattagctgggtgtggtggtgggtgcctgtaatcccagctactcgggaggctgaaccctcgcttgaacctgggaggcagaggttgcagtgagccgagatcgtgccattgcatgccagcatggcaacagagcaagactccatctcaaaaaaaaaaaaaaaaaagaaaagaaaaaagaaaaaaaaatggtgattatgtgaacagagttctattcctataacaattaggtataaattttagaagaaaaatgttgaaatcctttgtcaatgacgcaggttaattctggcttctaattttggatagggtttctagctttgcccttttctctaaaagaggctgaggcagaagaattgcttgaactgggaggcagaggttgcattgagctgagattgcgccactgcattccagcctgggcgacaagagccaaactctgtctcaaaaaaaaaagaacctaattatacattaaaaacaaaaatgacaatcaagtagagcttatttcagaaacacaatagttcaatattagaatgacattaagaaatgaaaattttaaaactatataatcttctcagtagaaactgaaaaacaagttaatctgcttttaaaaacaaaacaaaaactcctagtaatccagaactaaaaggagtagtttaaatgtccctgtagagaaacctctaacctccccaatcccatcaggcctccctgtaatcacggttccctggactttcctttgtaattcttatcacagttgcaattaataaattatttgtactaattgtaagaccataagttcgctgggggtaagaactagtgtctagcacagtgctgtcacaacaaactctaggaataagtctaataggaagttagcaagaccttcataaatggagaagaatgctatgttgctttatggaagaatatgaaaaaatatcagttcttgctaaattaacctatacatttaataaaattcctacaaaagtcccaacattcatctggaatggtaaaggctaagctaagaggagctaagaaatttttgaaaaaaaaagaaaatgggaattttcacctaccagattcaaaacatactgtaaagctacgattaccaaaacattgtagcactaccagatgagagggaaagtgaaaagatcaatgacatagaacaagaagtctagagtaggtccagataagaatcccatatatggcaaaggtagcattttaagtcagtgaggaaaggaaagaaaactcaacatatgatattcaggcagttggctacattttgatggggaaaataaatttacttctgtacttcacatgttcacaaaaataagtcccatagggattaaataaataaaatgataaaggtagtagataataacagatgtacttttccttatattattgtgcaggagctttctaaacattattagaaaacattaaggaaaagactgacagatatgactatacttctattcagtaaaaacaccaaaaagcaatttgaaagacaaataagcttgaaaagtatctgcagcatataacaaagggccgatatctatttatctatctatctgtagagagcttccttaaattgtttttaaaaaaaactaaataaaaaatagacaaaagacatctattagttatctattgttgcataacaaattacaccaaaacttagcagcttaaaacaatgaacatttattgtctcagacatcctgagggtcagggtctgggaggggagcagcctggctgggaggttgtggctcagggcccctcaggaggttacatcaatgggctgtagctatctcaagaccagaccagagctgaagaatccacctccaatggcactcctgttgttagtgggcctcagttatccagcaggctgttggccggatacctcagttctttgccacaggggcttcgcctgggaagccagccggcttcctccagagccagcgacccaaaagagatggagacctggagaccgcagtctctataacctaatttagaagggccatcatcacttttaccatatcctatccatcacacagaccaatgctggcacaaagtgggaggggactacacaagcgtgtgaataccaggaaccagggaccactggaggccatcctgggggctctcttaccccagaatgaaaacaagagctccagaactgggctaggacacagtagaaaagcggggaggagagcaagcccagcaaccagatgccttcactttacacacttctgtatttgattttcttctttaaaatgtatagtgtgctctacttttataatttaaaaaataaaggttttaaaaatatttttattaacaggaaaacagagaatgcctctctggttctgtctgggtatcaccaagttccccagattgtgccaggctctaagtcataataagaatgaccacctactgagaacctatgatgtgccaggcactgtcctagtcacttaaatatactattcctttttttttttttttttttttttttgagacagagtcttactctgttgcccaggctggagtgcagtggtgcgatctcggctgattgcaacctccgcctactgggttcaagcaattctcctgcctcagcctcatgagtagctgggactataggcgcacgctgccacgcccggctaattttttgtattttagtagaggcggggtttcaccttgttgaccagactggtcttgaactcctgagctcaggcagtccggccttccaaagtgttgggattacaggcgtgagccactgcgcccagccaaatatactattcttaacgctaaatgtcctaagtagatataactgtccccattttagagatgaggaaattcaggtacagataaagtcacttaacagtgcacacaagtagtaaggctggaattcaaactcgggcttctctggctccaaaaggctgagctcttcattagaccagtccccttgcccctcgatgccctgtgtaacccactagaagagtgggtaggaggaaagccatcaatcccggagcaccagggagacacacaaaaggcccagactccgggactgaagaactgctgctgacaaaaatagttataaacattcctgtccatttgggatcattgtgggttggtattagaacaagctggacatcctaatgttccaggcaagcagaagctctctgcttcagaccgtatactttctaataatgtaactagccaaagctagtcataaaaattctgaatcactggtcaagaaacacattttctcatcatcccctctatagccacccctccaacattttcccctgatgattgaattctaaggttccctcacccctgcttttctctgccaggggatgaagtgagtagaaggaggctttgtctaaggactgtgaactcctcttaccctctcactgcactcagcagcccgagaggtgagttcaggcatcatccacttagctcttctagggccaaattataagtggaaagcaggagagatcagaggtgtcagactcagtctatgaaagacagatactcctctttttcctcaacctccctcactaatccccacccccccgaataaatacactgacaaagcgttgaaagttgcactttccaagtcaattcagtctctcttatgaagtggcttcagtatttatcaggttatagattatgatcaattggtctgaactttgaatctaaatctaaaaattattgctttgcttcgagtaaaactgtaataataaaaactaaatctattgatcacttattaggtgccagacactgtcctaggcatgtcgtatgttgtcatttaatcctcaaaaagatcccatgagttactctcattagtcttcttttactctaaggaaacagaggctgagagagtttaggataattccacaaggttatcaatttgtcgttataatgtttgtatgtatgtatgtattattttgagacagagtcttgctctgtctcccaggctggagtgcagtggcactatcttggctcactgcaatctccgcctcccgggttcaagtgattcttctgcctctgcctcccgagtagctgggattacaggcgtgtgccaccacggctggctaatttttgtatatatatatgtattttagacggggttttgccatgttggcgaggctggtcttgaactcctgacctcaaatgatccacccaccttggcctcccaaagcgctggaattacagacgtgagccaccgccccagcactgttgttataatgttttagtaactaacatttacatcacatcaacaagtgctaaacactaaactaagtgctttgtgtatgctaacttgttgaatgtctatagttaccctgtaagagaggtgtattccctgcgctttatggatgagaacattgaagtcaggtgaggaatgtgcgctaggtcccataggtgagaagaggcagatgcaggatttggaccctggtagtttggctgcagcatcagtcttaatctcaacacctgtcttctcagatttggattctggctcacaggctgcagagcctgtacttcttttttttttctttttcccagagacaggtttctgttgcccaggctggagcacagcggcgcaatcatagctcactgcaacctcaacctcctgggctcaagcaatcctcttgtctcagcatcccaagtagctgggactacaggcatgcaccaccatgctcagttaattaaaaaaaaatttttttttcttcaagacgaaacctcgctctgtcaccaggctagagtgcagtggtgcgatcttggctcactgcaacctccgcctcccgggttcaagcaattctcttgcctcagcctcatgagtagctgggactacaggcatgtgccactacgcccagctaattttttgtatttttagtagagatggggtttcaccatattggtcaggatgatcttgatctcttgaccttgtgatccacctgccttggcctccaaaagtgctgggattacaggcgtgagccaccgcacctggccaatttttagaaaaatttttagtagagatgaggactcactatgttgcccaggcttgtcttgaactcctgagctcaagtgaccctcccgtctcagcctcccaaagtgctaagattacctagagcctgtattcttaacctctcttccttggtttttgatacttgaaaatcttttttccctaaatttttccaaaaatgtacaggatccaagtggcagacaggtcctccggattctattccgggttctgcccctgactcatgggtgacactgggtaagtcacaactctgccaacaagacactgaaacttgcactttccctctactaattatttaatgtactgcaaatcctgcttgaccttaagtacaggagaaatttgacttgtaaaaagagataacttaggccaggcacagtggctcacgcctataattccagcactttgggaggccaaggtgggagattcacttgagcccaggagttcaaaaccagcctgggcaatatagtgagacctcgtctctacaaaaaatttagaaattagccggccgggtgcggtggctcacgcctgtaatcccagcactttgggaggctgaggagggtggatcacctgaggtcaggagttgagaacagcctggctgacatggtgaaaccccgtctctactaataatacaaaaattagctgggtgtggtggcacacatctgtaattccagctacttgggaggctgaggcaggagaattgcttgaacccgggaggcagaggttgcagtgagctgagatggtaccactgcactccagcctgggcaacagagtgagactctgtctcaaaaaaaaaaaaaaaaatttaaccaggcatagtgtccccgatctgtagtcccagctactcaggaggattgcttgagcccaggaagtcaaggctgcagtgagccaagatcatcctactgcactccagcctgggagacagagtgagactctgtttcaaaacaaacaaacaaaaaaaaggtaactttaggctgggcgtggtggctcatgcctgtaatcccaggactttgggaggccgaggcaggtggatcacctgaggtcaggagttcgagaccagcctggccgacatggtgaaaccctgtctctactaataatactaaaattagccaggcatggtggcacacacctgtaatcccagctactcaggaggttgaggcaggagaattgcttgaacccaggagggggagattgcagtgagcagagatcatgccattgcactctagcctgggtgacaagagagaaactccatctcaaaaaaaaaaaaaaaaaagaggtaactatttggcagtgcctcaaaaagttacacatagagggacaggcactgtggcccacacctgtaatcccagcactttgggaggccgaagcgggcaaatcacgtgaggtcaggagtttgagaccagcctgaccaacatggcgaaaccctatctctactaaaaatacaatatattagccgggcatggtggtgcatgcctgtaatctcagttacttgggaggctgaggcaggagaatcgcttgaacctgggagttggaggttgcagtgagcagagattgtgccattgcactccagcctgggcaacaagagcgaaactccatctcaaaaaaaaaaaaaaaaaaaaaaaaagttacacatagagttaccatctgactcagcaataccactccagtgtatataatcaaaagaaatgacagtatacatccacaccaaactcatatacaaatgtcgcagcagcattattcataacagccaaacaactcaaatgcctatcaagtgattagtagatgagcaaaatgtggcctattcatacgatgaaatattactcagccaaaagaaggaatgaagcactgacataggcatgaagcactcacataggctacaacacagatgaaccttgaaaacacgatgatggccgggcgcggtggctcctgcctgtaatccgagcactttgggaggccaaggcaggtggatcacctgaggtcaggagttctcgaccagcctggccaacatggtgaaaccctgtctctactgaaaatacaaaacttagctgggcgcagtggtgggtgcctgtaatcccagctactcaggaggctgaggcaggagaattgcttgaacccaggaggtggagattgcagtgagccaaggttgtgcaattgcactccagcctgggtgacaagagcaagacttggtctcagaaaaaaaaagaaagaaagaaagaaaacatgacactaagtgaaagaagccagatacaaaggccacatagtggatgctcccatttatatgaagtgttcagagttggcaaacccaaagacagaaggtagattagtggttgccaggggctgggggagggcagaatggggagggatcgctagcaggtacggggcttcttgtcgggtgatgaaagtgttctgaccagctacagggagccaagatcatgccactgcactccatcctgagtgacagagcgagaccctgtctcaaaaaagtaaataacgtaaaatggcaaagcttatgtgaattacatctgaatagtaagctttcagatgtttaaaaaaaaaaagagagagcaagctaacttgaaaggtaagctattagcccagttgacacatttgtcctgaacttttccctgtagtatcgcttaaatgcacatcatcaaggaagtccttttaaaagagtgtcagttggaaacatttacattgagacagaggacttcaatatttaattgcatggcctgggtctccagggaggaggttgcttaaatatgagcatttgttttacttcaaagttaaatacaattctgtgggtgacctgtccatgtcacagtttctccatgcaactgagacagtttagggggaaagaaatcatccctatctgataacagatttactaggattttttttttttttttttgagacagagtctcactctgtcacctagactggagtacagtggcacagttatggctcactgcagcctcaacctcctaggctcaggtgatcctcccatttcagcctctcaagcagctgggacaataggcacacaccaccacatctggcaatttttgtattttttttagagatgggttctcgctgtgttgcccaggctagtctcaaactcctgggctcaagggatcctcctgcctcagcctcccaaattgctgggattacaggtgtgagacactatgcttggcctattatcttaagaaaatatcctaaatgtggttttggaagaaaaaagaaaacaattttcctaggaacaatgtaggaaggtagaataggtataaaagcaaaggtgaggctgagtgcggtggctcatgcttataatccgagcactttgggaggctgagacaggctgatcatctgaggtcaggagatggagaccatccgggccaccatggtgaaactctgtctctactaaaaatacaaaaattagctgggcatggtggcacgtggctgtagtcccagctactcgggaggctgaggtaggagagtcacttgaagccgggaggcagaggttgcatggagtcaagattgcaccactgcagtccagcctgagtgacagagcaagactgtctcaaaaacaaaacaaaacaacaacaaacaaaaaactaaactaaaggcaaaagtgactttaaaatacaaaatactcatccaaacagatgttgctgttacacaggagtaaaaccttggtgacttgggttgtgccagcattgctttcttggctgctgagttatgggaatagccaacaggtcccaggaaaaaggaccccacagcagggagatgaggggctcaaggcagcaactacataccaacccgtatggaagacttccactattttagtatcagccaaactgatgtgtaccatcaggatatcaactttgggttcaagaatacataatgttgagaaatttgggaaagacctgtaacagtctgggacctgagaagatgccatacatatgcaatttaattccacagagctatttgttgcctgcctgccatctataactattctaggcactatggggaatggcaaaagaaagaggacacagtccctgccttcaaagaacttatgacgtattatttaacaaggaagcaaaacttttgaccaggtgtggtagctcacgcctgtaatcccagcactttgggaggccagtgtgggcgactgttttgagtctaggagtttgagaccagcctgggcaacatggcaaaaccccatctgtacggaaaaaaaaaaaataatatatatatatatatatatatatatatatatatatatatatatatattagccaggcatgttggtgcacacctgtggtcccagctacttgggaggctgaggtgggaggattgcttgagcctgggaagtggaggttgcttgagcctaggttgtgccactgtactccagcctgggcgacagagcaagacgctgtcacacacacacgcgtgcacacacacacacacacaaacttttaacaaataactataacaggccgggcatggtggctcatgcttgtaatcccagtactttgggaggccaaggcgagtggatcacttgaggtcaggagttcaagaccagcctggccaacatggcaaaaccccatctctactaaaaatacaaaaatttgcagggcatggtggcacatgcctgtaatcccagctacttgggtggctgagacacgagaattgcttgaacccgggaggcagaggttgcagtgagctgagatcgcaccactgcactctagcctgggcaacagagcaagactttgtctcaaaaaaacacaaaaaccaaaaaaaacccctataacctaatgcagaatgcagaaagtgccataataaagaactgaggccgggtgcagtggctcacatctgtaatcccagcactttgggaggcggatgcgggcagatcacgaggtcaggagattgagaccatcctggctaacacggtgaaaccccgtctctactaaaaatacaaaacaaaattagccaggcgtggtcgtgggcacctgtagtcccagctacttgggaggctgaggcaggagaatggcgggaacccgggaggcagagcttgcagtgagtcgagatcacgccactgcactccagcctgggcagcgagcgagactccgcctcaacaataacaacaacaacaaaaaaaaactgaatggcgtctaaagagtgaaaggagaaatttatttgatttgatttgatattttttttgagacagagtcttgctctatcacccaggctggagtgcagtagcatgatctcggctcactgcaacctccgcctcccaggttcaagcaattcttctgcctcagcctcccgagtacctgggattacaggcacgtgtcaccatgcccggcttatttttgtatttttagtagagacagggtttccccatgttggccaggctggactcaaactcctgacctcagatgatccgcctgcctcggcctcccgaagtgctgggattacaggcgtgagccactgcagctggcctaaaggagaaatttctattccagataggaaagagaaaaatatcttgttgggaaaaacagtattaaccagatcttgaagaatggggacattcccaggatgagcaagctatattagaatccttttaaaaaatagaagttctaaaagtatgacacttttaattaataaactggaaacgaagacacaatcggaccactcaacaatagtgatttttaaattttaaatgaattatctaaaaagacataggccagacacggtggctcacacctgtaatctcagcactttgggaggctgaggtgggcagatcacgaggtcaggagtttgagaccagcctgaccaacatggtgaaaccccgtctctattaaaaatacaaaaattagcccgacatggtggtgagcgcctgtaatcccagctactcgggaggctgaggcaggagaatcgcttgaacctgggaggcggaggttgcagtgggctgagatcgcgccactacactccagcctgggtgacagagcgagattctgtctcaaaaaaacaaaccaaccaaccaaaacaaacaaacaaaaaaatatacattctacaactgtagttgtgatcccctttctcattctatcctgtttgtgtattattttcatggaaatacttgctggaaacttacttattttactttcctttaaaaaaaaatcacttttttattttttgagacagagcctcgctctgtctcccaggctagaatgcaatggcacagtcttggctcactgcaaccgctgcctcccaggttcaagcgattctcctgcttcagcctcccaagcagctgggactataggcacgtgccacgacacccggctaattttttgtatttttagtagagatggggtttcatcatgttagccaggatagtctcgatctcctgacctcgtgatccgcctgcctcagcttcccaaagtgctgggattacaaacattagccaccgcaccccaccaaaatcagtttcttctatattgtgtgtagctattctaatttattgaataaaatgctgggataatttattaatttttctttgttttctactaaaagcatctaaggatatgaattttcatctgagtacagctttggttgaatcccataggtttttttcccctgctccatagtttttatttttatttttatttatttatttttcagacagagtctctctctgttgcccaggttggagtgcagtggcatgatcttagctcactgcaaatccatcttccgggttcaagcaattcttttgcctcagcctcccgagtagctgggattgcaggcatgcaccaccatgcctggctaacttttatatttttagtagagacggggtttcaccatgttggtcaggctagtctcgaactcctgacctcaagtgatccacccgcctcggtctcccaaagtgctgggattacaggtgtgagccgctgcgctcagtcctgcttcatagtttttaatatccaatatttttgccatttctttttttaaaaaattattattttgttattttagagacaaggtctcagtctgtcacccaggctggagtacagtggcatgatccatagctcactgcagccttgaccttctgggctcaagccccctgagtagctgggactatatttgtgtgccaccgtgcctggctattgccatttacttctaaatatagtcctttgttttgaagtggatgtcactctcataactggtgataagtagtttaaattgtggcaaaatttccctaagaggtggtttgggactcaggcatcatcatcaaatgtaagagagcacgtatctgcctctagtatccaagaagggcttattgaacgtgcagtgaaaggttttccctctggcttttttggcgcacagcacctctgagacaaacaggtgcttgaaagctaatgaaatatctttagtggagtggtcaggccaaattttatagttatcactggcaatgtaacagccataaattttgagtcctggtcctgtgctcgcctgtacaggaagtgctttgggaatccccagtatgatcctctttaattgcctcaattagttgcttctctgcgaggctgttgcaagagctaaagttagagtgaggtgactgagactctgttttcctttcagcaagtatgaggtttacttacctttttccatgtcttttttcttttttatttgttttggagggaggggtggtggtgggagatagggtctggctctgtctcccaggctggagtagagtggcacaatcacagctcactgcagctttgatctcctgggctcaagcgattccagctgggactacaggtgtgtgcaaccacacctggctgatttttgtattttctgtagagaaaatacatgttgtccaggctggttttggactcttgggctcaagcagtctacccaccttggcttcccaaagtgctgagatcacaggcatgagagccaccgtgcctgaccttttttggttttttgtttgtttgtttgtttttgtttttttgtttgtttttttttgagatggagtctcactctgttgctcaggctggagtgcagtagcataaccttggctcactgcagcctcaacctcccaggctcaagccatgctcccacctcagcctcccaagtagttgggactacaggcatgcatcaccatgcctggcagatttttcttttcttttcttttcttttttttttgtatttgtgtattttttgtatagatggggtttcaccatgtcacccaggatgatcttgaacttccaagctcaagcagcattcccacctcagcctctcaaagtgctgggattataggcacgtgccacagcacctgccctgatctttaacttttttcttttcaacatccacccatctctatctgtcactttattttatttatttatttttttcttgtgagatagagtcttgctctgtcacccaggctgcaatgcagtggagcaatcctggctcactgtaacctccgcctttggggtcggggtgcaagtgattttcctgcctcagccttctgagtagctgggattacaggtgcctgccacctagtatccaaaaagggcttattgaacgtgcagtgaaacgcctggctaattttcgtattttcagtcacgacgggatttcactatgttggccaggctggtctcaaactcctgatctcatatggtcctcccgctttggccccccaaagtgctgggattataggtgttagccactacacccaacctctacctttcactgatgtctactaattatttagtctacgagcaaaccttattggaagtgaatgagatattaagtatttattacagtaggaaaacctgttttattcttggaaagaaaaaaatttagagggagataaagaaaagtggagaaaaacaaacaaaattaaaaaaaaatctttggagcctggatgtgtgaattcaaattcatgcagatttgaatctgagtctccagtagccaccccttatttggtgtccttctgagatgttagagaactccaggaccataaattatagtctgtgttcatttcagcatggctcagcagggtctgggaccaagtgttttcattcatccaaccaatatttgcgctgtctctacatgccaggagctgtgctgcatgggcagcagagatagtagtgtgtaagtagaccgggtccttgtgggatttagacagacagtggtgacgcagcaggaatgtgccctgacagggcaatataggtaatgctgaagcatgtgggaagcccccaggaaggcctgggcatgagcggggcagagtgagacctgcaggatgaggaattagccaggcaggagatggggtccgtggggcctgggggagaggaaggtctaagcttggcaagaaaatgagaaaggctgtggctggctggagctgtggggagtgtgtggagagcagtcggagagttgccagggcctgcttagccttggtaaggtcgtttatctctctattccagcagctgtgggaagctactgaaggttttgagttggggagaggcatggttagaattgagttcaaaatgctatctggttgctgtgtggagagtgggcgggaggcagtgggagggaagaggctgtggtgctggtcctagctggggatgtgatggcgaggatggtgatttatgccagggagagagcagcagtgttgggagggggaccccaacttgaaggcatcttaggatgcagaagggtcaggtcatggtgatggctgtgcaggaagaggagaggaagagtcagaaatgaatcccagttttctggctcgggcggccagttggaaggtcatgctgtgcattgagagatgaaaggcggagaagagacaggtttgtgggggaagatgaggttttgtaggcacaggcttcaggtcctgtggaccacctgcgggggatgctaatgggagcaggcagacatgcttgagattggcagtcacccggtgccagagtgtgggcaggtcagatgcacaggagagtgggagaagagggctgggatctcaccccgtgggacactggcatttacaggacaggcccagggagagcagccagcaggcctgagtgtcggaggggaaaggtgaggctcacagcagtgtcttatgattttgtgactcatgggacccaacctcaaactgagccagtgcaagctgagccagccaccaggaggctccagtttaggaacagcccccactctctaggctgggaggcttggccgctggaaacttctcaggagtttgcctgtctgtggtgttgcccctgtgttttagacaacacttgcctgtgttaacttccttgctcaggattgttttaaggaggaaatgaggaaatggttatagttagtcgacgtgcaaaactctgagcatttgggctttatgctgtgttaaaatggcatcagattggctgagtgtggtggcttatgcctgtaatcccagcacattgggaggccgaggtgggtggatcgcttgagcccaggagttcaagaccagcctgagcaatgtggcgagaccctgtctctaccaataaataaataaataaataaagtacgaaaactagccagacatggtggcacacgcctgtagtcccagctactcaggaggctaaactgggaggatcacttgagccaaggaggtcaaggttgcagtgagccatgacacaccactgcactccatcttggggtgcagagcaagaccctgtctgctgtggttttgttctgtgtccccacccaaatctcatcttgaattgtaatccgcctaatccctacatgtcaaggacaagaccaggtagaggtaattgaatcatgggggcagtttccctcatactattctcagataatgaatgagtccaaaggttttataagcgtcttgcatttttcctgctggcactcattctctctcctgctgccctgtgaagaggtgtcttctgccacgattgtaagtttcctgaggcctccccagccatgcggaactgtgagtcaatgaaacctcttttctttgtcagttacccagtctcaggtatttcttcatagcagcatgagaatggactcatacatcatttcaaaaaaaaaaaaagatggcatcaaattgtagaatcttggctctggaaaggatcttagaagaatctagtccagaccgtgacccagagtaggaagtcagattgtgctagtctattagcttgatcacattggccaatttttttcttctctgtggctgctggggatacagtattatcttcatgttccacaccagtgtagagtcacaatggcaagtataaaccatgaagagtgtgtggaggcagaaaggctgtggctctggactctagttggttctaatccagtcgcagttgagcctcgtgagcctcctttatggcagtaggaacaaagctgcttcattttggcagtgaagggaggaaaaaggaagaaaatttaggcttaaactgtttttggagcccccatactgggtacgacaaggtgaaccaaaccccacttatctcttctgtcagtttcttctgagcattggtgtggtcaggatagcattggagaggagccccctgcccagtctctggacacattggtattgatggttctatttgctaaggacttgaagaaaacaaaacactggtggtaagcaagagtcacccttcgctctgggagaatttcacactacaggctttaaacaatagactacagtgaggcatagcccttaaaaatcacttaatctgcagacctccttgtattgggggtcaaagtgctgcttcaggattttaggatgaggctattacttgactactcagaatgtttttcagtttgctttcccttagataatcttagggtggattaccctggggggtgactctggctcattcctcaataatcactaattgactagcaagaagatcccttaaaaaaagtcacgaggccaggtgcggtggctcacacctgtaatcccagtgctttgggaggccaaagtgggctgatcatctgaggccaggagttcaagaccagcctggtcaacatgttgaaaccctgtctctactaaaaatacaaaaaattagctgggtgtggtggtgggcacctgtaatcccagctactcgggaggctgaggcgtgaaaatagcttgaacccaggaggcagaggttgcagtgagctgagatcacaacactgcactccagcttgggcaacagagtgagaccctgtctcaatacaaaaacaaaaacaaactgattgggagctctcaccctgtggatgggcctgacctggataggctgtttgttggggaactcccggtgtcagcatatttagatttttcttcttggtctctgattccccagaaaggtcttcttttgtctgctgtctgggagataaaggtctggctaccagaattctgggaactgactggatgagatgagctgacagtgggttctcaacaagctttatgcccctcttattcttttttttttttttttttttgagacagagtcttgatctgttgcccaggctggagcacagtagcatgatctcaactcactgcaagctccgcctcccaggttcacgccattctcctgcctcagcctcccgactagctgggactacaggcgcccaccaccatgcccagctaattcttttgtatttttagtagagacagggtttcactgtgttagccaggttggtctcgatctcctgacctcgtgatccgcccgcctaggcttcccaaagtgctgggattacaggcttgagccactgcgcccagccacccctcctattcttttaagttccagaggcagctggtgctgccagttcctgaaacttttgaggattctgctgtgtacatttggttggttttcactgctccctaccaccagataaggattccgctttcatgggcctactaagtcagttacaacgcatctattgtagaaaataaggcgacagactcagaatgtaaaaacacaactttatcatttgtaataactgcattccaggaaggaaggaggggagtagccaccagccagagactggggaccaccacgcccgagtttctttcttttttgagacggagtttcgttcttgttgcccatgctggagtgcaatggtgcagtcttggctcactgcaacctccgccttccgggttcaagcgattctcctgcctcagcctcgtgagtagctgggattacaggcataagccaccatgcatggctaatttttgtatttttagtagagacggggtttctccatgttggtcaggctagtcttgaactctcgacctcaggtgatctgcctgccttggcctcccaaagtgctgggattacaggcatgagccactgcgcccagccctgagtttcttaacacagcagagcctctggctcttttggccacttgtttttctttctcactgagaggaaatagagtctcctaagagaaagagttttggaacaccacaaatccaggaatttaatactgaactagccctcagctcactttgaagcaggaaatcaggtgaggctaaggtcatgccttctgactggataaaccctcccggacccaggagacatcctcacctgcccggaccccgggaggcatcctgacccttgcggaccccaggaggcatcctcaccctcctggaccccaggaggcatccttaccctcggggaccccgggaggcatcctcaccggagcaatctttggtatagaacttttaactaaattacacagtgtggagagacaagcttcagtcatttctccactacccactcagtgcctggcggaaggcaggcagcacagaccttcatcccaacgcacgaggggaatattcaaatcatgccttaggggcacagggaagggagtcagagactgccccgcctgtgattttgatacaagtagacagatgatctgagagaacagcctctggtctagatgatttcagtggaaaagaagaagaaagatccatgtggaaactttgtaaacgttttatgacgggaaaagacaagtgtagcatttaggtaaagaagaccagcacagagaaaaccatttatcattctaacataaaatgatcaaccaagagctcaaatgtgatgtaatgtgagataacagaatgaggtggaaaatgggctagcaggggaattcaaaaacagcaaatcatggcattgcagaatgaataaaccaattttacaccataagaagcagaatcttcgctataaaatatggaaattgcttgagaaatcacgcagcctgcatattcatgagcattagtgctccccgtgtttcttttggatttttcgcgtcttctcttcctggagctccacctccttcccgtgctcgatctttggccccaaccccaaaaggatgttttcttttcctggtatcttactgtagccagttccacaggttggggaaaggaagccctcttaacactggccctttgtgtgtgtggatgggtgggtggggcatttcctgccttctggaagcttccctggggcttttgtcttatgtgggtttgacatcaatagcatggctgaattgagggttccagagggagcgtgagcttatggccttgtcatgttgtgtgggactaaacatttcctaatatctcagatctgtagacctgaagcaggctaaatcttagagcagaacagattgggctggtcagaatcttggacttgaaaataagacagagctgaacttggtgacatgcacctgtagtcccagctactcaggaggctgaagcaggaggattgcttgagcccaggtatttgaggccagcctgggcaacatggtgagactcatttcaaaaaagaaaagaataggatgactgtcaccaccatggtcatggataaatcatgtgatctctcctggattcagtttctttataagatagactgcatcagaatttctcagtgttggcactattgacattttgggccagatgagcttgtgccttgtgggatgtttagcagcattcctgacctctacttgtagattcccatatcatcccctagtcgtgacaataaaaaatgtatccagacaatgctgaccttcctcttgggggcgcaaaatcactccctgttgagaaccactggactaggtgatctttttttttttttttttttgagatggagttctgctctagttgcccaggcaggctggagtgcaatggcgtgacctcagctcactgcaacctccacctccctggttcaagcgattcttctgcctcagccttctgagcagctgagattacaggcaaatactaccatgcccggctaattttttgtatttttagtagagacagggtttcaccatgttggccaggctggtctcgaactcctgacctcaggtgatccacccacctcagcctcccaaagtgctgcgattacaggcgtgagccactgtgcccggccccactggactaggtgatcttatgtctcctgtctgctgctgggtttctgggattgtatgaaacactccattcttttcctctctctttagttttagactcatctttaagtccttagggaaactcccattcaagccaagagatgtgatttggagccattaaatgctgcatctaccaatttaagatgctagccacatcttgggttcctgccaagatcaagatacatattctgggtttctgcagttgaaggaggaattcctgcagccatcgcagagtctgtagtaggagcacaagcttttttcggagacacagatgtggctgggcgggtggctcatgcctgtagtcccagtactttgggaggccgaggcgggtggatcacctgaggtcaggagtttgagaccagtatgaccaatatggtgaaactccgtctctactaaagatacagaaattagctgggcatggtggcaggcgcctgtaatcccagttacttgggaggctgagacaggagaattgcttgaacctgggaggcggaggttacagtgagccgagatggtgccactgcactccagcctgggcgacagagtgagactccgtctcaaaacaaacaaacaaacaaacaaacaaacaataaaacagacacagatacaggttgacaggccaagtgggcattaacagatgaggactgctgctgttggtaatgtataagggcaatgtcttttctatctttttttttcctggtcagctgtagtcatgtatctttttttttttttttttttttttttttggagatgaagtctcactctgttgcccaggctggagtgcaatggcacgatctcggctcactgcaacctccgcctcctgggttaaagtgattctcctgtctcagcctccccattagctagggctacaggcgtgcatcaccacacccagctaattttttgtatttttagtagagatggggtttcaccatgttggccaggctgttcttgaactcctgacctcaagtgatctgcccgctttggcctcccaaagtgctgggattacagacgtgagccaccgtgcctggcccaggcttcccaaataactgaatgctggtatcactgtggtgtataaaaatggtcctcattttccagtcctttcttttaaagatgtccttatgtagcagagctttatgtggtgagagtagtgtttgctcccctggaaggttactatttcacaatttttgtctttctttggtatttttgcttcaaaatatcaacataactcaatagtgttgatgacaataagctgttgattttaagaagatatgaattattggatttccacttttgattgatttttccatttgtgtgtattttgtaacgtcacagctccttttatccaaggaacgttgtttcaggcaacataaggaagaaataatttccctttagaactgaggggaggtgactgctgcctctaacatatacttaggaactcctatttttcatctccactagccctggtttgagattttttttttttggagatggagtttcgctcttgttgcccaggctagagtgcagtggtgtgatctcgcctcactgcaacctccgcagttcaggtgattctcccgggttcaggtgaacctgaacctgaacttctcccgcagttcaggtgaacctcccgggttcaggtgattctcctgcctcagcctcccaagtagctgggattacaggcatgagctaccatgcctggctaattttgtatttttttagtagaaacggagttttaccatattggtcaggctggtctcaagctcctgacctcgggtgatctacccacctcggcctcctaaagtgcagggattacaggtgtgagccactgcgcctggctgaagttatttttatttatttatttatttattttttgagacagagtttcactcttgttacccaggctgtagtgcaatggcatgatctcggctcaccgcaacctccacctcccgggttcaagtgattctcctgcctcagcctcccgagtagctgggattacaggcacccaccaccacgctcagctaattttttgtatttttagtagagatggggtttctccatgttggtcaggctggtcttgaactcccgaccttaggtgatccacccgcctccacctcccagagtgctgggattacaggcatgagccaccgcgcccggccatggctgagatttttttttactaatcactttgaaggttcatgagtctttgcttagagattttctggctccttcactttttggctccaaaccttataaaacagggatataaaataaaaaatgggagtctctcttgaaagagaaagtaaatagtcatttctgtaaccctacccagtatctttatggacccgaggttaggatttggtttctcggatactaggcatttatcatcaggcactctctcggatattggcagtaacccaggttttgtatgttacagcgttggacatttgagtcttatgcaatctttgggtgtgctcagtaggccgatgtaatcaaatcattgttaacccatctctacacgttttaaagcttgtgacaactccaaacaattagccctcacccttttttctcactacccattacccaaaaatcaaacctaaatagagatgttctcagattataaccaggctaattagttgtcattcaacagttacagggagtgatacccagtgcttgccctgtggctgacaatttgagatctctattttggtctctcccacttcccacaaatacaatttagatataaaattatagtaaattattctagataactaatagttgatagagttactgtcttcaaatgaaggcactatggaacagttttatattaagcataactgcatttgttttgtttttgtttttaaaaattttttctagagacagggtcttgctttgttgcccaggctggtctctaactcctggcttcaagcgatcccactttggcctcctaaagtgttgggattacagccattgtgcccagccagttttttgagtttgaattttaattttttatctaaaattctctaatgattttagaaacagctttattgggatataattcacataccataccattcacccatttaaagtgtataattcaatggcttttagtctattcatagaacagtgtgtccatcatcacaatcaattttagaacactttcaattaccccagaaggaaactccatattccttatatgtaacccctaaaccccccatctctcctgctgtaggcaactactaatctcctttcaatttgtatggctgtacctgttctggacattgcatctaaatggcgttacataatatgtggtcctttatgactgcctgcctttttttgagacggagtctctctctgtcgcccaggctggagtgcagtggtgcaatctcagctcactgcaagctccgcctctcaggttcacaccattctcctacctcagcctcctgagtagctgggactacaggcgcccgccaccacgcctggctactttttgtatttttagtggagatggggtttcactgcattagccaggatggtctcgatgtcctgacctcatgatccgcccaccttggcctcccaaagtgctggtattacaggcgtgagccaccgcgcacagccatgactgccttcatttacttagtgtgttttaaaggttctttggtcttacaacatttattgtacttcactcctttttaatgactgaataatactccattgtgtggatatactgcacttacccattcacccgtcagtgggtgtttgagttgtttccactttttggttattatgaataatgctgctagaaacattcatgtacaagtgtttgtgtagacatatgttatttatttatttttaaaatttatttattattattttttgagacagggtctcactctgttgcccaggctggagtgcagtggcactatgtcagctcattgcaacctctgccctctgggttcaagcaattctcttgcctcaggctcccgagtagctgggattacaggtgcctgccaccatgcctggctaatgtttgtattttaagtagagacagggtttcaccatgttggccaggccgatcttgaactcttgatcttaggtgacccacctgcctcagcctcccaaagtgatgggattacaggcatgagccaccacgcccagccaacatacgttttaatgtctttaggatatatacctaggaatggagttgctggatctctatgtttggttatttgaggagctgccggcctgttttccacatcagctgtaccattttacattctcaccagcagtgcatgacggtccagtgcctttttatcttactgcgcttaaggtgtaattccttctttctcagactggactgtaaattctttgaggtaaatacattgatttatatgttgcttgtatcctctattgccttcaagtggttatgtgcattttattgtgcaattgctagatactttgtttctctcagcgtcagtgttttactttgtaaaatgagggtgctataattcttgacctctgagggctactgggagctttaaatgagatgatatatgtaaaacacatgaggaactctctcacatgtagtcaaccttcaatatgtttcagatattgctattattatgggcattttttttgttattgagagtaaattaacgattgagttttttctttattttgaggagtcttgctttgttgcccagattggagtgcagtggtgcaatcttggcttgctgcaacctccgcctcccaagttcaagcaattttcctgcctcagcctccctagtagctgggattacaggcacctgccaccaaacccagctaatttttgtatttttagtagatatggggtttcaccatgttggccaggatggtctcaagctcctggcctcaagtgacctgcccgcctcagtctcccaaagtactgggattatagatgtgagccactgtgcccggctgactttttcttttttttcttttttctttttttttgtttttgttttttttgagacggagtctcactctgtcatccaggctggagtgcagtggcacgaccttggcttactgcaacctccgcctcccgggttcaagtgattctcctgcctcagcctcccgagtagctgggactacaggctcacaccaccatgcctggctaatttttgtatttttagtaaagggtttcaccacgctggccaggctggtctcgaactccagaccttgtgatctgcccgcctcggcctcccaaagtgctgggattacaggcgtgagccactgtgcccgccaagttttttctttataagagctttgaaaaaattttggctaaggttgtaatatctcaatcagacactggttaaaaaattagcagtaggggaattatcagatggtggaccttcttccaagcccccagcaagttcattaaactgttaaatttcctttgggcactgatcactctccgaggcgatggtgtttatttctttgtgtttataggcagtctctcccttccacaccagagtgtaggcattttgtttagcttgctcatcatggtctttctgatgcctagaaggatgtctgccacatagcagctgttcaataaatattgtggaatagatgagaaaaaatgtatgcagagaaaaaattagaagacaggagacatattacaaaccccatggaggaacaataaatcactagattcttccttattaggaacgtaaaaatattatttaaaataggtgataatagggccagtgatagccaacagggttaagtactgttgtaaacactaagctaagtgctgtacaggcagtcacttatttaatcctcacgatacccctatgagacatttgcggtccttcccattttacagatggagaaactgtgacacacagagatttaataacttgcacaaaggcacagctaatgagtggagaagcagggagttgaactttaaccatctgtctccaaaacccatttgaatccctttgctttactctgtcaaggtgatcatagcaatgtagcacaacaaaggacagctgggttcagtgtcagagtctagcccatgctagagccagagagacgacatgtgcagtgggaagaacatgcggacaggggtccagagaatagttgctcatgctagagtgaccaattagtggcttacccactccagatggctgtcttctgcagggagtatctcaatccccaaattgagacctgagacctgggacctggaacctggccttagctgatctctgaggttctttccaatattaaagttttcaagccccaaagaagaatagttgaaaattactttgcctccccaggctacaaggtgacatagatcaaaaaattttattagcctcctgtgttagtgtttatgtttacaataaagtcctcactaatttgattggaataaatcagcaggtctccatgtagagactgtcttatgaatacatttaaggagatttgtgcaaattattgtatgttcatactatggaatgctatgtagtttgaaagcatgtggtaggtctgtgtgaaatgatacaagagaaagtctataatatattgagtagaaaatgtaattgcagaacaatgtgtatacgtgtaatatcccaaccaaagagctgtgtacatgtgcatacctccccacacctgggtgtatgtgcccaggaaaggatctgtaagggcacacccgaaactgttagtggctgttttccccgcaagagtagggggaaggagggaaatttcaccctgtatttatataatctattgtttgatttttttttacaagaatgtgctacttttttattattaagaactacataggctgggggtggtggcacatgcctgtaattccagctactcgggatcctgaggcaggagaatcgcttgaactggggaggcagaggttgcagtgagccaagatcatgccgttgcgctccagcctgggcaacaagagtgaaactccgtctcgaaaaaaaagaactacgtaaaggcaaaaagttaaagtggtttataattaggttaccaatagtgtgtgtataaatgatatttccaagaaaggaaacttgagagtacttggaaggcttgttttcaagtatttgtaccatttcctgcaatcttgttgaacattaacttattccacctgggaaaatgcagttgtttatcaaggagacccttcagccccacacgagacattcagagaaacttggttgctgtctttgctgtcaggaaagaggaagactacctagacatgttgctccagagcagaatttccagcagtagattgaaccttcggaggccgagtcccagcccagtgtaaactggtaaagagtgagccctcttcctacaatctggttattgctgctgtgtaaaaagtcctcttgatttttatgtatttatttcttatctgctgccttactaaatgttttaatgttgctaatcattttgatttctgcagatatatatcattattactaatattgtaactcattttattttctaatctgactgaatttttggatacatgttaaataataacaattttaaaatacagacctgtgtgccctgttgtgactaaaatgcctttgactttctatcggcctctgcttgtgcttcagattaactcacagatagccaggggccactctctgccctctcagaaggggacgggggtccttatgttcaactttatattttctttctttcttttttttttttttagtttgagacagggtctcactcttgcccaggctagagtggtacagcagcgtcatcttagctcactgtagtctctgcctttcaggctcaaagggatcctcctgcctcagcctcctgagtagctgggactacaggcgcgagctaccacacccagctaatttttgtattttttctagagacgggtttttgccatgttgcccaggtcaaactttatattttcatttaggattcgtatacattggtgctatagtgccattattccaaaaatgtattcatatgtttaccgcaggtcagagaagttttgaaatttttggtgaaatatccatgtagtttgctatctgaatatctttatgattatttaaaaactattttaaacatttgtttccttttttttttttcttgaggcagagtcttactctgctgcccaggctggagtgcagtggcgtgatcttggctcactgcaaactccgcctcccaggttcaagcgattctcctgcctcagcctcccaagtagctgggattacaggcacccaccaccatgcctggctaatttttgtatttttggtaaagatggggtttcaccatgttggccaggctggtctcaaacttctgacctcaagtgatccacccacctcagcctcccaaagtgctgggattacaggcatgagccactgtgcccggccacatttgtttccttttaagaggatttttacattatgttaaaaatcttgattggtagaagttatatttcataattttcttcttcctttgtatgaataatatgcttttatagtgatgtcacaagaggtgccttttgcagagtgcctcatacgtgtcactggactaagtaagcattttatctcattaatcttcacaacaggctattagagtattataattttaattttgcagatgagaaaactgaaacttaaaatgttttaaacttggcaaggcacggtagctcgatagctcacgcctgtaacctaatccaagcactttgggaggctgaggtaggtggatcacctgaggttaggagttcgaaggcagcctggccaacatggtgaaaccctgtctctacaaaagacacaaaaattagttgggcgtgatggcgtgtgcctgtagtcccagctactagggaggctgaggcaggagaatcacttgaacccgggaggtggaggttgtagtgagtcaagatctcgccattgcactccagcctgggcgatagagggagactccttctcaaaaaaaaaaaaaagtcccaaggtcacacagccagcaaatgcctgaacctggatgtcagccctggtctaactttagcgcttccttgggcatttttgggggtgatttctgcttgagcagccagcattaccccctcagacccctggagttcagtcaagaggatgccttttagaagaacgtctactgttgagtcagaataactctggaaattccctgtactctggattggtaaaaagaggcagggagttgtgggctgaggttggactctcttagttccctcagcagcatgaaggcaacttctcccaacctggggaaagtggatcctggtgcctctgtcctgggcagtgtggtgctctggggctactgtgtggaatcttggaatcgcctgtggtgttgactttggttgcacttctcctaagcttctggctcatctaatattagtcacgctacttcaggtgtttgcatgtgccctgggctcagggcatcgggcatctggcatatgtcactgtggagggcagttgtgagtccctcctgggctgtgagggtggggcttcatagggagctgcaagccttgagcagtccctgtagcgatccctggagcctgtgttttgggactccagttgaaatattgggtgcatttgaagatgtcccagatcatcttagaccaccggccatttttctcaggacatggcagagatttgccaaggttgggagtcacccaggacctagaggatgtggttgagaagggacctgctttcttactcatttggccatgagggaagcagagtccaccagggtcttcagtattacggaggaactgaagctgctccggtcttttaaacacatccccgtagactagctgggtggtggagcaggcatttggctgtagatacacatggtttggtatgcggaagtaagacctcctggctggacccacttcagaagtcttcattgtttctctccacatgaagaggacttaggaaggagatgaaatgagattgccagggattgtgaggaggtagcccaagctacttgattcttaatgctaaactgagctctaatccttgtttccttttcagtattggattagaaaaatgtagggcaggattagaattggctgttaacaatacccaggacaaacatatgccctgagaactttggaaaggaaataacttcctaggaatggtggcagctgcagtggtaatttatatgtgtcttttaacacttgtagtacttggttttatcttttgattatatctctgcctttccctatcaaaaggcaacttaagtgtaatttttttcagtgaatttatattaatttttagtggcaagaaaatatattcatcctcaataatataatacattcaaataaagagtgaactatactgttttctgctgtcattgtggcaaagattaaaataagtaaacctcaagatattttatcagttagtatgttaatttggagagccacatagtactgatgagggtgggagacataattttggaaagtaattcagcagagtttatcaggaccccagaacatttagatgttttaccaacttattccatactcagaaagctaccctaacggaataatttgtgctaagaaaagccctggccacaaagatggtcgctgacacattattttgagagcatttttcttatgcagaaagcttgggacaacattggaaggcacaaattggcaagtaaaggttaattataaatttattgcacaaaaataagcttttggtatgagtttttctaattttcctatgcatatctgctttaaaaatagttgtagcatgcttttttcacccttagccatatattttgagcattttcttcctcgtttgtactcatatatgaaaactctaaccttagttgaaaccagccttcctttcttgcacctggacagccgaacattattgggaaaaaacattactaagctgcctggtttaactttaaattcacagtcatgaccatcaaattagtccttagtactgtctgtaaatgctaaaacatttccacagtaaattgactttcccaatctctgggaagatatatgataccttctttcttcaaagcttccatatataacaccccttccccactcttagccaatgacttcatctccaacagggaaacccctcacctctgccaccgtgtctccaagcccatctgtggctttcctctccttcacacaggatgcctcctgtcccaggtcaagctttcctcttgtatctcagctccaactcctccctcttcctcagggacctcagtctttcattactccatcctctctcctgcatcgtcactctccccttcccttttgacttattgccagcatcactaaaaatgctataatctttcacatctttaaaaacaaacaaatcctacccttgcatccatgtctttatctaccctgttagtttttatgccttttctctgctaccttttaaagcaaaactcctttttttttttttttgtcacccaggctggagtgcagtggcacgatctcggctcactgcaaactccacctcgcaggttcaggcgattctcctgcctcagcctcctgagtagttggcattataggcacgcggcaccacgcccggctaatttttgttttttgtttttttttttttttttgagacagagtcttgctctgtcaccaggctggagtgcagtggcgagaattggcttactgcaacctccgcctcccgggttcaagcgattctgccgcctcagcctcccgagtagctgggactacaggcccgccacctaatttttgtatttttggtagagacagggtttcaccatgttggtcaggctggtctcgaactcctgacctcatgatccacccgccttggcctcccaaagtgctgggattataggtgtgagccaccacgcccggccaaagcaaaacttcttaagagttgttgtctgtcttgtcttcctcctctcccattttagtctggcttcattcttattatttcactgaaacgctcgtcaaggtccacaaagaccatgtccatccatctcactgctcctgtcagagtcattttctgcagccttccctcctgcctctatttgataagtccccagtgtttcactccagctgaggctgtgcttccaagcccaagagctaactctagctacctattcagcgtcttcccttgaatgtgtcttagccatctcaatcttaaaacaactaaaatagaactcctgatgttctacagaccagttctccttcctctcaaactctctgaatgctacatcaatttcttggcttaaaccaaaaatctgggagttggttatgtttcttttcttttctgccacatccagtgtatcagctagccctgttggttttacctccatagtgtatatcaaatctgcccacttctcaccatctcctctgccactgtcatgcctggactgttggaaaggcctcctgactccaccccctgcttccattcttgccccctccttcttgtctctctgtagcacatcagattacatccttaccttccatggctttccaatgcctttcagataaaatcatactccttatcaaagaccacgaggctctgtatgatccggcctccaacctcagcgtatatcatcttcagttcccagaaaatgtcaatctcattttcctttttccacaagactttgtactgttccttctccttttcctagttcttggctgacttcttcctcgtcaggtccaacttgcttagagtggccttgcctgaccccctatttaagtaggctgcccacacccttttaaaaaatcgtagcaccttatttatttaattcggagcacttatgagaagatgcaattgctcttttcagttagtggccgcctccttccctagagcagcagctccacaggagctgagcagcacagtatcttgttcattcgcagggtttagcacaatggctggcaagtagtggttactcaacaaatgtttattgagtgaaagcctgaaagaatgagtacatattttcccaaattattatttccaatgggttcatagtattccattgtacaaatgtaacctaattaagttaaccactgccctattatggatatattggtttctagtttttcactacactgaaacatgcgaagtaatctaaatggctattgggaatattgttgaccatgaacaattattcaggccttaaaatcctagaaagtgtttttattaaaatgggtgagttgagtacattaagtgaaaaaagcataatataaaattatatatctacagcatgatttttttttttttttgagtcagagtctccctctgtcacccaggctggagtacagtggcatgatcttgggttactgcaactttgcctctcactgaagcagtcccactacctcagcctcctgagtagctaagactacaggtgtatgccaccatgactggctaatttttgtattttttgtagagatggggtttcaccatgttgtccaacctggtctcgaactcctgggctcaagtgatttgcctgccttggcctcccaaagtgctgggattacaggcatgagccaccgcacgtggccaacatgatcttaactatgtaaaagtgcatagaaaaagctagtatgaaataaaactaaaatgttaattatgcatttcaagttgacatgattacagataatttttcttttagattttttttttttttttttgagacaaagtctcactttgtcatccaggctggagtgcagtggctagatcttggctcactgcaacctctgcctcctgggtacgagcgattctggtgcctcagcctcctgagtatctgggattacaggtgcgcatcaccacatctggctaatttttttgtatttttatttgagatagggtttcaccatgttggccaggctggtctcgaactcctgaccttaagtgatccgcccccatcagcctcccaaagttctgggattacaggtgtgagccaccgcgcccggcctgattgttttgttttgttttgtttttatcttttttatttatttatttatttatttttttattttttttgagacggagtcttgctctgtcgcccaggctggagtgcagtggcacgatctcagctcactgcaagctccgcctcccgggttcacgccattctcctgcctcagcctcctgagtagctgagactacaagcacctgccaccacgcccagctaattttttgtatttttagtagagacggggtttcaccatgttaaccaggatggtctcaatctcctgacctcgtgatccaccctcctcggcctcccaaagtgctgggattacaggcatgaaccaccgcgcccggccgttatcttttttattttaagacagaatctcgctctgtcaccaggctggagtgcagtggcacgatcttggcttattgcaacctccgattccctggttcaagtgactctcctgcctcaccctcccaagtggctgggattacaggcatgcaccaccatgcccagctaatttttgtatttttagtagagacggggtttcaccatgttggccaggatggtctcgatctcctgacctcgtgattcacccaccttggcctcccaaagtgctgggattacaggcatgagccaccgtgcctggcctgattgttttttaagcacatgagtaatacattgaattttttcttttcttttttttttgagatggagtctggctctgggtctgtcacccaggctggagtgcagtggtgtaatcttggctcactgcaaccttcacctcctgggttcaagcaattctcctgcctcagcctcctgagtagatggtataacaggtgcacaccaccatgcccaactaatttttgtatttttagtagagatgaggtttcaccatattggtaaggctggtctcgaactcctgacctcaggtgatccacccgcctcggccccccaaagtgctgggattacaggtgtgagccactgtgcctggccagaatttttcctttatacttttctgtgttttccaagtttactgctgtgtgtgtgtgtgtgtgtgtgtgtgtgtgtgtgtgtgtgtgtgtgtgtatgtgattactgtgattcagtgattactgaagatagtcaaaagcagatttaggaaccatcgagccctagagaattgtctaactgtctgaaccatacatgctgacaacagctcttgcccttcaagttgctccaggtgtgtgttactcaggtttacagagtagcaagagtggactttcctatggagcctccacagctggtcaggtgtgtgtgtgtgtgtgtgtgtgtgtgtgtgtgtgtgtgtgtgtgtggtggtctaggtaacggggctcattaaaatggtgatttggggataagagtgctctggagatgtgctcagggttttgaacatttcacaactgctcctcacatctgtttttagagcttgaggagggctcatgtggcctgaggcattgtcacagcctttacccacttaactttaggcagtggttctcaaatctgagcccttctgggggttcatgaggtcaaaactatcttcatactaagaccaagatgtggtttgcctcttcattctcattctctcacggggcacagcgaagtttcccagatgttatatgtttcaggacatactggctgcagaagcagatgggagaagccagaagtagacaggagaatgtctatgaggccagacattaaggagggttgcagaaatgtaaaacaatcccagctgtctccctaaaaatgttttattatgacaaatatatttatttttcattaaaatgcaattaatgtaacatatgagtttattatcttaaatgaattaatattgttaaaaatttctcagtttagtttccaatacaataattaagagcgtaaagaagttatgagaccaaaaagtttgaaaaccactgaattaaggagacaggaagagaactttctttttttttttcaatttttgagacagagtcttgctttgtcacccaggctgaagtgcagtggtgtgatctcggctcactgcaacctcagctcccgagtagctgggattacaggcatgcaccaccatgcctggctaatttttgtatttttagtatagatggggtttccccatgttggccaagctggtctcgaactcctgacctcaggtgatctgccccctcagcctcccaaagtgctaacttgttcatcactgaatccctagcaccaattacaggtgtgagccaccatgcccggctgagagctatttttatggtgggttggttatggctcagtaaaccagttggtgaattgcatgattcagaaacacaaagcctaaggtgggaaatgaccttatctaacagagaggtgtagacgtctttgatattacattaatttcctctctctctctctctttctccttttttagagattatgcatgatgtgataaagaaggtcaagaagaagggggaatggaaggtgagtagaaagtacagttaatgggcttaaggtgagttcacatggaaaaatcagaaggggatggagttggaggaaagttgtaggcaggaatgagggcttttgctgtgtccagagagtacagaatgctcctggattggagaaaggtgatctgctctgcctcacatttcatatggtcttggttaagaattctgtttgtcataaagcttatcttaaagaccacctggtcaggcagttagcagtggaactcttttgttcaaacaaaatattacctggaacccgttagataaagcagaggaaggtataattctgctggctctgggagaggaagaagaggccctcttgcccctttgtggccataaagcatctccatggagtccatgtacagtttgggctcaaagccctcatctggtctatcctcattgaactgtaactacataagacaaaaatagtaagctcgtttaatcacgtaacattgacaggagtgctggaaactatagtgtacttgaaacaagtatttaagccaatcaaactgagagtgggccgggttcctggaatgggtggtacaggagtggcacctgctgccccctatgcatgaagtcagcattttaaggactgcttggttgtctaaggctgagaattatactggccagaagagtgtgcagttttacttgattttttctgcatgttgctgaagaatttataccaacctttcttgccatcaaggtttcctgcagtcaaaagcccatgcagtttcaagtgcattgggcctaggaacaacagagctgattagtacaggaggattttgaagtctcacccggggcctttgttttaaccagcacatctgtcctcgccacccagaaggggaggccgtgcagtgggcctccccaccgcatacctttagcatacctctttagcatacctttctcacttacccttcccatcagtgacgggcttgtagacatgtgaattttaaactaatcttgaggaagctgccttatataataaaaactaattgacccctgtactgcagcagaaagctttctcatccacactatctgccctgatgtgtcttcctcctgttgcccccttctcagtttatagcattacaaaaagagaggataaatagccttgttttaactgccagcttcctctccactgtgggctgaatgaagataagaaaggttagctgaagagttgcaggtctgaagcttttaggccaggactggaacgttcttgttcttccagcctagactaaggtacactatgtcccagctgacatgtgtgttagtggcacagttctgatgatgcttttcatcaagtccccacatgccagaccacatgtgcaggcgctagtgttcactctccccttaaacacaagtgcatgccgtgaaaaagtactcactaatatgattatgtctgaatgttggagctatagatgatatttcctttatttatttatttatttatttatttattattattattattattattatgagatgggatcttgctgttgcccaggctggagtacaatggcgcgatctcggctcactgcgacctccgtttcctgggttcaaacattctcctgcctcagcctctcacgtagctgggattacaggtgtgagtcaccacacctggctaatttttgtagagacggggtttcaccatgttggccaggctgatcttgaactcctgacctcaagtgatccacccgcctcagcctcccaaagtgttgggattacaggcatgagccaccatgcccgactgattttttttccttttttaaatgggtatttactttgtcatgggaaataaaaactatttttttttaagtttataaaattacatcagtgagaggaaactctaactcctagaaagttaggttagggtatgggaggtacaagtgagcatgtgtccccgtgggcttctggtccataggaaatatggtttcttctgtattctgtacttctggagctccttttggagtctgatgcggtaagctgagcgagaatcacagcagatgccatgaagcccatacgctgttctctttccttgcaggtgctggtggtggatcagttaagcatgaggatgctgtcctcctgctgcaagatgacagacatcatgaccgagggcataacgagtgagcatgcgctctgcacttgagcagtgctggagccttctctctgtggcgggcttagctctttcctattcattattatctcctttgattttagattcttccagcaacctgtgtgctaagaccagaagctcctgagaggcgcaaggctatcttgttcatcactgaatccctagcaccaaatccagggctagatgctcattcaatgtctgttaaaggaatgccaaaagaagggttaaatcaagaaagaaaaggcagcccacccaatagaaaaaagttctgagcaggcacttaacaaaagaagaaatccaaatggccaatcaatctatgaaaattgtccactgtcattagtggtcagggaaatgcaattcaaaccagagtgagatgccgatatagattcaaaatattagaatatttaatctctgataatgccaagtgacggtgaggaggtagaaaaatggaaactcctacgtgatggaatgtctgctggtgtagcccctttgaaaaccacttggcagtgtctagtaaagttgaaggtatgcatgtcctgtgagccagcaagtctgtggtcaggtgtgtgtcctagacaacctcaggtatgtgtgcccaggatacatgtgcaggaatacatgtgcagtgttgctcataggttccccaagtggaaaataaccaaaacgtccatcaagtgtagaatggttaaatcagttgcgtgcaattacacagtagaatactctacagggatgaaaatgggcgagccctgagcgctcacagtaacatgaatgcatctgatgaacaacggtgagcaaagacagcaagacacgaaagaccactgatagtgagccttcattccacagagttcagaccgcagagctcagctgtgttgttttaaaatgcagatgtaaggggtaaaacctcaagagaagagctcaccattcaagggaggataatgattctgtttgcggggaagagaggaaatggtgttgatagaggggaatgtgagctggagccagggcacttttgtggtgctgattgggtttcgtttcttaactggggtagcgcttatttagacatttgccttatggttatttgtatgtttatgttttattcacgctttggaatgtgtgctataacttttggtgaataataaggagcaggattgctggatcacatggtaagtatgcttagttttgtaagatactgccaaaccatttttcaaagtggctgaccattttgcattcccagcagtagtgaatgagaattcctgttgctccacatccttaccagcatttggagttgtcagtgttctgaattttgagcattctaccagctgtgtggtggtatggtattgttgttttaatttgcatttccctgatgacctaggatgtggagcatcttttcacatgcttatttgccatctgtatattgttttttggtacagtgtctgtaaggtctttggcccgttttttaattgggttatttgttttcttattgttgaattttaagggatatttgtatattttggataacagttctttatcagatatgtcttttggaaatatttgccctcagtctgtggcttgtcttttcattctcttgatggcatcttgcacagagcagtactttttaattttaatgaagtccagcttatcaattcttgttttcatggattgtcactttggtgtcatatctaaaaagtcattgccaaatccaaggacacctagcttttcttttatgtaatcctctaggaattttataatttcgcattttacatttaggtctgtgatccattttgagttaacatttctaaagggtataatgtatgtgtctgtattcattttggttgcacgtggatgtgattccttcatttttaaaaaacagatccagtatatctatcagcagaagcacagtcctgtaaatggcatacacagtttttttgtttgtttgtttgtttgagacagagtcttgctgtctcccaagctggagggcagtggcgcaatctcagctcaccacaacctctgcctcctgggttcaagggattatcctgcctcagcctcctaagtagctgggattacaggcacctgccatcacgcctggctaatttttgtatttttagtagagacagggtttcaccatgttggctaggctggtctcgaactcctgacctcaagtgatccacctgcctcggcctcccaaagtggtgggattacaggagtgagccactgcacttggcacacatacacaattttttatgtgacttttatgtcatttagtgacctaagtcagtgtgttttttgtttgtttgtttttgagacagagtcttgctctgttgcccaggatggagtatagtggtgcaatcttgactcactgcaaactctgcctctgggattcgggcaattctcgtgcctcagcctcccgagtagctgggattacaggcaggcgccagcacacccggctattttctttctttttttttttttttagtagagacagggtttcaccatgttggccaagctggtcttgaactcctggccccaagttatctgctcgccttggcttcccaaagtgctgggattacagacatgagctactgtgccctgccccaagtcagttttaagactaggcttgcccctattttgagtttatgatgttattttcttcattgaatttttgaaactatttttttcgtctatcaaagcaaaaacagacaaaaaacacaaaagtaaaggagaaaaacactaaatggagctaacaaggatctaagaaaagagcagtgacctcctgtcctcctatctcccatcctcggggtctattaccccagaggcagccacctcgcccttcattctggacatcttttttatttttctacataaatgcttgttctattttctcttgattcagtgatattagatattattaactgacttcctgtgggagatggggattcagagctctccactatacacagactcttgcctacccccaaaagtggtttttaaaaaatgtccttatggccgggcatggtggctcacacctgtaatcccagcactttgggaggcagaggcaggcggctcacaaggtcaggaatttgagaccagcctgtccaacagagtgaaaccctgtctctactaaaaatacaaaaattagccaagcatggtcgcacgtgcctgtagtcccagctactcaggaggctgaggtgggagaatcacttgaacctgggaggtggaggttgcagtgagccaagattgtgccactgcactccagcctgggcgacagagcaagactgtctcaaaaagaaaaagaaagaaagaaggaaagaaaaagtgttcttacttaacaaaatttaaaagttagcaaccctatgttgaagctctgaaacattttggggggagatattagtggcctatgaaattaaacaaatctataaccactggtaaagtagatgtttggggatttttggtattaatttgaacattatttaaggtgaaagtctttataaatattccaagtctttataaatgttacaatcctctaaagtgatgcttttatctgcttaaatgatctgcatagaaagaatggcacctgtataattgccttgctctctcaatgccagaggacagtaggtaacacattttaagcattaccgggtgattggtaagattctcccaaaagctgttctttccaggtgaagtccctgacataactgtagaggaaacaagcaaaccaaagcctatggtttgttttaaccaaatagaacatttaatctttgcactattgaaggaagcaatattgtatagagaatgtggttggaatgccctcatttgatatgcagaggagagcaatgaaactatccagctgttgataaataaacccaacatggaaattccaaaggaattgggattatctagggcagatgagacaaagctgaagaagaggcaaaggacccattcttgacagaattagatatcattttccattttctctcagaacagatcaatgaatttacttaaactgaaatgggaagtgagaactatctagtgtgaagatttcagatttttctttgttgttgtttttgtcgttgtttttgagatggagtctcactctgtcacccaggctggagtgcagtggtactatcttggcttactgcagcttccacctcccaggttcaatcgattctcccacctcagcctcctgagtagctggaattataggcacattccaacatgcctggctaatttttgtagttttttagtagagatgaggtttcaccatgttggccaggctggtcttgaactcctgacatcaagtgatgtgcccacctcagcctcccaaagtgctgggattacaggcatgagccaccatgcccagcccagatttcagattctaacatcttgggcatgttgagaccatggaattcactcccaaggaacgtggtaaccttaaggaatgagtgaatgattccccccggtcccccactgtagatatttatctgcaacagtctgaaggtagcctgtctatattgcttctggttttatggtcacccatcatgttttcttattcactgtgggttgttttgttgtctagttgtggaagatatcaataagcgcagagagccgctccccagcctggaggctgtgtatctcatcactccatccgagaaggtaaaccttccaccagaggaggactctggctaaggttagatggactggcttgggatttatgtggcacagactgtctgacattgctaggttaagcacgcatttaacacactgctctgtttaagcatgcaatccacaatggggtggggtcgggggtggtgtttatgcagtgagaagtgatgaatgtattaagcgttcttaaacacagcagctgtgcagaaaaccagagcctgtgttccgtggccctggatcattctagttttcccccttgcactccctcttcaggtaggacccactctgtctaattagcagtccacctccagactttggtattttatgctttcattttattttatcaatatccagttactgttcacatttacctgtcttataattttggaggttacttcaaatcactatccaaacaaggtccaactccttgcttctgggtaatagttgtcttaggcatgttttcttttgttttgttttgttggttttgttttgttttttgagacgaagtctagctctgttgcccaggctggagtgcagtggcacgatctcggctcagtgcaacctctgcctcccaggttcaagagattctcctgcctcagcctcccaagtagctgggattacaggcacccccccgccacacccagctaatttttgtatttttggtagagacagggtttcaccatgttggccaggctggtctcgaactcctgacctcaagtgatctacctgtcttggtctcccaaagtgctgggattacaagcatgagccaccactctcagccttttttgtttttttgggttgttgttgttgttttttgtttgtttgtttttgtttttgttttttttttttttttttttgagacaggtctctctccatcacccaggctggagtgcagtgttgtgatcacagttcactacagccccgacctccggggcttaagtgatcctcccacctcagcctcccaaacagctgggactacaggcacatgccaccatgcccagctaatttttggtagagatggagatcttgctatgttgcccaggctagtggcaaactcctgagctcaagtgatccacctgccttggcctcccaaagtgttgggattacagttgtgagccaccatgccagccttaggtgtcttagtctatataaatttcctccaattttcacacttttttttttcactttgaaaactggcttacatatgaatttctacagatgcaattaaattgccaaaaggtcatcaatatgaatctcctggaaggtttctgccgggtttccttttttgtgggtgtcttcctaacaactaattacagtggctccaaagaactgatactgtcattccagaatgagctaagaaggcctttgttcatctaaactctgaaatagtactaattttaagtcctcaggacttggttatggccaaacatgagtgttagaattatgcatcaaaaatcccctgattttgtgcaagtggcttgaagccattggatttaactcagttcagatacaggtcccatttggctctagaattggattcaggtccctctttttcccccccatccacagtccgtccactctctcatcagtgactttaaggacccgccgactgctaaataccgggctgcacacgtcttcttcactgactgtgagtacaaccaagagctgtccccagtcccatcaggcaggttagcatttctgtacagctgggctgagccaaaactaaggcaggtcaagagggaagaaatgggttgttaccatgcttgtcccgatctgctggtttctcttcagaagataaattgcataagagacaaaaataagtgcacgcaaatacaaacccactagatcatgcagtccttcctgctgaaaaatagcacacaagcacctcttctcaggactgacaggcttggtgctgagaatgaccttcctgaggcttggcatttcattatgtagacttccagttagcactgtatgctgtagtatgtttccatcaatttttcaactacaaagatattccaatccagtagtctttgtattagatagaatctgcatcattaccctagaattagttttcttatgttttgaggattttatgctcagatcctagcggagaagcagagggagatgaattgacctggacagctacagagtataaaacagtaagaattcacccagagatcttctctctagggataaactcccacagcactcaccactgagaaagtggaaaggatatagcagaagaaggattttggccgggtgtggtggctcacgcctataatcccagcactttgggaggcctaggcgggtggatcacctgagatcagaagttcgagaccagcctggtcaacatggtgaaaccccatctctacaaaaatacaaaaattagctggatatgacagcaggtgcctataatcccagctactcgggaggctgaggtgggagaattgcttgaacccaggaggcagaggttgcagtgagcaagatcacgccattgcactccagtctgggtgacagaatgagactccatccaaaaaaaaaaaaaaatcctgataaaatgaagagcccactgtacatgtgcagctgttaaatgaaccagcaaatggacaggaaagccaactgtcttttgtcatacttgcagcttgtccagatgccctgtttaatgaactggtaaaatcccgagcagccaaagtcatcaaaactctgacggaaatcaatattgcatttctcccgtatgaatcccaggtgagcctgagtagggggtgcaaaggaaatctgcatcctgtcttattctgagagggtggggtgggacctactaaagagttgaggagggaaggtaccatgctctgaattgccaaatgacaggttagaagtggatgtttactgaatggaaatagtattccatagggcctgccccctgccctcatcttactctccagttgtttctgactttgcttcagccttgtgcctttctttgtgtgcatttcatccttgctctcagtgttcactcctgtcggccgactccttgaataaccactaagtagccaatcagaaacgagcttggaaggagagcgagggtggggagcagaagcatcccatctgctgcgaaggagactgttttttacgtggagataacctcagcttgtcatgtgctgagagagcagatggcagccttcgtcattagccgttaacacttcaggtgccaaatgccaggcccataaagcactcccttggaaacaaacaaaattattaaacaaataaaggtgaagctgattgtgagagaacagacacaacttgtctcggtattttgagagttgttaaaatgtcttctcttaccagacaaggaaacaaaaaccacaggactttgatgcattttacggagctaaaagatgattgtggcatattggatctttacagatcagcttcgagacaccagagagtgacctattcttagagaaggagagatgcataatatatagtgtgaacatttaaaaacaggcttccttctcacttggcctaaagcctgtcacccgcttgggggaaggaatttttttttcttctgtgtgttccatccccacctggatagaacaaaatccagctttagcatattgaacaatcttatatttcagaaattttaagaaagtaaactatttttcgaataccattttttaagattaaggtagtttatataaacgagaatttaagagaatactgataactggaagactcagtcatttaagagagaatcttcaacttctagcatactccaaaaaaaaaaaaagaaacagaaaaagaagagacaaatacggccaggcatgatggttcacgcctgtaatcccagcactttgggaggccaagacgggcggatcacgaggtcaggagatcgagaccatcctgtttaacacggtgaaactccatctctactaaaaatacaaaaaaattagccaggcgtggtagcgggcacctatagtcccagctacttgggaggctgaggcaggagaatggcgtgaacccgggaggcggaccctgcagtgagccgagatcatgccactgcaccccagcctgggcaacagagcaagattctatctcaaaaaaaaaaaaagaaagaaagaaagaaaagacaaatacttagaacatgctactgaagataaggtattattaaatccataaatagctcctttatttgcccacagtcacagcacagtatctggcttgtctcttatttattgaaactaagcttacaatttccagtgtagtctcacactaatcccttctgctctcctcctggccttgtcactgttctccaggcaccctaggtacacacccgcccaaggtccttggcactgcctgttccctccatgtggaagtcccctgtaaacatcccaccttcaagcccttgctcagatgttaccttctcagcaagtcctggtgtcctccctgtccagccctcctggacatcctcccctgctctgatattttctcatatacttgccagtttctcaggaccacacaattcacttttcattatgtttattgtctgctttctcctactagattgcaaactccttgaggacatggatgttttggtcactaatagttcccaagtgtttagcacatgggcacatggtaggcacccagtacatatttgtggaagaaacgggaacatattctgtagactcactgccagggtcagagaatactctgatagttcacaatatgtattaatactttttctcctccccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcgggggtaaggcagtgcaccagtctgctggagtggcctcccgtgtgtcccccaagtgaggagctggcctggactcctcctccggccttaaggttcctctgacagttgtctcaagaagatcaggatttgagcatctcttacttcaaattattcttccagtggttttgttatcttctcaatgttatagtgaaatataataatacatgcagaaaaaagcataaatcaactattgaataacgaaaatgtgaacctctatgtaactgcaactcaggctgcctaccgtttttaatttctttctaatctttaaaaacaaatactatctttactaaagatgtttcagagtaagataaaatacaaagagagtaattctccaaaggacatgttcctcagattttatcaagccacgcatttctcacttgcttgctgagtgctgggggcacctgaagctgaagacccagcccatgatcagggaggatgggtgggatgtgccttccagcgtgtatgtgcatgagagatgcacccctgcaggctcgaccctgcgagataggacaggccaagtgctggggacagccacagtagggagagggccctttgagccaagggtgaagcccgtctgcagaccacaggtgacgataggctcatgaggagagagaggccagcattttgtgtgcacagttggctcttgcatttggtataaacaaaaacttgggagttgggaaaatgtggggcacatttggggaagatgggtagtccagcacagtgtatgtgtacggcagtggcgtgggatgaagccaattctggaggtcttggatgacaggtttgggattatgtccttcggtggttatcactggaaacctatgggggatttggacggggatgaccacagttctctgggagagtgaaggctggagtataagcaggagtcagggcaaggaaaaaccagaaggggtggctaaccaggaggccactgcaggaggaacaaagggcctggtcttggagtgatgggaacggggtggacaggtaaggacagaatctgagagcgtgcagaggtggattcggaactgccagcaggttagtagtagggcaggaagggcttaggctgccaaggcattgtgccgtggtaaccaagagcttggtggtgccacggatcatgggttcacccatcctgtgacctcattgtctcctggaagttgtggccatagaaaaacaccttccggttgctgtcccagtgcctggcttccctccactgttggtaatcatggacaaagccagccggcagttaagaaatgggacctaggtggcatctcctgactgacctgtgggagctcaggctggtagcagggctgctgcagtgctgagactggccaggaagcaggcagccgccgccccagcatcaggtcaggtggggcccagggagtgctgtcagacccagccatggggaagggttcaaaggttctcacattgttctggccatgccagctgaaatgtcactctccaacaaacacaacaaaacaagacccaagagaatgtgaactgagggaagtgagaatcatgggagtcaggctgggagcctgatcgtggcaaaaggttcactgactggtcagggcccccagtggaagtgcggcagtttatctgaagctgcttggaaagacatctgtttccacttagatcattctggataaaagcaataagaaaatcacttacttatggtccaggcactgagctaagtgttttattttgcttttcctttctaattatactctcattgtaaaaacacgaatacagacaatgctcacatctcccctaaccccgctgcactgcttggcttcctttcccgggggcagccagcaccatcatgggtgctgggtggttcatgctctgtcacccctcctttgtcagggaatacaaggacaatgccctgctggctcagctaatccaggacaagctcgatgcctataaagctgatgatccaacaatgggggaggtaagtctggcttggaccacgtggttctctttaccaaggaccgcagtgtttgtgtgacagtcccagagacagcttggttctgttgccacagagcatgtgtcagtgctgcttttcctggggactggcttccagtgaaatgcctgaagcccctggggcagggccatctacatgtgttcatcgtggccagggtgaccaacttgttctgtttgccagggctttcctggttgcagctctgaatggcccaagtcccgggaaacccccagaagcataatagcaaaccagaaaatcgacagacacacgcttcagagctcattcagcattcactggtttttacacatgctctgtgtacagccctgtgcgttttacacatggatagatattcactggtttttacacatgctctgtgtacagccctgtgcgttttacacatggatagagtcatgtaaccatcttacaatcaagatacagggctgtttcctcaccaccttgattttaaaactgaaaggcccaggtcctgggaacccgcttagtcccaggcacactggagggtggttgccccatttgtagttgaacttgggcagtttcctacagaaactcacttcggctcctagcgtttcatatctgcccctaagtgcgcttgctatgaaatagaaacactggagtcttttagggtatttttggtgatcttgtctagcagtagacttctgtgctgcgttagtaactttgcacctcagagtttgcttcctgctgccctcctttacaagaggggttcgctaggtggagaagccggagttggctgggtggcttgtgaagcatctccctgttttcccccagggcccagacaaggcacgctcccagctcctgatcctggatcgaggctttgaccccagctcccctgtgctccatgaattgacttttcaggctatgagttatgatctgctgcctatcgaaaatgatgtatacaagtaagtatagtgttacagaccccagagtgtatacggctctgcacatgagccaaaaatatgtctagaaaaagaacgggtttttttgtttgtttgttttgagatggagtctcgctctgtcacccaagcgggagtgcagtggcacaatctcagctcactgcaacctctgcctcccaggttcaagcaattctcctgcctcagcctcccaagtagctggggttacaggcatgtgccaccatgcccagctaactttttgtatttttttagtagagatgggatttcactgtgctggccaggctggtctcaaactcctgacctcgtgatccgcccgcctcagcctcccaaagtgctgagattacaggcatgagctaccacacctggcagaaaaagagagttttttttgtttgttgttttcttaagacgaagtctcgccctgtcacccaggctggagtgcattggcgcaatctcagctcactgcaacctccgcctcctgggttcaagcaattctcctgcctcagcctcccgagtagctgggattacaggtgcccaccaccacatctggctaattttttgtatctttagtagagacggggtttcaccatgttggccagcctggtctcgaactcctgacctcatgatccgcccgcctcagcctcccaaagtgctgggattataggtgtgagccacagcgcccagcaaaagagcatttttaaccctaggaaaaacggttcattgatacagccttgcaaattagcctgtaagttcttctgcgagttccccaaatccatgtggcatttctaggcaggaactcatgacttgtcctctttttggggaggacaagcactttaggtctttggttcccagctcacagcacctcaggtcatagcctacttggatatgttaatattgatttttgtgtttatgtgtgtatctcattcagagttgaaattttttctttctgttttattggttctgcctctctggaggcagagttgaaacttcttgtttatagatcctgaaatatgatgatgatgaaatatatcaacagaagtttcatactgaactttcctcacagaggagctgttttcttcatttgtaaaaaacatttttcttggtagcaatcatcagaaatttagtttctaaaaaccagtttttccttttgtggaaccagactgtataagaaacagactgtatgagaacagacattgttctcatggcatttaatagcatccatcataaagatagtggtttcaaaatgaagattctaaaaatatgagtgaatctcggttctccctgttggtagctataatttgtgcctcctccagctgttcacgatttcccatgtgattggtgctgagggcctattgcaggcagctgctggaagctatttaggcgccacacattgaggatgacatcccagtgcctttccagagggacagatgtgatctttgcctttcccctataaataactaaactcatgtatgacctgacttcatgccctggaccagacagctcaggtggagcttgtatcagctgacccaaaagattttaagacagaatttcaaattggttgactttgaagagagctttgaatctctcctacccgaggaattgcagcccgggtcagtgctgccacagcaagcctggctgacaggtccaatgttgtgacggcacttgtgaacatctggcagctgagggtggtgagctgctgctgctgtaagctgaagagggttcgatgaatgttgtggagacagtgcactccacctgagtcccgtctccattctaggtatgagaccagcggcatcggggaggcacgggtgaaggaggtgctcctggacgaggacgacgacctgtggatagcactgcgccacaagcacatcgcagaggtgtcccagtaagagccccctgcccccttctccagcgaggcgcctctacccagctgctattgatgatgcgttcactctgggcacctcgcgggggctcatcactgtgtgaattcgttttcttggcagagtcaccaacatgctaacccgtaatgataaatcccttctgttctctgagcttgagctactccgacttcatgaagttagaaaatcaattctgtattagggctgcttttaggattcttggaaaacatatgtagctctctcagaaaaatgcattacaaacattaaaaatttaaagctagttcattctattgaaagacccaaacaccacagtatacaattggactttcttttttatagctggtatacagccttccctgttttacctacagttcctgagcaatagctgatgtctccctactaaactgtatccagctctgaaaatgtttcagaatgtttctaatatttaaacattgttgtaagacctttaagctgtagataatgattctgctttttcagaaagacatattctgctacagtgagttggtgatatattcaggaaatgcccaaggaagagtgagaaaataatacagccttggatagttctgttgtttagagaagaggtctctaaacttttttgatcactcaacttaaaaagatactaacctgtggccaggcgtggtggctcacacctgtaatcccagcactttgggaggccgaggcaggtggatcacctgaggtcaggaattcgagaccagcctggccaacatggtaaaacccagtctctactaaaaatacaaaaattagctgagtgtggtggcgtgcgcctatagtcccagctactcgggtggctgaggcaggacaatcacttgaacccgggagttggaggttgcagtgagccaagattttgccattgcactccagcctggatgacagagtaaaactccatctcaaaaaataaaaaagatattaacccatatttcagtaaattaaatgtatttatgaatttaaaatatgctttattgtactaatgtgtgtatttacagcataaatatatatgtttgtatatttttcaaacatgaattatgtttcactatttatattccaatataaatttgaaaagaatgaggtaaaataaacataagtagatattctaatattttcttctcttttctccttgaataatctggtacaccccactctggagaccactggtttcaaatattaattagaaaagctatgtgtctctcttctctcttagaaaataacttctttttctttttctttttctttttgagactgagccttgctctgtcacccaggctggagtgcagtggcctgatcttggctcactgccacctctgcctcccaggttcaagcaattctcatgcctcagcctcccaagtagctgggattacagaagtgtgccaccatgcccagctaatttttgtatttttagtagagatggggtttcaccatatagaccaggctggtctcgaactcccaacctcaggtgatctgcccaccttggcctcccaaagtgctgggattacaggcgtgagccaccacacccggccaaaaataactttaaatgcataccttactggcaggaaaactcaccacatactcctaaaggaaaaattgcatgactcctatagcatccatagcaaggtccatggtgttgctgtgaaacttagctgcctccttttatcttccagggaagtcacccggtctctgaaagatttttcttctagcaagagaatgaatactggagagaaggtaaacccatgccagtgctcaaatgcccagtaaattagtccctgctttctctctaagagcagggaagctgcctcctccaaacaggactagtgggttagcaaggccatatccctctcttagtttatatcattttgccttatttttattttgcttttattattattattattattttgacagagtctcgctctttttcccaggctgaggtgcagtgacaggatcttggcttactgcaacctccgcattttgggttcaagcgattctcctgcctcagcctcctgagtagctgggattagaggcacgcgccaccacccctggctaatttttttgtatttttagtagagacggggtttcaccatcttggccaggctggttttgtactcctgacctccagctatccacccaccttggcctcccaaagtgctaggattacaggcatgagccaccgtgcccggccatttttacatttaagatacagatccaggccgggcatggtggctcacacctgtaatcccagcactttgggaggccgaggcaagtggatcacaaggtcaggagttcgagaccacccttgtcaacatggtgaaaccctgtctctactaaaaatacaaaaaattatcttggtgtggtagtgggcacctgtaatcccagctacttgggaggctgaggcaggagaattgcttgaacccgggaggtggagattgcagtgaggcaagaccatgccattgcactccagcctgggtgacagagtcagactctgtctaaaacaaacaaacaaaaaaaagatacagatccagagcccctacattttgatatttacagagaactgctttttgttactctgatggttaatatttactcttttggatcatgattcattttaagccagaagaatgaactgtgagacctttttttaacttgtggtaaaattataatctaccttatttatatatataaaattatatatatataattataacctaccttatagaatttataacctaccttacctgggcctctccctatcctgcctgtttatcagaggtggcacacctgtcttcgtcaagggaagtggaattaccaaaatacaactctggttgtgttactcacttgcttaaaaccatttagggacttcttgttccccttagaataactcccatctgcaacacacacacacacacacacacaccccccttccaaagcccagatcatcagccccacaggcctctctctggtctcatctctgcccctatccttgttgccctgcctccttgctccagccacaccagtgtcctcttgcctcagacctggccaggttctttggctcaggcatcatttcctcagggaaaccctccccgggtccctacccagactaggcagatgcctgtgccacgtgcacccacactacctggtgagtcccctcgaagggccctgatctctgcagtgctttggctcctctcctggatgctctgattctccgtgaattagagattctttttttttttcttttgtccttgtatctccagcacctaatagttcctggtatatagtagtaattcagtaaatttttgttgggtaaatggatgggattagatggcccacacagaaagcacacagacctgtcttgcccattgggtgcagattcccaccctctgtgacctccctgtgctcctcccgtccacgtagccacagtctttctgccaggaggaagtgcaaacttgatgctaaggctgcttgagctgaggatgaagaaaagcagtgaatagaaggattttttttcctcagcaagaattagctctcaacagctttctagtccaataagcatagaataaaatataactgctagacttcagagttcagttcccaacctataagacaatcatatttggatcaaaaaaaattttgagccagaggcctggaaatctaaacacacatgattttgtgtttcacagattcattttgagtgttacagagtgtgcgcttgggaaccctagtgtgggcagctgtcctgtcctgtgcccactagccttgcaaagcctcctaacatcagggccattagagtgacaccatgtgctttcctttcccttacagaccaccatgcgggacctgtcccagatgctgaagaagatgcctcagtaccagaaagagctcagcaaggtatggcagccccaaatcatctgtttgaataattgagtagaaacagctgcaaaaagacttctcaaagccctactactctaattgattcatggaaattcacagatttagttatcttcaatttttattagaaaagaaatgaaaggctgggataggcaccttatttcctgtcactttcttttctcctctttatcttttccttcctattcccttgctgttggcaggaggcctcagttcctcaccacatgggcctctccacagggctccttgagcatcctcccaacagggccattggctttccccagagtgagccatctgagagagagagtgctaggaggaagtcacaataccttttatgtcccgatcctggatgccatgcattatcagttcctccacattgtttgttagaagcaagctactaattccagcctacagttaaggagggaatgaagctctgcctcctaaaaggaggagtatcaaagaatctgtggacacattgtagtaataaaaccatcattggctgggtgtggtggctcatgcctgtaatcccagcactttgggagaccgaggtgggcagatcacctgagatcaggagttcgagaccaacctggccaacatggtgaaaccctgtctctactataagtacaaaaattagccgggcgtggtggcacgtgcctgtaatcctagctactcaggaggctgaggcaggagaatcacttgaacccaggaggcaaacgttgcagtgaaccgaggttgcaccactgcactccagcctgcgcaacagagcaagactctgtctcaaataaaaaccatggtgccacctaccctcataaaggatttctcctttgtcttaactcttttagaatgtggtttgtccctctcttttgacatgtaacactttctactttgtgatgtttgtgtacccgcttgtacacactttttacctcctttctgaggctagcgactccttggtgcccagtggtgttttatacgtagtaggtgctcagtagatgttgcatgcatccatgattagtcccttggtcacaaactgttgtgctttttcctagtactccacccacctgcaccttgctgaggactgtatgaagcattaccaaggcaccgtagacaaactctgccgagtggagcaggtaggactctccttctgccacggcaagtttttgccaggcctatttacccagcagaattttaacatctgcccttgaacatcctgcagaatcataggaaatagagacgggaaggcctgctagatcatgctgtctcaactctggagccagtgcggttccactgtccatggtagggactagattggtctggaatgctgtgccgtttggattttgcatgcctattttgaaaggctctgttttccctggaatgagtgaagaaagatgtgtggggttctgagccctacattgacaggactggcagaattttatattctgaatgtgttctactcttgccatggccagaccagctttggagacctcgaggctgacagagggtagagcagtagcaatcagaaatttgcccaaagcatccctgatcacaattgggattgtaaattgagaatttggggtttgagttctgtctctgtcactgattatttgatgtgcctgtttctttgtgtttcatttttttcatctgcaaaagggaaatcattgctgacatttttcaaggttgtcttgtggagtcactaatcctggcttagattcatcctaattcttcaagtgtttcaacattataaaaccatggttcaaattctaagcgaagagaagatgttaaaagattctgaagccggctgggcgtggtggctcacgcctgtaattccagcactttgggaggccgagacgggcggatcatgaagtcaggagttcaagaccagcttgggcaacacagtgaaaccccatctctactaaaaatacaaaaattaattgggcgtggtagctggcgcctgtaatcccagctacttggggggctgaggcaggagaatcgctcgaactcgggaggcggaggttgcagtgaacagagattgctccactgcactccagcctgggcaacagaacgagactctgtctcaaaaataataataataagattccgaagcctcagcttggcctcttttcatagaaaaaaacaattcaggatctcagtgtgaagctaagatttcaatcctctggtttggtgtgacaggctcagtttaggattgtaagccctgtcctgtatctttggatattttataaggggaagcagccctgctaaaatccatcaattttataggggattatagcaaacacaaggtgtcctcttgaaaagaacctgaccatctagaaaataggtcatacctaaatcagtaaaaatgtagtttgggattaattttggaagtttacaaattttcagaagtgatcaaaagtattgttgaactagttgcattattaaaatcatgtcctgctagtcaaatgtctgttgaggctggtggtaggactgaaaggtgaacggcctgtgagaggtgtcctgccttcctgggacacagactggagagagactatgaactcgagatcagaatttgtatggactcttgggatcttgagagaaaaaaagagagccttcaggcaacctcctaagagccacaaaggaagctgcagctgtgagtcctggttggctgagaccagcgtgctgccttctctggatctgagtcttgcctgcatcatgaagcggggccaggaacttgtgttcacttcactctttttcatgtctagttctttttcagcccatatcttccccttcatctcctggggtttggatttgctggtttgggggctctttttttcccttcctcactcatgaaacatggtagaaagattaaaaacacgttaaaagcctggagcagttcaaactcaaaaagcatgtgcttcaatgtgaggggaagcagaatggaaagaatctacccacgcggaggcatcctaaaatcccagcacttttcatgggagggaagcacatccctttaagtcccgctccctcacagggccttgtacctctagagggcctaccaagatttagtcttttttttttgttatgagccagggtcttgctctgtcacccaggctagagtgcagtggcgcaatcatagctcactgcagccttgaactcctgggctcaagcaatcctcctgcctcagcctcctgagtagctgggactacaggcatgtgccaccatgccttggtaaagatgaggtctctgctgtgttgcccaggctggtctcaaaactcctgggctcaaaagatcctcccacctcagccttccaaagtgcggagattacaggcatgagccaccgcccccagccaggattgagtctttatctgagaagctggcacaagtacactggcactcacctacagtgaacagcctactttaaaacaagatggtaaatcattgtggtttctgttgggcaagtggcactcagggcttttatccaccctcactgatgctgtgggagacaatgctgatcacactcctgctaactacagtgcattataagaacagaagcacctgtttaagaccttccccaaccaaggtggcagttctagacatttgtggatcctgaatttcctaagaactactgttcctccacactgtcaccagagagatggagccaatgaggtgtgttttccttaggacctggccatgggcacagatgctgagggagagaagatcaaggaccctatgcgagccatcgtccccattctgctggatgccaatgtcagcacttatgacaaaatccgcatcatccttctctacatctttttgaagaatggtagggctgtgggacctagaggaaggcacagaccctgtcttggggaaactgagacaactgagaaagaggaaacaaagcagagaagtcatttaaaagacatggactggggaaggaaaagaagatcctaggggccctttttgtttggggaaatgcagtgtagtcagatcgttgcagctagaggctgaatgtcccccagtcattgtagagttaataaatggtatggagtagatggaagaggacagggctggggagagagggaaagctgcttggccttgtggccagtttaccagagctatgcccatcacgtatttttaacttgcatcacattggtaatctctgcctttaaagaactgacttttacccagttcaatcacagtttcccaggaatgtccattgtacaaaagatagataataagactcttgtccaatttgaccttgattcagggtgggggtgggcaggggttgctgagaagccggggggcagatggaaacacagactataggggcagctgctgatggtcctcactcaggcagagtggctggaggggaatcgggatcctcgtgttgtcctcacctatagtgaatctgatgaggtgggggagcaatgtccactaaccctgaggggagaagggccaccatccggcctgtcccattgggtgcatgggggctgtgtgtggtgatcgggtgtcttgtgccctcaggcatcacggaggaaaacctgaacaaactgatccagcacgcccagatacccccggaggatagtgagatcatcaccaacatggctcacctcggcgtgcccatcgtcaccgatgtaagaggccagctcagcttccgggggaggtgggaagggagctggcagatctgtctgcttctgctctgactgacatacagcatctctgatacacactcgtacgtcaagagagagagacacagaatcagagggataaaggtgtaaagctatatataaatcagagacacaaagccaagaacctagacgtcaacagcagtgagtcattcacagttgtgaaagctgagatgtcttggaaccaaaccataacaggggtccccgccattttatctgtcttgtctcagggtctgtctggcctcacctttggacagcttagcctcagtgtcccctgtgaagatgagaatatgacacttagagctagcagtttggccacctttgagtcttctgcactgggttggttcagagccaagtcagggcaggttgtctgggaggcctggaccacgtgatgtgctctagaagaggtggggtgaagcctccaggacccttgcagaggactctgccatgaaccttgcctgtcacagccccactgtgtgcttgtcttctataggcacagcactaacaaagctagggttgcaaatattctccctctggaatcttatagacaaaactgttctagtgccaccagaccatagccctgtaactagcaggagtttggcatttttaaacccttgttcacaagagggatcaaaatgagaatggagatgtgcattcattcagtgcaactgtgctgctgaaatccaatacggcatgctccaagcagtatgccctcctctaataggcagcaaactactgtttcaactgcctggagttttttcttttttctttttttttttttgagacggagtctcgctctgtcgcccaggctggagtgcagtggcgcgatctcggctcactgcaagctccgcctcccgggttcacgccattctcctgcctcagccttccgagtagctgggactacaggcacccgctaccacgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggctgagttttttctttttaatggcacttacatacttgacctatgtttgcccttttttataacttttttttttttttttttttgagatagagtctcactctgtagcccaggatggagtgcagtggtgagattttggctcgctgcaacctccacctcccacattcaagcaattctcctgcctcagcctcctgagtagctgggattacaggtgcacaccaccacgcccggctaatttttgtatttttagtagagacggggtttcgccatgttggccagactggtcgtgaactcctgacctcaggtgatctgctcacctcagcctcccaaagtgctgggattacaggtgtgagccaccaagcccggcctttttatgactaaagaacaagtttgctccaggttcccaaaagggcacatttagggctattccatggaaaaccatccccccaccattactctttgccagtgctgcctctgggttccttcagggaatttccagagagtagcagaggtcacctagggcccaagtggccctgactcaggttctaacctggtgtgtgtgtgcatgcagtccacgctgcgtcgccggagcaagccggagcggaaggaacgcatcagcgagcagacctaccagctctcacggtggactccgattatcaaggacatcatggaggttagtgctggggcacagggaggaaaaaccaggcccagggcccttggcttgtcagcctggatgcttccagcttcacctgcggcgaggtgctgctgacttcacaggtactgcctccacttgaggatttgcatccaggcctccttcggccctcatggtgccccttgcctgggggtttctgaagagctgagagactgtgaagcacagccccagatctatttgttgttatgtcttggaggactcagctcctataatagagactcctctagggtgccgcatccagaggggtccaagtgtatctcaaaggtcagatgagtgacatcacatctccacacaggtgcagtggctcagcacacttccccagcacggccctgcctgccccgccctgccctcctcctgctgttccctacctgagcctccacacaccagcaaatcggattctgctcctctggccaaagcagccccttgcctggcatattctcacccctccactccccttcccagatcctgctttccatccaagcccctcttgaatcttaccatttccatctgccgccccacctgtctgaccactcagcacacaggggcctcccctggactccttagtgcacatgtgcctcttggtgcctcgggtcgcctttttgtttgttggtcctgtcccctcagctgctgtgtcatctgcacagagcctctagtgcagcaggtgtttttgcagttgttggctggaaggtgtataaggtggtggccaccgcagtagccctgtggggtcactcccttctctccttgtagcgggaagagaccctgcatagaatcctgcaccactagatctttccaacttgattagtgaacaaaactggggtctagagaatgaaggggtttttctcgggatcccttagttaattcctggcagcccaggtgttcctattgaattgtacattaatataaatgtattttaaatatatagagtgagtcagctcccatttttaaaatccacaaactaaaaggatgggtgaacatgaaacatctagaaaccaattatatctctttgcttgttgggatagccaacccctctgtctcattccttcctttgttctctgctcccttttgctccccctcctctccgatcccctaaagagacatgtgtaggcttcatgtgggagctgtaaagaagagtgtggatttctaggcagcaggaggtagatggtgagagtccacccaccagataattagacacttgaaaaacggagggggtaaggcttcttcatgcaggagagacactgcttgtgcctggtttctacaaggctgatggcaagtatcaggaatttattggacagaatgcatcatttataaaacctcacatagattatgaaagtgaataaactggaagagaagcaagaaaaaacttctcttaaaaagcaggctatctcagtgtagcagctagttacaaagcatctgctataactgagccctgtgctaggcacctctggccgcagggaagggagctctggttgttgcaaacctggccatggctttgccaagtgacatgttctacagatcatctggccttggttcctatcagcacttttcagacagatggcaagctaatatctgtctcttttccttctaggacactattgaggacaaacttgacaccaaacactacccttatatctctacccgttcctctgcctccttcagcaccaccgccgtcaggtaggtgaaaatcccttagcaaggacagaggggagccagctctggttggatgtcagctctgcggcagacccactgtacggctgtgtgatctaccagagccctctcgctgctgctccccacagctgcagcgtgggccaggtctgcacagtggtcccacggcccttccccctccagcatcccgttcctctctgattcatccctcacacctcctccctcgctcactctgcatcagccatgccagcttcctcgcacttctcaaacagtcaggcttacgtctgcctcaggaccactgcacttgcttttccctctgcctgaaattatctgtccccagatatgtctgcatgggctgggcacagtagctcacacctgtaatcccagaactttgggaggccaaggcgggtgaatcacttgaggtcaggcatttgagaccagcctggcgaacatggtgaaaccctgtctctactaaaaatacaaaaattagctgggcatggtggcggacgcctgtagtcccagctactcaggaggctgaggcaggagaattgcttgaacccaggaggcggaggttgtggtgagctaagatcgcatcactgcactccagtctgggtgacagagcgagactccatgtcaaacaaagaaaaaatatgtctgcatggcttgcctcttatctcctttggtctttaatcaagtgttaccttctccaatcttccctcaccaccctgtttaaaattgcagtgcatcagcgttcacagctttactcatgcagtccaagtgtggagcagcccacatgtcccccagctgacgagtgggtaacacacgtggtctctccacacagtggctcctgagaacagtcagggctgagcacgcactcgggatggtagagttagcagctcgagagggcgaccctggcactgcagctgtgccacacctggcaccccaggatgtgcacatctctgtccctcctctcctgctttccccacctgtcttctcttttgcgtctcttctctctgtgttcacttttggcttcagctgggccagaggcctgtggtggcctctgtgtcattgtgcagcccttctcatggcagcagaggtaaaacgttttttgccaaatatggcataaaatacaaaatcccaagtagcgccacagtcaggctgggtgatgagaatgggatatcaaatgattgcacaaggaaagaaagcaactgtgagattctctgttggcccaaacggtgccccaaacggtgtcttcctggtttggaaagtgactgtaaagctgtcatgagtcaggaagaaaggcgacgcattgcagtggccagaaaggacttgctcctttcatctcatttttctcattttcttaacctgggaacaacccatttattcctgtttctcagtcaaaggtaaagagctattgaaggaagcccaggttcagagggaggcccctctgggagcagccttgccactgaagtactcttcctccctggcttcgccgcaatttccaggaggcagctcagggatggagaagcctccccagtggtgcccggacagggttccagggcttccctgtgcttggccctatagcacagagctcttcatcagaccaggatttgggctcacttccttctccccacctgccccattcaatgatgacctcttggtcaaggcctgtgtctccttaggatgtggtactggggaggccctggcctccaagaggcactcactcagtacatgttttcaagggatctatgtgccagcctgaaggcagatcttagactgtcatcactgtgcactgacagcagagtgtcccaggcaagctcagaggcatgtgtgacttggggtagacgtctgcatgagcctctagcagggggatgctacagaacttgacccagcaaacgtcagagctgaactgatcctgtctgttgcctgcatgtttctaagagtgacaaggtcacagcagcacaggcattcatagtgactcttctcctgggaaccaatccacttgaaaattgcattgcagtgaaatttcagccagcactcactaagcatctacactgtttggggcacaagtgtacagacctaataagtaaacaaaccactggggtatgaagcactagatgccgtgagtgcagataaactgactgacattctctttctctctctctttctcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggtgagtggccgtgcttccagcggaaggcgccgccgcatcgcacctcaactccattccacgctttggtgtcgcattctgtcatagactcccttgacccacaaaacttagtctttaggtaactgtggacagcagaagctaggggcaaagggttccctccttggtctgccctgctgcatctctcaatggaaggcagcctcatgaggtaggaagtgcctgatcccagggtccggcagactcaggctcagattcctgctctgcaaactgcaagtgggggaccttgagcaagtggttcgagctctccaaccatttccttactcagcaaaacaggatcagtcatactcattcacagccttgaactaggcccaagatgaggtctgtcagtctcctggcattggcctcatgcccaggcaggaatgggcagtgaatggcagtcaatcgctgccctgtcaggtggagatggacagacagctgtgagcaggtgctgcctgaaactactgcctgaccgctggactctgcccagggctcccccagccacctccaaccactttctaggtctgccatgccctttctcgtatttcctgttcgtttcccaaaagagaggaagcgacttgtaggagctagcttaacgcagcaggagccttttctcctttttcgtgccttttgggggcttctatgatgtttagggctggaagaagatgaacgagctaagaaaagtcttgctttctccagatgcctccctttttgtcctgttttgcccttaacaaaatggagggtacctgccagcctgggagtccctctcaacactgtctggcaagaagctgtcatgttcactaccctggctgggctctgtcctcagtggaaacaggctcacgctgagcaaggagtgaggccagggctcttggcctccttttggaagggggtgtgctctgcacagtggggaattatactctccagggccaaggatggcctctcaggccacttacacatgaagtgctacagggagaggccctgagctgccccagctgggaggcatcgctgaccttctcccataggtgcccaccactggtcttaatcccaggcacagtcatgatctcgataacaagtggtggttttatacctcctatttggggtgagcaagtcgcagcaccccccccctcccaagctatccaagtgagcagactccatagaccagtccacatggctgtttctgggtttttcaagatggatctggggctgtcagccgcctctctgatagcacaatccagtggggagactgtacctccccaccgcagccctcaagcttcccgtgtcaggtcaccagctctccacataactgtttttcccttctgttgtgtagccccggtgataaagctctctgctccctgcttgcatatgtattgcatgaatgtagtgagtaattctgagcccaaacacagcttttctggacagaagctgtcacagccaggctttgggtgtaaatcttccccttcatctttagacctgacttgaggttccatatatcgggaggtgggaacctgggggtatgcagttgcccatgaagattcatggaggggcctcgcgcagacagctgacgtccgctgtgtggcctcccctgctttgtgcatgccagcctccttgctaccatgtgtgttcgtgcgcgcttgtgtgtgtgtgtatgcatgcgcacacatgtgtgtgtgtcttgctttctcatacctcattggctgcataaaatgtaggcctaagttggcatgttcctgtgacgtacctttgttcaagcagtcagctggcctctgttctcccacaggttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctttctttgattattccgtcactctttttctttatttcttcctttttagtttattatttatttgattttgtttcaacaagaaaatgcttgcagttctcaacaccgattgaaaatgtgtccagtgctgccctcacagccctgccatgaaccctctgggctctgacctgctggctcacccatgccttgggttccgcactgcttagtcagacgcctgcaggctgctgggtggaaactaaaaatgataatgactgctgtgaacagttgtcagagagggagctgaagttttgggggatgcctgaggcacagtgcccaaccctgctggtctgggatgaatttgtggcccccacaaggaatgtagagtgtcctggttgtgctgggtgtgggggtctgagagcgaggccagtggacattcagggaacaccatgtccaggaaggcaggcggtggtggagatggctggtcgtgagggaagcttggcaggcaatgtagaatagaccccaggtcagtggcagctggacggatggtgtgaatacctttttcctaggacaggcacttctcaaggaataagttaaaaggggtaattgggtcacaagccgccatctgcttggggaaccccaatctttagcgggaagagcttttgtttcatgttcctctgcaggaaacggcacttaacagtcatttgctcttttactaattacttttaattctgtggatcctttcaagagttgagtagtcatacccctctctctcccactgaagtcccttggtaaggtctgagagcctgtcagtagtaatgtatttttttttttttgagacggggtctcgctatattgcccatgctggagtgcagtggctcttcacaggtgtgatcacaacacactgcagcctcaaactcctggcctcaagagatcctcctatctcagcctcctgagtagctggcaccataggcccataccactgtgcccagcataaacctattattaatgctctgtgtggttttagagagcatcttctgtctcccaccaagcttgttacccagaacctattgtctgcttagtagactatccaaattttattttatttatttatttttatttttatttattattattattattttttttgagatagagtttcgctcttgttgcccaggctggagtgcaatggcatgatctcagctcaccacaacctctgcctcctgggttcaagtgatcctcctgccttagtctcccaggttgctgggattacaggcatgcgccaccacacctggctaatttttttttttgtatttttagtagggatggggtttctccatgttggtcaggctggtctcgaactcccaacctcaggtgatccacctgcctcagcctcccaaagtgctgggattataggcgtgagccaccgcgcccagccgactatccaaattttgatcttcaaaactgtcctcattccctcctctctctttccatccttcagatacgatagaaccttctatgtgtttaaatggcagccttccatcatcacatcagtgactccttagcttgttacatattctttcatgaggccatattttgtgtacctgactttgtgtatatcattgacaatggaccctggaaaagccccttcacctgagctgagatgtggcccagtgagtcacagagcatgagtcccctgtgagcattggagagagacctggactcagagccaggaggactggcctctactccagctactccatgggcacctgtgtggctgtgggaagataccctcgctctctggccatagcataggagcacagggagggtggatcgtgtgcccccaggcacgcaggacctctgacattctgtatattcagtgattacgatttgtgcctcaaaccatgcagtcctgctcactctctcactctctggtgatcctcaggggaatggcccttcagaaccttggctaggtgacatcagaagctgcttgtgtatgtaaggaaaatggggcttcctcctaaggtaggaacaggaggctacgctgtttatctcctcctctctcccttccttgatatgaatgtcagggcagcagtgtgctaaggaactgaaagtagttgggaacccagaaagtggacctggttatagccctaggctatagctcccatcctgcctgggctggccctccctagaaagcaaggccagtaggtggtgaataaaagccattgttttaaaaaaaatcattccttagaagcactgataggttgtaaatcagagacatctggttctgtgtgcagactgcaggtaggtggatggatttgctgcagtatgtattttaagacttctagaaagacaaatgttcagtcgagtctgcagcaatagcagaccacttgcaggatctgaaagagcacagactcaaactgcaaaggctcctgctaggatgagttctgagcttccctgcttcagaacaagcttctcctttgcagagtattttcctttgcgttatatttgctcagcagaggtctcagctgccatcaaaacaaagagaacgtaaacagactccgtatattcctggcttctgaaatcatttgctgagtggtgttgggttttagagcattcagttaagcaaggcacagagccctaataccagtgaggtcagaaagcagattaaggtctgacttgccctcttctgttgtgatcgtccaggtgaccaaagtacaggacagtgcagactgtcagaaaacttgagtgtcctaaagaccagtatcatggcagcatatcttttgtgtctttttttctttctttcttttgagtcagggtttcactctgttacccaggctggagtgcagtggcatgattttagctcacttcagcctggaccttctgggttcaagtgatccttccacctcagctcacctagtagctgggaccacaggcatgcgccaccatgcctggctaattgttttgtatttttggtagagactgggtttcaccacgttgcccaggctggtcttgaactcctgagctcaagttatcccccagcctcggcctaccaagtgctgggattacaggcatgagccactgcacctggcccaacatatcttttaggagaggatgagttttcctgcagcaaatgagagggttctcagcagacaccgtgcatgggtgatggtgccatgccctgtcttcccagctcctctccctcctgtagctgacgctggctcccccgaggtcagggttaaccaacaactctcactaaatcctcaccagtcatccctccacattgtctaaaaaatgaaatcttttgattagattttcacctctctgctctggttagtttatgataaaagtactcttctttggggaatgcccaagagactgtgagaagcaaatgtgagagagctgaagactggatcaagtctttgcagtacatgggggccacttgggagagagttggtgggtttttatattgattattttgcttcattccagattggggtcaggtatgtttcatttttctttgggactcagatttgaatctgaattcagagcccacctattgcctggctgctattcaagcatccacctgcccatcccctcccctcccaggggccacagggtcccgagaatcaagagcctggaggcactgcttctggacctgtctgtgccacccaccctgagcaagcacctgactgctctggccttcacgtgtcccatgtgtaggatgagaagggtgggccggatcacagttttccaaacctggctaatgatcatactcacctgggctgctctttaaatgtacacattttctggcgccgccctgcatattctgagtcagtaggtctgcttcagccaaactcaagaatgattggaccagctagcctgcaagaacacttttggttttcagattctgtccgtgtagaaagaaggattttgtcccatcagagcttgcggtgtctggcccacagctttgaaaacatgtagacagtcatgtagatgggcctcaacttagtttttagagaccactgtttacatttcataatcgtccagttatagggactaaataggaccctcagagcaatagggcccacttgctgctttattctggaaaaccaacatggtcagccatctgtggattcaaaatgagaactgtgcaaaatgtggattatggactcactcagcttaatttgcaatgtttatggtggtgaaaagcttgaccaatttattaaaacaacacagatgactgactttgaagaattggctttctgatgatcagcatttacaccagctagtctggtccccttaaagaaaccacgtaggtgaaggcctaggccacagcctgttgctgagggtcttcgaggcttcactgattgtctccaatactcagtcctagaattattgttcttcagtcaagactgggagcaatgaatggtcagtgattaaataatatcagagacttctagtgcattaattccctaacctctctttggcctctcccaaatcctagatttacatatcagcaaagatagggaggactttggaatcagcatctgatcagaggaaccccttcggatgcctcctttaaaatgagtctgccctcttatttcctggagtcatttggatggctaaggagggccttggggacattttctctggcacgtgcgctccttgctgttgcttgtaacgaggaagctcccaagcgaatcctcacgctctgcaggacaggctgtctttcagcatctggacacgtgggctacatggagttgcaatttggagggcccccatcctggcaatggttcactcttcagagtttggggcaagccttgtaatatgcgtcctttctcctcatttgtacagcagcctttggcctcttttaggactagcaggaggagtggtgaggtcacagaaatgagtggacttcaggggaaaggagtgctataaaaaagcccagggacacactcctgaaacctgcatcgcatttgctgaaggggcctcaggtctgcagaatgatgagtcagctttccagcgcagggcccctacaggctgcgtgcacagggcatcatgccgaggacaagttcctcactcagctgggagtgggcagctggggcctgaactgcagagaaagggatgttggaagaacagagacggctttccaagtttctgctagtctggagtgaccaggaagggctgcagttccagcagtcttcggtcagctgagcgagtagttagtggtcaaaggcatagggaccctggtattggagtcatgcccagtgagccagccaaagccttcttttgcctgcccttggggtggaaatccagcatccggtggtttccgctcccctgctcccatgaaggcccattcctttgccacgtctccagggaggcacattttcaagtacgtgtctcttttgttcagttcttgtctcccaccaggacctttctttgaagcacactgctgcatgcgtgcaggcctcatgctcacccacacaccaccccggtcacctctgttctgtttaagtccatgtccaaaccacacgacccatgcatctttttttactgcacttactagatctctctctctctccttatgacaaagactttcatttatttttatttttatttttgcagtagaagtatatctaattccattagcttaaatttttgcaagcatttctaatctcttacaatacgcggtctctgcaaggtaaggcctcaggtcccctggccctttccctctcacacctgaggtcccacccaccagggcagtaccaactggctggctcccagaggtcagtggattctcccagggggctttgcctatcaacttcctctcccaggcaccatgctttccacacatggtccccctaccaactctggccccattttcagcctttccctgccttgccatgtttggaatttctctccctggcttcacctggagtttaagagtgaattagaaacgcagctgcccatcacctgcagatggctctgcaccctgatggtgaggcagctcgttccttggtgcagcctgggaccctgcctgagccagaggatgtgttttgtttatccacagcccccaaatatctcccaggcctattgcgacgggaccccaaccccaattctgactcccctccctgcttccactatacccagaccagggttggggaggggggtgggtgcagatctgggaatcgagaagcgcaggaaaggaagtgttggaaaccagaactggcaagctcactgtcttctctgcctcctccaggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggctccagtctggctttcctttgggcaacggaaggagaaagcttttgcagtggttcatcgcagaggaggcgaccacctccggctgtggcatggagtcttctggacccaggtccccgttgcttgcgttagatctgtagccgccttacactggggactagccatggagcttgtcttgggcccctagcagcaacagcgtgctgcctagagatgaggccattcttccaccgtgtttctccttatctagaatgcttttctttctttccttttttttttttttttttttgagatggagtctcactctgttgcccaggctggagtatgcagtggcgagtctcggctccctgcaacctctgtctcccggtttcaagtgattctcctgcctcagcctccgagtagttgggattgcaggcagccaccaccatgtccagctaatttttgtatttttagtagagacagggttttgccacgttggtcaggctgatcttgaactcctgacctcaggtgattcgcccacctcagccttagaatgcttttctaacgcaggcactgcagggctccatctttgcagatgctccctctccaatcatgtggtgcctgtgtatttagggcatgcagtgagatcacttcaccagcgttactcctctcctcctctgctcctgctgccgtaccacccaccctacgtgtataatgaacttctctccaggatggaaggcggtgtgtgtcctgcttgtcttggaacctgctcctgacctgagaagactgcagtgaggtgggcccagctctcagagtggacccgtaagtgagggtcgaggccacacgggaaacttgctagaatgctgggccccggggagtgagaccctttgtagggacttctgtctctacttctttttcccccatcattctcattctgatcctgatctcctttatagcactgagaaagctaccaactgaagggcagttagtggaatttgcaccaccacagcctgctatagtctggtgagacatgcctcattaggagggaacaaccattgactgaccctgccaggcccctcacatacttgtctgttaggcagatcctctcccattctacagatgaggaagctgaggctcagagagatgcagaaattcagaaagctcactcccctgacacccattgttctgtcttgttgttgttgttgttgttgttgttgttgttgttgttgttttgagactgggtctcactcccttgcccaggctggagtgcaatggcctaatcacggctcactgcagccttgacctcccgagctcaggttatcctcccacctcagcctcccgagtaactggaaccacagaaccacaggcacgtgccaccatgcccagctaatttttgtatttttctggagagatggagtctttcgtatttttctggagagatggagtgttgtccaggctggtcttgaactcctaggctcaagcgattggcctgcctcagcctcccaaactgctgggattacaggcgtgagctactgtgtctggcccccattatctttatcattagttcaccagcaaacagaaggctttggaacgagatccaagactggaatttttaaaattctaaattgttctaagccaaatttacattaaagcaaaagcagcactgtttgctgcttcccgggatcatctgtccctccaatctcctgggagtggctttctagtatctccctggttgtttctgaagtcttctgtcccagcttcctgtcacctctctccattctaccccttcactaccacccaagagcaaatgagtgtggctctttaggttcttggccaaagccctggtcctcctgtgttacccagaagagatggaacccacaggccactgctaaaaagtctccaacggtgttaaatatccttggaggagcagggaattccaggaacaaatgcttggtgtcattccgaggtgggtgcacaggcccccagcagtctctgctgagtcccgcagcctggaccagggcctctggaa

SEQ ID NO: 17403 - DNA, 17348 bp, Human
cgccatctcggctcactgcaacctccgccatccgggttcaagcagttctcatgcctcagcctctgagtagctgggactacaggcgcatgctgctacatccggctaatttttgtatttttagtagagacatggtttcaccaccttggccaggctggtctcgaactcctgatctcaagtaatccgcctgtcttggcctcccaaagtgctggggtgacaggtgtgaatcaatgcgccctgccaggtcattgattttcttaagcctccagccctgccctgcttggaaacgttttgggaagctgctcagttcaaagttcccaggagggtgtgcctggaggggagttgctcccaaagtctgcctgctccccccgccccccctgccccccaccccccgccatcttctcctcctcctcttcccctgagcagcccctttgtccacagaaccggccttttctggtagaaggagcaaggccaagtggtttaagccttcttagggagaatgaggctgtgtggtagtgctggggactcgagggccttggccttggcatggctcttccacccagggcagctggcagccaggctcccaggaggcagaggagatgaggggggaggtgagtccgagcaaaggaaaggaggtcggctgtgcagtcacggttctagaacattccttggatcagcagcatccatatcacctgcagactggctggaaaagcagtctcagaaccaacattataaccagccctgcagtgattcataagtactttaaaaagtggtcaatcatttcagcaaagcagagccacacagtccgggggaccacaggtggcctctgtgtgcttgtctcggttttcctgcccctctccagacatgttgattagacactgccaatgcccagcctcagacctcagtctaatttggaagtagtcagaatttactatgattacataagaccctcgtgtttacagaacacattcccctctctgaggtctggattagatccattttacagatgaagaaactgaggctcagatatttaagtgacttggaatcaaggaaagaatactggactaggggtcgggagggctgggctctcatcccagggttaccatgagcatgctgtggactctagggagtcccatgccctctctgggcttcagcctcaccgctagggtagagaggttgggtgagagaacgacctccttcccaggtctgagctggatggttcaccagggaccccaggctccctggagcagactctgtgcccgctgctgagtctggaattcctttcctgtatcttgcctttggctgccccattcttcatggcccagcaccctgtcttctggtcagaacctagttctgaatgggtttttccagaagttgttgctttcaggggcccctggcagagaggtgtttctggctggctttgtctctctggcatgacaaaggctctgttcctgctggaggcatttcagggctcagtgggcagctggggcagagcccgtgagaccacagccttcctggtgagcccggtctccgccccctaccccatctctggggaaggcgctgaccccatctcttctcccacgctgctccctggctctttgcgcctgattacttctcatgagaggcactccttgttaatgtgctactgagtgtccagatgggcctgctgggctgagcgggctttggatgtgaaccatttcaggaaggggaaccccatcgtcctgttggttctgtgatggcaaatgggtgagctcagataagcagttcttgggaggggcatggtgggggtggagtgcagggggaggggtttctgttttatgcaacagcctcagcttctgggaaagggtccattgtgtaagaccggggctatggcctgtgccccgtggctcagggcagccagcccagtggtggcaggaacactggcagggcagcctgctgtcggcttagaggggatgggcagtgtggagggcctggcagagcaagaggactcatccttccaaagggactttctctgggaagcctgctcctcgggccactgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcaggtggtgctgagactccctgggggctgcagcgctgtggtgaatggggagcgtctgctggggtgaaggtttaggtgcacattgcagaggacgtggctggtctctgggatgcagtccctctgtggaggtggcatggggagggacggatgcatgacctaaggggggtattttcagtgtctgacatgatcgataccactctggacaaggaggccaggatgcagaaagcctgtgtgcctcgctgattgtcggggaggatgtggcttggacaagagcctggttcctccgatgccagggttcttgtttcttccactcaacattgctgtcctgcagtccctccctccctgcacctcctgccttcgctttcattcgaggtgtccatggcaagtctggtcatttccccccatttcctcaggaataaaagtgcagcagtgcctgctgtggggacagctgagggcagtgaggccctggggagctgctgcaggcagcaggtgggcgggacgccagcaggctgtctagctgttcccatgatggtctcctgttctctgcagaggcgtgcaaagactccagaattggaggcatgatgaagactctgctgctgtttgtggggctgctgctgacctgggagagtgggcaggtcctgggggaccagacggtctcagacaatgagctccagggtgagtagaccaagcatgatgttcctctggccacagggtgatgaggtcagagggcagggtagctaattctgctcagtgcctctctatcaggccccagtgttacagaccgtttttatcttgtgcactgggtctgggtgcctgtgtctgggcccactctgagcctcagctccgaggcccctggttcaggctctgcgtgcatcagactgccggcatttgcaggcatttcccaagcactttcggctgttgcatttcattcagctcttcccctcccaggccccttagcccagctcccaggcctcctccacgaagctgtgtctggaccaccggagctcttatccctctcccctttggagtgcccagagcttatccctcctgtgagctgacggtttctgcaggatcattgttaaaaacccagatcagacatgggtgtgagtctgtttcacctcttctcagctgggtgactttgggccactatcttgatctcatgacactccccccaccccccattttattgagatataattaacaaataaaaattgtgtatatttaaggtatatgacgtgatgttttgaaatgcacatacattgaaatgatgaccactttttatggtgggacggtgggaagacttaaaatctactttcttagcaaatttccagttatgatatggtgttattaactataagcaccacctgtatgttagacctccagaacatactcctcctacctgatgaacactttgaccctttatcatatcacacttcccatgtctccctctgcgaagtgggcacggcggggggctggagcattatgtaaactgcacatgaagtgtttggcgcagtgcttggcatgggataaacaccagtgaagtagcacttaggtgacacagtgtttcgctgcatttgtcaccagtgctataccttactcatttactcatcttcttattcctgtcgcctggcactgcattggaacaaagaaatacacatatctgtttaaactgaactctagaaagatttgtgtccaaaataacaatattttatattttgatgctgcaaagctgacacttctgggtttttttttttccttgccaagtttcttctgcacccagctcattctccaggggcacatggcagtggctgggcataactctgggtgtgccggctcccatggtctgcatttctaagcagtagggtgcagtcagcaaggagcctgtgatgggagcctgtgccagggcaaggctggggccatgctgctgcctgctggcaggagtgggggtcccagccttgacagcccctgaactgaacgggcctttctggccatccagctcattccagggtcctgaggccacctcttcctctcgcctcattctgcctcttgcacttctcttgcagaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggtcaggaggagccgctaccgcctccctgccttgaccatcccactggaggggagggagggggtcactgcgcggtgccctgctgggttgccatggtgacccgcagtcctcccaggctgtgtcagctgatgctgaggctgcaattaagaagcagggaaggttcatttgcttctgaaagcatcagggagtgagatcttggatctggttttgttatgagcctggcccagggcctaatgcccagattcatttcaatagatgtttctaagccctgatcacatgctagttccaagcaggctctggatggggtggcggcaggggcccagacaggcgtggcgtccaaccttcaggaagcttatctaataggggtgatatggttagggttaaggcaggcacacagcaccccacgtcttgctagagttctggactacttcataaagaaacatcttaagcccagtagtggatatagcaggtctagcctgtgcttaatgattcaacaaaactaaaacactataattcaatgaacaacttatttaagaaatcaagtctccttaagagtatcctacaaacctcctctcacggtcgccctacttcagatgctaagatgtagctacctgcaagcttcatgatccatcgtgcatgttaaaagcatttcaaaggctctgagaagttctgccgtaaagaaacctgtgtaactccatgaaacccagagttttccaaactgaccagggaattcatttttgtttttgtttttttttcctggccgctttgagcacagctccataggagccacttcagggattgctggcctggatgtggctctacctttttttcaagtttcatgccctttcttggccttagtatcagttctcaccattctatgagaatcctcaaatagctcctggggaaggggcatgacttgttctcacatttttgtggttatcactggagtttgacattcaacaattctggttttataataaagcacatcacatacatttggagaaaagagcctgctacttcttagttgaggagtaggtgagccagaaggcaaggaagtaggtagcaggggtggcgcttgtgtcttggctcagtgggaggtgggttgtccttgcccagcaggggacaggggatgatggagcaggacagagacctcacctaactctggggtgtggataggctatttttttttttttgaagactaacacactcattcatagagactttaatatagaaaagtagaaaaggaaaagtttttccataatccttttgcccaaggacaagtcactgttaacatttgatctatttttcctattattttcttctatgcttttttgacagtggctatatttaaaattatgaatttttaacatataatattcaaaatggactataaacatcctttgtaatgatgtaccatctaccctttatatgaaccatagtttgtttaatctgtctcttttaagcatctgggttggttctgatttttttttttttgccataagctaatactgtttcaaatatttttaagtatctttttctttgtcaggggattcctttgagatagagtctttgttttgttttgttttgttttgttttgtttttttgagacagagtcttgctctgtcacccaggctggagtgcagtggtttgatcttggttcactacaacctccgcctcccaggttcaagcgattctcctgcctcagcatcccaagtagctgggagtgcaggtgtgcaccaccacaccagctaatttttgtatttttagtagagatggagtttcaccatgttagccaggctggtctcaaactcctgaccccaagtaatatgcctgcctcggcctcccaaagtgctgggattacaggtgtcagctgccgcacctggcctgagacagattcttacagaattattgggtcaagtggcaagggcccgttagagaattttgatagctggtgtggctttggtgctgaatgcctgccattccctttgcacgccaggaggcatggttgcaatagaaaggtaagattcagggagtctgcagcctgctttggaagatgaaatttaaacaccagaagcagagaataggaaatgaggcttcagtgagagggtagtcattgagtaggtgatcagagagagaggtggtgtccacatgggttccaggagttgggaagcttctaggagttagggaacagttggatcttgaaggatgagtggattctttaagccaggtgggaaggggattccaggtgggcgaatgaggggaagcttgaactggagcaagggtaggcacttgcatgctgggtggccagcctatgggaaggcctgccctggggcagagggcctggcacccagcagctctttgagtgcatgagcctgtggtctctgtgtggctcagccagccttgtgtcttcctgtaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccaggtgaaaaggggacacatgagtggccaaggctctgagtggggaaggaggggagcctagtgaaatatgcttcattccgcatgccagatgcaattgattagcattggctggcttgcccagagtgccatgctccattggtaatgtctggcatgagtagagagagtggagtcatcaaaaggatgtaggccaggtatctgccttctcttagaaaactcatgcagcagtgcttagctggatgacataataaactgcttcgtgggatggcagagccctgtgtccacttatgtggaaggatttaagaatttttttttttttttgagacagggtctcactctgtcacccaggctggagtacagtgatgtgatcatgtttcactgcagcttcgacctcctgggttcaggtgatcctcccacctcagcctcccaagtagctgggactacaggcacgtaccaccacacccagctaatttttgtattttttttttgtaaacatggggtttggccatgttgcccaggctggtctcaaactcctaagctcaagtaatcctcctaccttggcctcccaaattgttgggattatagatgtgtgccactatgcccagccaatgtaagattttgtagtatattagtgttgctcctgtcctctgctgcagggcttttttgattgggactcagtgaattgctccaatccctgaagtcacatcagttggcccttagccgagcgggggtggatatcattggtggccaaagatgacagtgaatgaacctgaaatgttgggccttgtgacttttggggcctcccaggtgtctcaaaactgtcccccatggagggagataaaaggaaagagcatggacctgacagatggggtgctgggggctggtcccagctgggctgttggtcacttgctgtgtgactgttacagccatgggcagggcctggcctggctcaccagggggtgggaggccaggaggccgtggccttggtgagcttctcctaactgtgcccatgctggctgtcccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgaggtgagaaggggtggaagctcatggccttttgagcaactcgttagatgctgagaaccatgccgagggctcagcgggtgtcatctcgatttttctccagcaatatcacaagggtgatattatccttatttaaagaggaaaaaaactgagctgggcatggtggctcatgcctgtgatgccagcactttgagaggccaaggcgggaggatcatttgaggccaggagtttgagaccagcctggccaagatagtgagaccctgtctctacaaaaataaaaacttaaaaaattagccgggtgtggtggtgcacacctgtagtctcagctactcgggaggctgaggcaagagagtcacctgagcctggaagttggaggctgcagtgagctatgattgcaccattgcattccagcctgggcaacagagtgagaccctgtctgtaaattaaaaaataaataaaaataacaataggaatcagtggagtccatctctgcatggctggatgactgactcttcttccctcgtgtgtccccagaaggcgacgatgaccggactgtgtgccgggagatccgccacaactccacgggctgcctgcggatgaaggaccagtgtgacaagtgccgggagatcttgtctgtgggtgagtcggggtccagaccacaagccgtcccccctgatcccttgtgtcctggggtcactggggcctcactggtgctgcctttatggagtcagacagataagcgtttggattccagctctgcagcctttgagctgtgtcccggggcaggtcctgagcctcatgcagcttcggttcctcatcttagaatgagatgatgatgcgaggctgtccctgaagtcggtgagatgtcgttagagatgcaaaagtgccctccacctggtcggccccatgttgaaaaaagcttgttgaaaaaagtcatccccctgggactccccggtgattctgttcccaagcgccaagcgcagtaggcatcttcattttcctctgcagattatgacattgcagacagtatgtgttttgtttaacaaaactgaccagaggccaggcactgttctaaacactcgacatacatttcctcatttcctcagaatgaccctctgaggaaactgagccacagaaaggttaataacttatccaagattgaccccgacatgggcgagctgggcttcaatcctagggcgctgtgttctctcctggggcccctcgcagcctctggccacagaagtcacgggtctcagtacctgggcatccaagcaatagtccctttggtcggttggttggtcccctaggcaaagggaatatttccctttaactgtccccctccgtttcaccagctctggttatgggttaacttctttccacttagagataacagctgtgacagtatttggactagttcctggtacacagcagttcatactcacaaagagttaattgtttccccttgtcaacagcttatcgatctggtggctttgctcttacttaatgcttagtttgagtttgccatggcaggccgccagggtctagttaaacattcctagcctcactcctataattttagaagccactgcaaaataaacagttgtgctttaacaggctgaagtataagttgctgtagatgagtgcacaaccaggccttggggctttttctataaaaaatatcatagagtggcatcaattacatggtacctcaccacaagaaagtcatgttagggtctgagaaaagatgtccagatgcctgtgcccagattggacctcttatgctgatttttactctgttgcccaggctgggctcaggtctggcgccaatcttaacagtcattgattacagttgagagtgcagccagcgccagtcttatcagtcattgattatagctggcgtacagtggctctatctcggctcactgcgacctccgcctcctgggttcaagtgattctcctgcctcagcctcccaagtagctgggagtgcaggtgtgcaccaccacacccagctaatttttgtatttttagtagagacagcatttcactatgttggccaggctggtcttgaactcctgacctcaagtaatctgcccgcctcggcctcccaaagttctgggattacaggtgtgagccactgtgcctgacctgagatagattcttagagaattattggtaagaataattctctaagctgagctaaatagtctacactgaagaggactgcctactgttatttaaggtgcttgcaaccatataagcacgtactgcctgggaactctagatgaggatttctcaatttcagcgctgttgatttttttttttttttttgagacagggtctctctctatcacccagcctggagtgcagtggcaccattacagctcactgcagcctagacctcttgggctgaagtcatcctcctgcctcagcctcctgagtaacagactacaggtgtgctccaccatgcttggctaatttttttatttttagtagagatggggtcttgctacattgcccaagctggtctctaactcctgggctcaagtgatcctcctacctcagcctcccagagtgctgggattacaggtgtgagcagtgctgacattttggaccaggtcattctttgtcgttgggggctgtcctgagcagttcagggtgtttggcagcattcctggcctctgcccactagaggtcagcagctcccttccctttgttgtgacaaccagcttcagaacttgctaaatctccctgggtgacagcgtcaccccagtagagaacctctattctagactaagcctcagctctcaaggatttttcttattttattattatttttttaagacagggtctcgctctatcacccaggctggagcgtagtggcgcaatctttgctcactgcaacctctgcttcctgggttcaagcgattctcctgccccagcctcctgagtagctgggattacaggcgtgcaccgccacgcctggctaatttttatatttttagtagagacagggtttcaccatattggccaggctggtctcaaactcttgacctcaagtgatcagcctgcctcagcctcccaaagtgctgggattacaggtgtgagctagtttttcttatttttaaatttttttttggtaaaataatgaagtttatttattacatatttattttcaaactggcatcttgttagtaattctgtttctttccccacctaacattttgtttactataaatgattgcagtcatcatcctaaagcatatgcaaaatctcccttcccctgactcacgtttgatgtacctgcctctggatatttttgaaataccttagggggagaaaaacagtagttttaagagctagtggacagtttccaggtcttaatgaatctgacaacctgcagcccagggccaagaggaatgaattctcttttccctgctctcttgatgaactcactgaccagccatgggcgggcaggtgggcaggcaaggacccctggccaccaggtgccagtgcatcagctgcatgaactcctggcaccagaactgccacctctacagacatgctcaaaagacaagtttggaccgggtgcattggctcacacctgtaatcccagcaccttgagaggccgaggtgggtggacccctgaggtcaggagtttgagaccagcctagccaacatggtgaaaccctgtctctcctaaaaatacaaaaaaatcacccgggggtggtggcaggcacctgtaatcccaactactctggaggctgaggcaggagaattgcttgaacccgggaggtggaggttgcagtgagctgagctcgcgccattgcactccagcctgggaaacaagagcgaaattctgtctcaaaaaaaagacaagcttggaggattgtccagaaccacagatccagggtaggaaaagcccaagcttaggagctgaagaccctggttcaatcccgggcccagagatcatttattctatggctttaggtaagctatttattgatacttctgtgggcctcagtttcattattggtaaaaattatttcattattggtaaaattaggacttaagtcctaatccttaagtcagaacagatccaattcttagagaaaaaggatatccagagagaactttctgcggtgtctgggacgaaggcagtgccacacgaatggcagctgtgagtaatattcctcctctctggaaatgattcccgggagggactagggcaacgagagccactccaggtctgagaacatggagaacttgagatcagtgcttttggaagtgtggtcaacacagtttgtcaccaaagagataagggtctggcacccaaagataaatcaatgatgttacgaagcacactgtttaggtcagttggcgtatttttccagagcaaggcttctcaggctgggcgtggtggctcacaccagtaatcccagcactttttgggcagatgggttgagcccaggagttcgagaccagcctggacaacacagagaaaccccgtgtctacaaaaaatacaaaaattagctgggcatggtagcatgtgcctatagtcccagctactcaggaggctgaggttggaggacagcctgagcctgggaagtcaaggctgcagtgagccgagatctcaccactgtattccagcctaggcaacagagcaaaactctgtctcaaaaaaacaaaaacaaaaacaaaaaacccaaaagactttctggatgacggaagcagtgtctagattcacattctgaggcaaaacctttattttgtcgtggacaattccagtttgtggcccttcccttagggaagcactgcttttgttcccgctgcatgtgctaacttccattcattcatggttctatccctttgtagccttcccttcacacttctcacttgcgtttcttccatctctgggcagactgttccaccaacaacccctcccaggctaagctgcggcgggagctcgacgaatccctccaggtcgctgagaggttgaccaggaaatacaacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtgagctgtgtcccggccacatgctgtggctcgggagcccgagctgtgatcgggagcaggggcatgtgtgcttttgactgagcatttatcacacggcagaaaatagaaaactttaggcgcccctgttgccttgaagcctcatcacccactcagggaaaatataaccctgctttacaaaggagcaaagtaagagaggttccacagcttggccaaggtgtgatagctgacagatgacttggacgggtatttgaacctgactgcctggctgccaagcctgtattttgttgttgttgtttttgttttggtgcacaaatctgtgaataaaccagaagcctctgttcttttctcaaagctacaaggctgccctctggcatgtaaaatggcttatgaattagtacatcactctctgccagtgataaaaacttctctctaggccagacatggtggctcatgcctgtaatcccagcactttgggaggcagaggcaagaggattgcttgaggccaggaatttgagaccagcctgggcaacacagcaagattccctctctacaaaaaatacaaaaatcagtcaggtgtggtggcacacacttgtagtcccagctattcaggaggctgaggtgggaggattgcctgagccctgaagtggaggctgcagtgagctgtgatcacgccactgcactccagcctgggtgacagagtgagactctgtctcttaaaaaatatatatatataaaataataaaataaagttaaaaaatcaaataaaacttatttctagtactgggaactcttctttttcttttctttcttccctccaggccctctggattccttttctaccctactctgaccaagggctgcttctaaagcaaatgtttggaaaccacttttattctttggggtgctccctgggctggtcatttgcagatgacatttgccccaacacatgagtgtctgtgaaccaggtccgttctgtccactgagctgtacttacgtctagatgtataagaagcatggggtcagctctctaggtttccttggagaagcaggaggacttccttatcagaagcctgacttctgttgcagagcgcatgcattttgaccacagtgtttcagctcttcccttttctcttgttccatttaggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccggtaagcaggcgggcctttcctgcgggcctgcagggcccagtgagtctctgggagccacaaaaaaacaaacaaagtgcagactctatagcctggtgggaacgactccgcccggagccagagcccaagaacaaagccaggaagttacgggggaattttatttttcctttggaggatgttttactttggaggataactgttttttatttcagggaggagtgagatgtggatgttgcttttgcacctacgggggcatctgagtccagctccccccaagatgagctgcagccccccagagagagctctgcacgtcaccaagtaaccaggccccagcctccaggcccccaactccgcccagcctctccccgctctggatcctgcactctaacactcgactctgctgctcatgggaagaacagaattgctcctgcatgcaactaattcaataaaactgtcttgtgagctgatcgcttggagggtcctctttttatgttgagttgctgcttcccggcatgccttcattttgctatggggggcaggcaggggggatggaaaataagtagaaacaaaaaagcagtggctaagatggtatagggactgtcataccagtgaagaataaaagggtgaagaataaaagggatatgatgacaaggttgatccacttcaagaattgcttgctttcaggaagagagatgtgtttcaacaagccaactaaaatatattgctgcaaatggaagcttttctgttctattataaaactgtcgatgtattctgaccaaggtgcgacaatctcctaaaggaatacactgaaagttaaggagaagaatcagtaagtgtaaggtgtacttggtattataatgcataattgatgttttcgttatgaaaacatttggtgcccagaagtccaaattatcagttttatttgtaagagctattgcttttgcagcggttttatttgtaaaagctgttgatttcgagttgtaagagctcagcatcccaggggcatcttcttgactgtggcatttcctgtccaccgccggtttatatgatcttcatacctttccctggaccacaggcgtttctcggcttttagtctgaaccatagctgggctgcagtaccctacgctgccagcaggtggccatgactacccgtggtaccaatctcagtcttaaagctcaggcttttcgttcattaacattctctgatagaattctggtcatcagatgtactgcaatggaacaaaactcatctggctgcatcccaggtgtgtagcaaagtccacatgtaaatttatagcttagaatattcttaagtcactgtcccttgtctctctttgaagttataaacaacaaacttaaagcttagcttatgtccaaggtaagtattttagcatggctgtcaaggaaattcagagtaaagtcagtgtgattcacttaatgatatacattaattagaattatggggtcagaggtatttgcttaagtgatcataattgtaaagtatatgtcacattgtcacattaatgtcacactgtttcaaaagttactttttcttttccactgttatgttgctagactctggaactcactatattcagtgggttttttggttgctgcttccccccccccccgccccccgagacagagtctcactctgttgcccaggctggagtgcagtggtgcaatctcgggtcactacaacctccacctccaaggttcaagcagttctcctgcctcagcctcctgagtagctgggactacaggcacgtaccaccacacctggctaatttttgtatttttagtagagacagggtttcaccatgttggccaggctggtctcgaactcctggcctcaagcgatccgcctgcctcagcctcccaaagtgctgggattataggcgtgagccaccgtgccaggcctttatatccagtgttttggattttttttttacactcttaaatactagcaccctgaaagacagatcctaaagctggctctaaagcttcctgagaccccttctctgcacctccttacccctctgcacagtggcctggggttgggggtccttagatgtctctccatccctgacagaggttccaacatgaggcactgggaagactgagtcagcacatgatgtcaccaaggtgtggggatgagatgaggctaattctgcctgggggactgcggaccctgagcccttagtgtctggcttctaggactcttgtggcaaagggggagcagggcttgatgtgctgagaagagagggatttgacatctgtctggaaagggaggcagcaccaaccctgctgagcccctctgttgacactcaactgtcatctgccagaaaattgtaataagatacaatctctcatgggtacaaggtgaaacggtgctggagttgtgcagtgcatggcttgtacaactgtaaacagtggccttgggccaattacttcatgtaatctcact

SEQ ID NO: 17404 - DNA, 137753 bp, Human
tagtgtcttttagggatttccatggaatttgagggctcctgaggcatttctgatgggtttttttaaaaggcagtaacaggcagaaatgcatgaccttgtcacctgagttgcttgtacatgacactggacagaacctagggagacctgatggcggagttggccaccccagagagtttctcaatgtctttttcatttaaaaagctatgggtttatgattctgtgaggtagatttgggagattctttttttaaagtgctgaagaattcaacaacctctgaaaactcacctttcccagaattggtcccagcaagataagattgtagttcatttatgtggccacacaggggcagcacacacaaactctccttttcttaaacaggtcttgattgtctttgcttttagttcccactgccacctcctagtacagactctcaacaactcacccaggtatctaacttttgtgccactcagccttcatcacttcatttccaagcgcaagaatacggaggggacacccactgtcagatgccctctgaccatgtccttgccatgtagtcaattacctgcctcctcatccccacaccttccctgctaacttcagtgtacctctgtctgacttgcctctccatccctggccaagttctcccacctgaccaccttctgacctgctgaccgctgtgtagtcaccaagattacctccaaaatgctgagtgctgggaacgtgacaaatctgtgaatagcacaaatgggaaggggtgggggggctccagctgtcaaggctggcagtgcccatcaatgggttgtgagccccatgctgggcaggtgggccctagctgcagagagtctgatcttcatcggacccagagtgacatccagccaatagctatgggtagtccactaattatactttgagaaacattgacttcctagctttgttaacttatctaagtctccagtttcttttcagaaatgggaaggagtcagtgcaatcttggaaactgagtgcttcctcagcacaactccagggggcgccattctcagaaagtacattgtgaatagcatcctctagaattgtgcaacagggcagctctgggaatcagattccaatcctgcacaggacacagaataaagaagcttgggacaggggctctggagaggacattgtaggatgaggatgatgctgcgtacactccacttttttcactttatgccaagtccaggtcacttcctcctcctactcaggagcaagtctggagttttcctagggatagggaagaagtgttgctaagtgcccttgagtgcctgctcacatatcaccggcctgaggaaagaggggaccagcctctgggcggggcccctggaaggggctgtccagcatctctaactattcttgtgctgtcctcagaccctacttagtcacagctcagggacctggtcttctgtgttcagggacctggaccggttctgccaaaatccctagtggtatttatgatttttcatgcctgcaaagggactggggccactttaggacatggagagattaggacacaagtgctcagtaccatgtagatataacatctcccactgcggggggtcttgggagaaccagcctgagaagttggtttcctccgcccgccctgcgcccccacccacctcacacacaccttttggcctccaaaaggctgcaggtggagtggacagaggatggaggggtgttaggaattggggagttaactgctcacaaggggcacataacatccgaggatcccatttgcggccgggggaatggcagagatcgccccccaggtctgcccggcgctcagggaattggtggcagcgtctatttcagagtttatggtaagaggctggagccggcacacacagacaacacaccccaccctttaaggaagtggggaggagagcagcaggggtgtggttaacaactcagaggaggagggagaatctaacctgtcagcccttttactcagccacagcctccggagccgttgcacacctacctgcccggccgacttacctgtacttgccgccgtcccggctcacctggcggtgcccgaggagtagtcgctggagtccgcgcctccctgggtgagtccctcccgcgagccagggctgagcgctgcgcccggcagaagttggaggcttgaccgggtggcaggggttggggacaattccgggatcctgggcacctgagctgggagttcccggagaaacggccagacccaggaaatcggagccgtgggtgctgtgcacatgcccggagctcgccagccttccgcggggaagaggggttctatttttggagtaaatttgacactatagggtgtttctccctctttgtcctctcaacatattcagacaggggaggctgggggaggctaggggtgacggtgtgagggcacagccaggctgctgcctctaaagctcaggttagggagccacggggtttcagctcctgcccccgctccccgctccctcccgggcccttccgcagccccaggggttatagtctcacccccagcccaccctgactctcctgcagccactccttgcacctgagaggtcatcttctgaatcaagccctggctggaggaaagcaagggtgttctggggcacaggggagctcgtgtgtatgtgtgtgtgtgtgtgtgtgtgtgtgtgtgtgtgtagttaacactggccattctggtatcttgagaagccgcctcctgagtgccactcaagggttaagttcagagctgcctctgcctgctgtcaggctgcgcgtgggcaccgctttgggtgggtgagcgtggagcggcatatgggtgatgttctgcaagccctgccacctgccctaagcctcgaccacatgacactggcatctccctataccccaaactgggagcaaaatccaagtccgctcatttaaggagccagcagaaggacaagagcagaaagttgtgcctagaggtggctttagccaggaggaactcggaagctgcgctgtggctgggtctgagcccactggggcagtgcacgtggtgtgatgtggtggtgggtgctgggaggcccctctacgtgggatgctctctgttcaccccaagtgctgttgctgaaggccctgtctttcccaaccactctgggggagggggaggaggacactgatgaaaaagtgactaaagacagaagggaggaaggaagtagtcacactggagagccccagcattggtgggacagtctgcagtcatccattcaggaggcactcactggcttcccacctgcggccaggtgcaaggtgtggggacaaggtgagtgtggcatggcctctgctcaccagggcagtgtgggataccgggtggttgagggagggctgccaggggaaggtgcagggtactatccaaccctgcactagagggctgtggggggagccagtcagcaatggccaggagggcgtcctggcagaagtgactccaaattgagagctgaaggatgactagaaattagcacaagagaagaggggaaagaacagcaagtgcagagactggaggctaaaagcagcaggaggctggaagcagcgggcggcatccaggaaaatgaaagtagctgggcttgttgggaacctagagcgtgcaggggcgaggggaagctgcaggggtgagtggagactgctctagaaggctttggaaggcctgccaggctgccatggcaacttctgttggagcaacacttgggacctggagccaggcaggagacttcccagcaggaagagattgccagatttagccaataaaagcacgggacactcagatttgaatttcagataagcactcaatggttttttttttcactacaaatatgtctcatgaactacatggaacatacttatactcaaacattattcactgtttctctgaaattcacatttaactgggtgtcctgtatttatctggcaaccctactctaggagaagctgaggttggcgcaatgctgtgaagtaaaggctggaaactgcccaggcactctgagaacagtctcaggtctatcttgtaaccattcctcctggattttattatgagctcatttaaaaaacaaaaaatcaattccttggtcagtttattcatctatacaggtgaaggagtatggtacctcagaaaaaacgacattaaatccagacagatctgggttcaaatccatgtagaccggtgagcttctctgaccctcagaatcctcttttctgaaatgagggcaggagtatctgtttgtgcaggtggttgggaggatccctgataatgtatgtaaattgcctagtgagtactaaaggaaacatggtacatattgaattttgcaacaccttcacagggttgagcaaagcaacagccacagagtgcttgggttcatttacttccacaagtgagcacttggaggtctcaggtgaaatacatagtagggttcatgcttccagtgagaactcgtggggttagcccttgggttggggacagagtctgcattatgtttttagctttgctactcccttcccatatgacctgcttcaaggggtggagatataacactcttcttgagggatggtgggtgggcagagagtgactcaaagtagaattaactgaagggaaatgtgaatgaattaaagtagagaatccagataaaatattcagcgcagacaaatgcgccatgaaatttggctgtcatgattcccagttttaggatgagttccttattagaaaagtagcgctaagagatagaggaagtgaaggtgccttatgaactggattttgactttaatgggagcatttgtaacaacaaattagggtcctcctaaaagggaacctagaggaagttaagaattcgttaagagaaagaggaaatggaaagtgtgtttcccttgtgggaacggctaggttaaaaatggtccttctttccagtggctaaatctccccatccccctgtgataaacattttgtccccaggcccttggattgtttgcccaggtggtgttgagagagaccctatggcgtgagatggatagaggtgttccactgatgaaacgttcaaatgagcctgcacttggacatgtgtcttgaatatttgcaagatcaaggttatgataagtcctgcataaaaagacacgtgtcattccctgaggatggctgtagagcccatgcacattctcagggaaacagcattccacattgagtgaaccttgatgtgagggcagtttggggaccaagcaggtcgttcagaaggcatagcccttctcataactctagccaggatggacctaattcattctagactaggcagtgtccaacttagagaagatcttcaaggaaggagcccttgcgtgcaacctttttttttttttgagatggagtctcactctgttgcccaggctggagtgcagtggcgcgatctcagctcactgcaacctctgcctcctgggttcaagtgattctcctgcctcagcctcccgagtagctgggattacaggcacgcaccaccacgtccagctaatttttgtatttttagtagagacggggtttcgccatgttggccaggagggtctcaatttcttgacctcatgatctgcctgcctcagcctcccaaagtgctaggattacaggtgtgagccaccgcgtctggctgtatgcaatctttctagcatcatgcatccttcagagacacaaactcccacctgtatcagcctgagtcttcccattgcagatccggccatgtttcatcgtgcagaggaccctggagaaagtccaagtcccttggcacttagctctccatagtgacgacagtagctccatgtaccccaaatactgctaggacaaaggaaactgatggtgaggctagggaggggagggaggctaccctggggctaccctgcatggtaggtcactcagtctctagtttcccctgcctgggacccatatgtctcaggaccatgtgaccctggcctcccaggtaaatggccacattgggggatggagtagaggtgcagagctgcgacgtgcccggggctgaaagtgtggtgatgaagataagttttgctggcttgaggatgaagagtttccttgtagagtacgggtcagttccagggttaaggagaaagagcagggatagtggtgactctgcaacactgatatgccttatctgtccaagcagtcggatggtcaagagctcaggctcagtcagtctgcctgggttccagcccaggtttggtaccccctgagtgacgttaggtaggtgagttagccctagcttcctatttgcaagatggagacaataacagggctttgggtgagggtggcatgagatagtgtacattagagagatattcaaaatacagctactaaaacctgagtacagatcaaacagaacagacaccaccattactctgagcagcgtcagagaggcccccttccatgccaggctcaccccgtcagtgcatcttgtggagtctgggggtggaagaaacaggcctttggagggctgtagcgtggacatatccaacgaggatggactgtttcgatatttcaacaacccagatgcacccgcttaataatagcatcttatgcacccactgaataataatagcgtcgaagtacaataaaacattcagtcccataattaggcagatgatatgcatccaataagtatgagctctctggtatctttacacatatggccatatctgagctggcggggcagcaccatttatttttccagaggttataggtcctcttctgcgaggcatcaggcagcttcccctgagcactctctcacaagcatacatcaggtattcaatgatgtttgtttctgcctaatcccactctcagttcactgtgttttggcaacagccagccctcattaactctttagacagcgaagagactgtctacgaatgcccagccggcactgaagtctagatggtcatttaaagcgttcagagagctgacaggtaggagaaaatggtggcttcactttctgggcctcctaactctgtgtacaaagctgcgagctgtgcaagggggcggcagagggggaggggatagctttttgagtcactctgctatttctcaaggaataattattactcatggtgacagtttattaagaagagcagacttgaggctgcatgttccgacacacttttcacccagatgcagcgggcaggttggtgtgaatgcagagtttaattttcaggagaccctccaggtaggccacagggggcctgcaggggtggacgctgctctgagtttagtggtcttcgtggcctcttaccttttcccagcactaaggtggttgctgcttttatgaggcagccagttagtgtgactaaaaccaagatcagcaatggccaatacctgcgggaggcaagccttcccgtttcctagcttggctgtgttcgctaacatcttccccctctccagttctctctcttccttttatgttctgaaatccacccacacagaatctggtaagatcactcactagagacaggagggctcaaagaatccacctcgcccagggtttagagctcggtaccaggtttaattcacatctcctgcatttgtcttcctttaaattggaccaattctcccaataattgtgggggcagacccccttttaatgccctttctttcttgagggccttgcacctgattctgtgagaacctgccccccacaagccatagcagtcccactggttcatatgggggtgattgatggggaggggtgtactgggaattctgacctgagtttgggttttgctcttctgggggttcccttctcacctttctcacctgggacggaatggcccctgtggtggttctgaccacttggagcaccatcattttctggtttttttttttcttttctttttttgagacaaagtctcacttgggtgcaggggcatgagccaagactacaggcacatgccaccacacctggcttattttctttctacaacctctacctcctgggttcaagagattctcctgcctcagcttcccgagtagctgagattacaggcacccaccaccatccctggctaattcttttatttttagtagaaacggggtttcaccatattagccaggctggtctcgaactcctgacctcaggtgatccactcccctcagcctcccaaagtgctgggattactggtgtgagccaccacaccctaaattaatgtactgatttagggtttctgatttctaaattaatgtactatgtccatcccactgctctgggaacctcaagtgcttttctatgttctctggcagtatttggagtcaaaacccaacccctctcacccagctccatgtacccagtccccgcccccaggtcccaccccaggtaggttatgagagatctgatgctgctgcactttgcacctctgcagaggctcttggcaacatccggtcacatcccctccgctatttaggcagatgtttggtgctggcagacagcggtgccaaccaagacagctgcaagtggctcactgcaagtttgaatcccagcccctagctcattacaggcagaagctcaggcagtttttcagcccgggcaagaggaaagagagtcagagggcaggaggcctgagctttggtgtagattctctcacctgttaactggggtacattggctaaatctctttcctcttcaagccttccttttctcatttgaagatgaagaattggtactgcctccctaatagggtaatggagagaaatacttgactgtgtgaaaatcccccataaaacatcacaggcattgtcccaggaaaagtgatgaatttgggatcagaacgtggtgggtttgactctcgactctgtcatactctgcctgtctgacatcgccaagtgatagaacctctctgagccttactttgctaatttgtaatttgttctaggcacttgttgaatgtttctccccatcaccccctttactctcagggtatagtttttcttcccccaatttttttttttatctcatttcgagacagaatctcactctgttgctcaggctggagtacagtggtgcgatcacacctcacagcaaccttgacctctcaggctcaagcaatcctccggcctcagcctcctgagtagctggggccacaggcacatgccaccacacccggctaatttttaaaatttttgtagagacgatgtcttgctatgttggccaggctggtgttgaacacctgggctcaagcaattctgcttcggcctcccagagtgttgggatcacaggcatgaaccaccacttcttccccctaatttgaggaattatatctgtcctcacaaagtttatagtatggtaggggaggcaatacatgaagataaagaactgtaagatatttatttaactctaagttacttaaaggtaaataatgtgccataaaagaggcacgaagtgctatgagattgcagggcagagattccttctggctatggactctgggaatgcttcctggaggagacggcatttggcaaagctctgaaaggatagacaggatacactgtgggaacttgagatggtggctgtagtcaaagaagagtataaataacagcagagagatggagaggtgtggtttgagtgactcattttgggtggaaccaagagtggcaaaaggcaatcagagttgggggtggaacggaagataaggcttggacagggaggccaatgtgtttgggagttatcctggaagtcccagacagccatggggctttattctgaaggcagtaggagctgttgaccatgctgacttcggtggaggtgcgagggtcagattctggtgtgtagagtggatgagagtgaagagagcttgaattcgcaagggagcagataagagagtgttgtaatatttcaggcctcacacatctgaataaattgcgtaactcagatactttgcggtcctgtggagcatgcaggcatcccctggaggcttctactttctctgagctgaaattggttctttgatgaatttgagagatatataacttatgagaacatccatgagaaacccaccattcctcttcacctctgtcttccatattcttgattcccagcctggccgcttccccctgggcctcccctctgctaggagtgtgttaaatgccaagcctgtctcaacctctatctggcagcaccttgaagtatcaagtcaggaatatgcacttagatccacaggccccttctccatcatgtctccggtgaccatccagatgtgatgattcccaggaccctccctccctcccttagccctcacttctaagagtctgtaagatattcccacttgaggagcttgtcttcttcaatgctgtatctcagaaattaaactcctccttttctcacgccaaaccatctctcctcctggcttctctcctcttcatggggttgttcatctcccacacactcaggtcagaaaccttgctattgcctcccctctttccacgcccccacttttttctgctcatatcttgcccatcactcaatcctgcagattctttcttcatgcctttcattccttccttcccgtttctatggcccctactctgacccaaatcatattacctaatattgcttcatatttttacccaagagcttcgtcctatctctggttcccttggaagctccccaatgcctgcaggcaaatccagcccccttaaatttaccattcagtgcctcccataatccaaccttgatctgctcttctaactaaactttccccatacccaaatgaagccccagccagcctggtgtgctccccagtctctggcaagcctctgctcaagtcctgtgttctgtttggaatgccagccccatgcacttcaccagtcctacttactcctttaaggctcagtcggtgacccacccttttggaggacatctgagctccccatggcagcttctgggcttctttgcatcctgggatctcccagaatctatttttcaacctgatgctacattcctccacagcagggagatgccttttattttgttcttcttccttataccgtcaaattccaaggatagaaaattgcatttccctgggcctgtgaaaagggatccctccctccctgcacactcatgcctggctcacacggagtgagccagacagcgcttcctcattccccgcagtgggtgtcgcaacagccagttgcaactagaataggggccacatcccgagtctcttgaattcttgccctgtggttaggatgcccttcttgcctgtcctgaaggtggagatttcctacagccgagagagagggagtcagcagtctagggcaggaactccatcatttctttattaaaccactcctaactctctctaatctctgtgagtcttgcctttcccttttctctcctcctcctactgttgagtacaactaggccaggctgaatgagaggagaaagatggggaggaggaaagaagttaggcagccttggcagagggtgcaatgctccgggaaaatgggagagatttacaaggcagagattgacagtttttagtaacttgactttgacctccagtgtacacagacatagccttggctgctggactctgagctttctggccctgggaagctcgagatttgcaaacacttgttcgacaatcacctcgtttatctgcattgtcaccagtgcagcctctgagccctctccctgtctttacttgaccctgtatagaaaaatgctttcagggccaattgcagtgactcatgcctgtaatcccagcactctgggaggccaaggcgggcagatcacctgaagttgggagtttgagaccagcctgaccaacatggagaaaccccatctgtactaaaaataaaaaattagccggatattgtggcgcaggcctgtaatcccagctaccagggaagctgaggcaggagaatggcttgaacccagtaggcggaggttgcagtgagccaagatcatgccattacactccagcctagctgggcaaaagagcaaaacactgtctcaaaaaaaaaaaaaaaaaaagagaaaagaaaaatgctttctgcacccaacactgaagactcagccccagcctgtgttcatgccctgggggtccctggaagagggcacaggagctgccctgagcctaggagccctgggctagtcactgcctccttcatatcccaccacatgctatggggtgagtcccctgggtaagcctgttcaagcctcctgttttttatttgtatgtgcaatcagggggtgtggggactttttagcaaagctttcttcaaagcagatcttaggcaagagcccaatataaaccaggcaaaaatattcctatccagggttgaagtgagaaggcgaggtacctaccaggcccttgagtcccctccatggatctcctggggtgcaggtcatctggaattctttccgggtctcaggctcgtgaggtgctcattgtgtatgtgtcatgggagctggagaatggctgtaggtgcaaatggacttggaaaagaacaatgtcaaagtcgtaagtccagcctggggcatggcaggtttatgtatgtgtgagtggcgggaggggctgtagatttgaactccctgaaagaagatatgtgtaattcttaccaaagagtaaatgcatatgtttatgaaagaaagttcattgctatcatctggctctccaaggcacctgtgaccccaaaagattaagaacatctctcataagatattatcatccgttctacaaacctttcataaaaatgacctcaaacttgagctcctttttaattcagacaaactaggccataagccctgttgaggaaagaaccgtatctgtatggagagtcactgttacatcccaaggacacagcctggtacctgacacacagctggcattgagtacgtacaatgtgtgcctgatataaggcagctctgttctcccaataaggagggctgctaaaaaaaaattaaaaagcttattttcatatgtaaactttgtaggataatgttgaatagattattttagcgatacattttcaatcacatgctaataacaatacattaacttaaatactgctttcccccaactctcccagtttaggaaacattgtaactgttcactcccatctctgacatcagtgtccttcttgtcaccagaaccctttctgcatcagctcttcatgttctgtgggcatcatagtccctgtggtctaaagagagttagctgtttcaaattgatccaaaaggagtttatttacttatttattttttatttttgagacggagtctctctctgtcacccaggctggagtgcagtggcacaatctcggctcactgcaccctctgccttctggattcaagcgattctcctgcctcagccccacgtccccaccacccgtcccccctccccccgccactgccagttttttaataaccgctaattaatacttattgatgaatagtagttttttgagatacaattcacataccgtaaaattcaccttttaaaaatgtgcaattcaatgagttttagtacgttcacagagttgtgcaaccatcaccgctttttttctttttttgacaagagtcttgttctgttgcccaggctggagtgaatggcatggtatcagctcactgcaacctctccctcctgggttcaagtgattctcctgcctcagcctcccaagtagctggaattacaggcacctgccatcatgcctggctagtttttgtattttttagtagagatggggtttcaccatgtcggccaggctagtcttgaactcctagctcaagtgatccacccgcgttggcctcctaaagtactgagattacaggcgtgagctactgcgcctggccctccatcactgctatctaattgcagaatattctcgtcactccaaaaagaaacccccgtaccataagcagtcacaccgtgttctccactcccccgtcccctggcaagactaatctactttctatttttatggatctgccttttctggtcattccatataagtggaattgtacaacactgtggcctttcgcgacggctgctttcacttagcacaatgttttgaaacttcctccatgttgtaacatctattagtacttcgtttcgttttgattgatatttattgatgagtaacattttgttgtgtggatatgccatattttgtttatctcttcattagtaaacatttggattgtttccactttttgaccattgtaagtactgctgctataaacattcacatacaagtttttttgtggacatatgttttcatttctctgagctatagacttaagagtggagttgccgggtcctgtgataactctgtttaacattttgaggaactgttgaatggtttttcacagcagctgcctcattttttattcccatcagcagtacttcttggttctaatacctccacgttctcgccaacacttgttgttgtctgtaatttcgttgttagccatcccagtggggatgaagtagtatcttactgtggttttcagttgcgtttccctgataattaatgatggtgaacatcttttcatgttcttgttggccatttgtatgtcttcttgggaaaaaaaatgtctgttcaaatcctttacaaagtatttattttttatgtcaacaatataaccactcagtacactgctttttagacaatgatcttttaaaggtttgtttacaacatttagcacttgaaattttaaggttatgccctcaaaaaaattgctgagggagctaagctatgaagatgcaaaggcataagaattatacaatggactttgggggaatcgagggaaagggtgggaggggggtgagggataaaagacaaattggatgcaatatatactgctccagtggtgtgagtccatcaaaatctcagaaatgaccactaaagaacttatttatgtaaccaaacaccacctgttccccaaaaacctatggaaagaaagaaagaaaaaattttaaaaagaaaaattgctgaatctatattatagtatggtggttgcttttcataaaaaccaattcttttaagtaacctttgtaagcatcccaaactagccttgattgattggagtgctaatacttttcccaaacagtatattgttgttcaaaataagataattgagaaagcaacccataacatgaaagattctgtaagggcttggatataaactttctcctttctgacagataatttgggaaggtagagagctttacctcctattcaagcaaatgtgatatttaaaaataagtagatggatgaatggacaatggactcatgaatgaatgaacaaaagaagaaatgcaagcaagtaaaccaatcaagcaaccacaccaatctttccctctttatttaggattttctaatccccacttagtaaatcagccttggtctttaatttacattttatggaaccatatataaaattgtttaaaaaacaagtttacagttacagattagaaacaagacactgtattttctgtcgcctggaatatctttatcatcttcctttaaaaatgggaagaaactaaggctgcgcagggtcctggaggcagttgagagactcagacatcaagtgatgtgattgcaggccttggtccagagttgtaagtcaccagagtgggacctttaggcttgtgacatgataacaaggattttcttgggtgggccccccagctcttcattgctctttccatcagcacaaaggcttctgggttgctgatgttttgtgtggtggccctggaggtctctccttctaccttctctggggtgagacagtctgatccatctcagaggccacactcaccacctactgcacagagacacagccccctccccatcctttaccattggtcctttcttaagaaaatgtgtcagctggcaaatggtactctggagtttggggtaagagagagaaagaggaagaatactgggcaagaaggtaagaaaggaagctgtggcctgacatgggcacagagacatgggcgaaagcttgagagatgacctttaaaggctcagaccccggaaagggaagaagttgggacaatggaaagactggcagggtggtaacatagcaggcaggctctggcgtagttgactctggattgtgtatggttggagttggggatcagggggtcagggacagtacacagcaatgtggacatacatggcctggactcctttcctttactgatggtggttggcaggttcagaattaggagttcaggtcagcatctttcagagaagcattcagatcccttctgtagaattttagtccattcctgggcaggattccagtgtttccagtgacagtgacacctagtcctttcttctgtgcctgtcggtcaggacggagtctcacctatcctagcaggtggctgttttcctttcggctttaaacatctgcaaggaatgagtctatgtgcttccttgaagccatgtttcctatttttgagaatgtagaattggtggctttgacatggtgaatctaaagcccagctccacatcacttagcacctgctgtgggccaggtaccatgcaaggcatgagtggtttcagaggtgaacaaggggtactattctcaagatgaaacagtaattcaggcagccacagtgagaccagatgttctgcatgacagtggagcagatgccatggaggcaggaaggccagagctaccaactttaccaagaggtggcccaaaaggtggtgctgggaaggattttgaagaagatatgtgtgtgccaggcaaagggtggttgggtgaggtgctttacaggttgagagcacagcatatgcaaagataagaaggcactgaagaaatggggcctgttttggaagctgggaacatctcagggtgtctggatctagcaggagcacggtggagataaggcgagaatgctatagagacccttgatctgggtggcttagtgttggacatcattctccggtgacaggaagcaataggatagataggataggataggcagttgcaagaatttttaagcagggaagagagtcagatttttgtttgaagaggactttggccccaggccacaggagctcttgcaccaagcatggagaagccttggctgggcatgggcagacaggcatttctggggtgtggccagggctgcaggcagggctgagctggtgcagcaagtgggaggtgccagccctccaggggcatggcccaggctgccaactgctgcttgggcattgaagctgtccatgctggccgctggccagcagggctggtgaaggaagaacccacttcctgcctcttgctgctgtttgcgtatgtgcagtggggaggggggcagacagaacagacagggcttggccaggcgggtaagaaccagccagctgtcagcaagaggtgcagtgggagagacggatgaaggggatacctacctggagagcaagggggtggcctggcagctatttttgccccaacaattgggctcagctattccatcgggatgatgacacacagaggatgttcaggagtagaaggcgctgtggtggagggaagggcatcctcatgttctacctccccgggtgcccctcctcccagagctcttggctgtaccatccatttgtgcctggcacatgttttcttgagataaaattatttttcacaagtacatgcattgctaaatgggatgaaggaaaggcgggcccccgtctcgtgcccctttgtctcccaatcataatctagcaaatgtcaggatacggagctcacactccggaaacatttgttcagatgcggagaagttttagggaaaagattatcaaggaaaaagtgcttgttttgggatggtctctgatacctgtggaaatgaggggcatcagagagattcagataagaacaagatgcacaaaagctcatccactcccaaaagagctgagtgagtggaggactccctggccccaggatgcggccacttcagtggagggtgttctgaggggagatgtgtgtcatgaccaaggcgggcagtccttggactcactgcagcccttcagcatagcatggagtcagtggcatcagaatcacttgcagggctgtgggggggttttgtgtgttttttgtttctgacagggtcttgctctgttgcccagcctccagtacaatagcatagttatacctcaatgcagcttctacctcccaggctaagcaatcccctccacctcagcctccctagtagctgggactacaggcacccaccatcacactcagctaattttaaaatattttttgtagagatggagtcttgctctgttgcccaggctggtcttgaacccctggggtcaagtgatcctcctgtcttatcctcccaaagtgctgggattacacaggtatgatccaccccacctggctgcagggctttcaaactgggctccaactccatagtttctgccacagtgcatctggggagagcaagaattgtacttcccacagggttgcaagtgatgtggacgctgctggcctgggaaccccactttgagaaccactgcagtggaggtcccccacagggatgtaccctcaagcacctttgcaattccattccttaggggtgtgtatcagaaccccctactccacgggtgagattttgagacacttctgtgcctgtctgctgttgtgcccaggcagtcatttcttcttctctttggttttgctttactttgttccttttttttttttcttgagacagggtctcactctcttgcccatgccagagtgcagcagtgtaattatagctcacttcagtctcaacctcccaggcccaaatgatcctctcacctcagcctcccgagaagccactgagcccagcctgctttgttcttaatgcttcaaaaatagttttggtgcccaccctggttgaaacaacgactatgtttcctttcctgcccacagcgccctgacgacttggttggcttccccagttttttgtcttcgttcccggtgttctcgaaggcaagactgcctctcccaggcttcctaaattcccacctctcagattccttcgaaccctccccctgtgtcacctctgccatgtgcttctcccagcacccccagttcatcccgtctgtgctcctctgatcccacagtcttcttcctgactctgttaggactttccttctgccttattttatcattcattggacatgtgccttccccacttacactatagtcctgaggatggagtcctggctcctttatcccccctcagtgggtcacatagaagatgtattccatccatatctgctgaattgcagtgagaagggcctgagaaacaaaccaaagcaaaccgagacctgtttacattggcccttgctggacaccagctctcgaaacgcacctaccaaggcctgggtgatggggaggaggaggcgtttgtgaagccacccctgagctgatgtggccgagtgccagggtccgatgtgctcatcaaccttgaaaataatttgattactgatctgtatcgctcagggatctaccacccccagagctgtattaagaatgttttcctcaggcaacaaatatgcgggctttgacatccaagtcagcctcaggaatttcattttatgattgatccttctttgtttgtttgttgtttgtttgtttattttttgctcgttcttgtacatcttccagatccaccttcttcttctggatctctcagttgacatacagccaagccctcccactgctcccttcccctctcaaatcatttccaaacatggttcctcttcctcaagcctgactcaaggtcttgctcttttactttgttacgaaagtcacaaatgactttgaaatgaagccactggtgttttccaggcagatggggtcccctaacctggggaccccatgtagtccccaaagctctggagtgttccagataactgtctgggaatgactgcccttttatgcttttttatacctgtctaatgacatatcaccccggaggggatgcccagctcacagaatgcaccttcagccagtctcagcccaatgccacagaggtgtgcttgacaaccccattcaacctttaccttattcattcactgttaccatgtcgcctgccttctgacctttctcctttaaaaaaatttctttcgccaggcgtgctggctcatgcctgtaatcccagcacttttggaggctgaggcaggtggatcacgaggtccactctcagattgagagcatcctggttaacgtggtgaaaccctgtctctactaaaaatacaaaaaattagccaggtgtggtggtgggcgcctgtagtcccagctacttgggaggctgaggcaggagaatggtgtgaacccaggaggcggagcttgcagtgagccgagatcatgccactgcactccagcctggatgacagagcgagaatccgtctcaaaaaaataaataaataaaaaataaaaaaataaaaattttttcatcagtgctgtaactaaaggaaaatgcactaagtttggagaaaggactcctagactcagttcctgcctatattttactctttagggaaatggcacacccctcagcccatgtatttgtgcgccctctcccacttctctctccccaagacctcccctccccagcatgaggttggaactgatattattgctcttttaaatttggagcaatatgtctccccgtggagaaggacgaatatctggtttgcacacaattattcacactatatcagcaaggcaggtcccaagggttagaagcgagggcttctcaaggtgtggcccctctacttcccagccatgtgacctcagcaccttctgacccctcccatcctcagctttcctgcatgctgaagggtgacaaccccagtgttttccttaagggatattgcaaagattaaaaggagatcatacacatacgtatataaagcacttagcattcattggtgtgctgcatgtaataagtattcaatccatgtagctgttacttgtattgatggcatatattactagaagacagaaatatagataactaaggtcacccaggatcccacccctcgtccgcttgatggcacttggcaggaacttcagcccctcagcctggggctatcttggtctgtctacaccaggtgtaaactcacttccttgtgcttctgccacctctgtactgttgcgtcttgtttggccactttactccaggacacacaactcagccccttcaccaatgatgccaagaagtctcagaccatacagaacacttacaatttttcttggaggaaggaaggagggaggaagaagagtattagggagagaggccgggcatggtggctcatacctgtaatcccagcactttgggaggccaaggcgggtggatcacttgagatcaggagtttgaggccagcatggcaaaacctcgtctctactaaaaatataaaaattagccagacatggtggtgggcacctgtaatcccagctactcaggaggctgaggcaggagaatcgcttgaacccaggagccaaaggttgcactaagccaagatggcgccactgcactccagcctgggagacagtgagactctgtctcaaaaagggttagggagagggtcagatcatgggggcattcccattccactacttctttggcttcctccttgcttttatttctccctcttttcccagagcaatgaacaaattataccaccccagcttcctcgggcctcatcttctaactgcaatgatttagtgagcacatgtttctaaatagttttcttcttaggaggacttctgttaccatctcctcttcatcttttatacatttaaacacatgccacatccttggggcagagctgcccatgttgacatctgggccacagcgaggacctgcctatccctggggaatggtggggctgctctgagtgaggggcttagcagcctggaggacaacccctcttggagaatccccctgattcccctgtaaaggcaagctgagccaggagtggggtgtggatgattctgtttgtgaatcctgggaagtacttgccttccccagcctgcagatatgacatttggatgatgggacccagtaacctatttgtgcagacttctatgctgactttctgatcaaaggaggagatgagaggtaggcagcttctatgacacatgggtgattccaggcatggaaaacatacgaaacctataacattaatgggaaggcgagtcaggtgaaaatgtgtatatgtgccccagatccagtagctgccatggaggaaaccaggacctcatgatcctggaggccacagtgaggggttggggccatggtgaggaacttagaggagcaggagatgctcacaccactggctacaaagtgactgagcctgtctgagacaccagaccaaaggtgtccaaactccttgctccccaaaaaaagattcatgtctcacccctctgccagaagagctgtttctcctactcagatgttcctcattccctcttgcaattttgaagttaaggagaagctgattcagctacaagtctggttgctcaggactatggcatatgttacaggtagtttgccctctttgagctacagttttccatttgcagacagggaagagctcataaaagaggttatgtggattcatgttttcactctgttttcttaaaagtacttgctttctttgcggggtgctgtggctcatgcctgtaatcctagcacttgggaggctgaggtaggcagatcgtttgaaccaggagttcaagactagcctgggcaacatgacgagaccctgcctccacacaaaaaaaatacaaaatacgaaaattagcctggtgtgggggcacacgcctgtagtcccagctactcagggggctgaagtgggagaatttcttgagccctggaggttgaggctacagtgagccgtgattgtgcagctgcactccagcctgggcaacagagccagacactgtcttgaaagagaaataaaagttgctttctgctcttcatgctgctgtgagtgatggaggaagtgacgagcagtctcctttcatcacagaaaaatggaacatcacaaaggaccagaaatatccccattgaacaacaaattatttgagggaaaagtggggcagaccactaaaagtcatccagcccaaactcctcctcatggagaaaggtatcttttccttgagcacctgttgggaatgtttcgtcccaacacctcattccaattgttggataactcatggctggaaagttctttctttcactgagccaaactgtctgaagctcacgctcctttggtgctgaactgcacttggcaatagcccagaatgatgactgttttgcagtttgacagccctcagtgatagggagctacccaccgcattatcccctgatctaggcttaacatcaagagttacttctcctcttctttgcatgaggtgggttttcagatgtcgtgcctttctggctctccacttctggatcaatgattctgttgccatcttaaaaagtcatggctaggctggacactatggcttatgcctgtaatccaagcactttgggaggccaaaacgggtggatcacttgaggacaggagttcgagaccagcctggccaacatggtgaaaccccatctctactaaaaaaaaaaaaaaaattaaccaagcatggtggcatgcgcctgtaatcccagctacttgggaggctgaggcaggagaatcacttgaatccaggaggcagaggttgcagtgagccgagatccacccacctcggcctcccaaaatgttgggattacaggaatgagccactgtacctggccattcttatgttagtttgctcaactgtcatcagaaagtaccacagactgggcagcttcaacaacggagatttattttctcccggtactggaggctggaagtccaacatcaaggtgtcagcagggctggtttcttctgaggcctctctatttggcttgcaaatgccatctgttgcctgtgtcctcacatggtcatccctctgtgtgtgtctgtgtcttaatctcctcctcttataaaggcaccagccatactggattagggcccaccctaatggtcccattataatcaccactttaaagaccccatctctaaatacagtcccattgtgaagtactgggggttaggacctcaacataggaattttgggggacacaattcagccagaacattctatcttagcatcatctagccaagctgactttacctagtctctgcaatcactatatttctacctctcatgcatttgaccccactacctcttgccttcctcccctgcttctctttcaaagctgctcttccaagaagctctcatgccaagcaggtgtccagtctgtttaaacacccacagagatggggagctccttctctctgaagcagcccattcttctggcttcaacagcatcataccctagcaatgtggacctggagaggcctcacgtttcacaaacccaaggtgcttttcaattcagataaaacaatctccagataagtaaaacgacctccagataaaatgagaactgagtaacatatgggaaaaaaacagaaatatccccaaagttgaaaaccagtgaaactggatgcctgaagtctgtccactctgagatactcttcttggggagcagctttaagccaaatctggcccttttcctgtgttacgaatactcaaatgtttctttgcttgtttccagccgtgcgggagtaccgtggtctctgccctgtttcctctgcatgacaggactctcctaaatttcacttgccaagacccctcggtcaaagtaaaattaacagaaccccctgttcttcccactctgctttccagctcttcccggcgtgcacacacacctcctggaactccagccttgtgcatcatcttgatgccgtcgcctagtaacgatatgcttagcaaccggtaagggaagtgcgatcgcacctcccagcactgtatgtgaagcactgcagacaatacaaacagttccctggttctctttgcagctagaggaaggtaattgtcagaggtggccagcattatgctccagagatagtggctcatcatccgggggcccaaattggttgttgcttggcttctacttggcattgggcaatatctttgtgggggcggctgggtaggtggttcttgaagggccggatctctctgcttgcacttgttgtcaggatgccagtgatgcaggctgggcagcttgcagaatcctctctactcccacgcagccctgccctgtaccaagccacatccccctgcatcccaagccattccccgctgcctcttccatttggaggctgttcttctatgccctggcactgcacaggcctccaccttgcagctgacctgtcctcccagtacccatgcctctgtctttccaacaccccatcaggcatgtttctccctcatcactatctctcacgttcctatgcatcccagcctcagaccactgggtctgatgccaaacagaggggactgaggcccacctcctgttctcttctggtgtccttattagaaattggatcattgtgacttaactaaagtttccaaggtgtcatgttgcactgagaaaacaacagagaaggccagagagtctagagtctaaaagtgtatttccaatcccagatccctttttctgtttgttttttggtcttaactgtatgacttaggtcaagtttctttaacctctttaagtcttaattttctagaggggttggaatatttgcctcacatggctaggatgacaattacataaggtacaaatagaaccccgtaataaaccacatggcatacagtcagagaacccgttaaatatcctcttcctgtccttccatctctgcctctttgttcttcctttcaaacttcaagctaaagccagttttggagttggattctcagaaggcagcacagtgcattggcaggaatgcggggcagggggtgaagacctcagctctgatcctgggccccacccccaacagccccgagattcctttcattcccctgtaaaatggagcgaagagcacctggcatgtctcatgcaaagagctgctataaaactcaaaggaaataatattcatcaatatcctgtacacattttgagatgttttacaaattttagaataattttctcggacaaacctggtctcatttttgcacctgtaaaatgaaatgagattccaacatgcctaaaacccccttaaatcctaatattgtgacaaactgagaggtgatggttgcttgcccttcaagggccaccctagacaggacagactccttcatcacaggcagtctttgtcctaaagttgtcaggatagattgcagcaatacttccactctctgttcacagggtccccttgaccaaggtggctggttatcacccggtcaagacttcagcccagtaacattctgcaggcttctcatcctagcatggaaatgtatataactctgttctttcagtaagcaaaacaaatgagtcagagcatactcaaagcatgataaaggtacggggaagcaatcgctagtgtaggtgtttgaagtttatgtcatggatacttccatggtggctgtgtatttagtagcagcctaaaagacagtggaatttgcaaatggaggatacattaagcaagaaatttaaaaaggcgtaacgtaagtcacagtaagtcaaacagcagagggacaaacaaatagaatttggatgttattgaaaccttgaaggttgggagtctggccatgagccagagacatttgcattctcttctgagagacttccccccaggcaattatagggtctccaaataacagagcatctcagcagataagataggagattcagagctctcaaagctctggatttgtctggaatatctatttcaataacctttggggagaggggtgcaaccccactcagggaccttgctgttatacattctccagtcccgtgacttcagggcaaagatcagtagagcctcccctcctgttaataagtgggggaactcctgcttcgtaataaagttgcaagaggtcggacataacacaagtgcgaactgttaaccccagttgtaactaactttttaaaagtataggtatttggggctgggcaaggtggctgatgcctgtaatcccagcactttgggaggcctaggcaggtcatcacctgaggttaggagttcaagaccactctggccaacatggtgaaaccccatctctactaaaaatacaaaaattagggtgttggtggcacatgcctgtaatcccagccacttgagaggctgaggcaggagaattgcttgaacccgggaggcaaaggttgcagtgagccgagatcacaccagtgcattccagcctgggggacagagaaagtctccgtctcaaaaaaaaaaaaaaaatatatatatatatatatatatatatatatatatatatatatatatatatacgcgcttggagcacgcacagtggtgcacacctgtagtctgtagtcccagctactcaggaggctaaggtgggaggatcacttgagcccagaagttccaggtagcaatgagctataattataccattgcactccagtctgggtgacagagcaagaccctgtctctaaaaatgaaatatatatatatttcacaaggagcagtgggatttaatctatgttcttcctggacccatagaatagaaagtcatggaatcaaagaatattaagccgataggaactgtaataatcacctggtccaatccctttaatcacgggtgagaaaatggtctccaagatgttagaagtgattaatctgggattgtagaaatgttccatttgcctttaaaataaaaatacaaaaataagaaagcataaaagtgacttacctaaggttccacagccacacagacaaagaatttgtctagaccctgaatctgttgacttccatccctctactggtcctaatggattccatctgaggctagaactgagtttccaaaaatatcctttaccaaaaaaaataaattaattaataaataaataaaagtgtactaatgcctccaactagtctttgcaatgtaaaactttccattttcaacatttcacaatctccaggataatttcatcaacattatcttttgaataaaacatagacttatctatggggaaacattacacctaaaatgtcagcagtcagcaaatctctcaaaagacacctggttatgtaggattaaaaccacccgttgaagggcaatgtgaaaatggaacctctgtttgactttcgtaacccacttcccacgtagcccatccactggagggaaagagaaactgctaatgggatggtaaaagcagtttgaatgccatcccccgcagaagctcctgtctacagcttttgttcccatggtctcttcaataaatatgactcaggctgctgtttgggcttcacttcctctgggcagggagctgacagcagcggctctgctgtgcccatcatggttgactcaggggacccacggcgggggggctgcctgtcctctccccagctgaccaaacacccttctgctcttccaagcgctgctgtccctgactcttctagctttcaaagttctcaccaattcataaggctggtggctccccatcaccccattactttttctaaagcagtgctgtgcacgtatcttgataagctgccaaagtgcttttttcacccacctactcacctatagaattcatagtctccagtgtaggcatgacgcatggaaggccaaggaaaggccaacatgtgttcctgcaaaaaacaaaagcaaaagacaggaaaagcctcccaaccatctcacctcttctaaatgcttgttggagcaagaccacaatctacttaacgtcttcaggggtggagggggggcggtcatctgggccagcctacacttgtaaacttctttttgctatagaatcagctatgaaaggagctttcacttatttggatacacattatttgatatggtttggctgtgtccccacccaaatctcatcttgaattctcatgtgttgtgggagggacccggtgggaggtaattgaatcatgtgggtaggtctttccaacactgttctcatgatggtgaatatgtcttgtgagatctgatggttttgaaaaacggaagtctccctgcacaagctctttttgcctgttgccatccatgtaagacgtgacttgctcctccttgccttctgccataattgtgaggcttccctagccatgtggaactgtaagttcaattaaacccctttcttttgtaaattgcccagtctcagttatgtctttatcagcagtgtgaaaatggactaatacattattattctaaactcaaggggatggattctagaacaagaactgtagcattttacataacaagaacagttacaaaggattgaataaagagtatgggggtctccttcacctaagccagcccaggctacagtcacctaaaggatacagagaagtggagaaccacattttcacgggactgctcatctagtcttgggattaaaggggattaattgcaaaaatatttagttagcaatccaaaaatatttagcgtccactacagaagagacccagaagatttacggtataagtttgccataagctacataccagttgggctgttaatgttgggggctgtgtttttctccaatactcaagggcagtagggagtggatggggagataccacatcaggctagtcagtcacccttggctttgggatggcactccttgtccaagaaagtgctgttttttgctaggacatctcagatgcagggtgcattgcttaccaatctgctgtgaaattttctcctccttgtcctttcttcatatgggataggaaaggcccagcttggcctaactatgccctcacacgctgatctgtgagtgtgagtaaacacagctcctaactcattcactcatgcatgctcgctctctctctaacacacacacacattgatcctgtggtcaccatagcacagccctgtatctacctagtaatggcagaccaagacagcacttgaacagatgaggcaactagggtagggctgttcccaggggaggctgttcaggaggcacgatttctactgctcagctgcatgaaggttaatagcctggagtgccaactccgtaaaccttatcagtcacttagacctgactatgggtggctctgtaagatatttcccaagagcaggggaaaaagagcctcagcagaaatgggcctgctattgaagatgaagcagggaaaggcaggtgtcacacccctgtttattgtcccagcactcttttagttgcagatgacagaaacccaaaagagaggattcaccttggctcacatacccaaattaagggaagattcaggaagcagctgaactcaggtgtggtgggaatcaggacctcatcccagaacctcagacatctctgtgtctgcccctctgcctctgcttctgtctctcacatctctggctgtcattacatgttggcttaattctttcagaacaacttgtgccaaaagaaaggaacttggtggctaatggtgtctgagctcccagccatagccctatcacccagagaaaagcccttttccccaagctaaagtaaaaatgccaaagaataactctgattagtttggctaagatcgtgtgtccatttctggactaacccccacagccaaaagggtggggtactgtgtttgcttcctcttgattaatgtgccccatcctgtggtccaggccaggacggggaggaagaggagatggtgttctgtgatgagccgtctccactagcacacaaggctggcctgggaggaggaacagtctcacaaagaaagccagtgaaattctcccaagcagggaaaggagacgttgcagacagatgaaacaattgaggtcacctgcaatctatgtgcaagcagtttttgatttgcggccggcaggtatgttgactgttgggaggactgttaaacttggaaaacaggaaaatagtgacatccgaagtgcttgaaaaatggcagcgtgtaattatagctgggaacaaaataaaactttgcagaaagaacaggtagtgagggtgtgaagtatatgtcaataaatcatttacataccgctgggctgtttgatgattgttattctatgaaggtaaatgagcttgccttccttgtctcattggcctgcttgtaggatctcaccaaccaatttgtgtgtttgctccttgttctgtctctcctgggctggaacccaatgtcaatattagggatggtcttccgacggaatcatccctgattttcaaggatgatatttttattatactgcttatgtctagagctgaaaaaccaccttgctcttcagtcttgagggaatgatgttcttacagtaaacgactctttttgattctgcctcttaactccccagactatactttgttcttattcaaaaggagcattagctctaatactctgctacaggctgtctaataacaacctcccaaagatgtccgcatcctaatcccagaacttgtgcgtgtgctaccttacatgccaaagagactttgcagatgcaattaagttaaggatagtggaatggggagattatcttggattatccggttggacctaatgttatcacaagggtccttttaagagagaggcaggaaggtcagagtaagagaaggcagtgcaacaacagaagcagaagtcagaaagagggagggaagagagagagaagagagacaagagagagattgtaaggcactatgctgctggttttgaagatggaggaaggaaccgcgagccaaataatgtagcctctaggagctggaaaagacaagaagaaggattctcccctagcaccccagaaagaagtcaaccctgctggcaccttggttttaggacttctgaccaccagaatggtaagataaattagtgttgttttaagccactaaattggtggtaatttgttacagcaatagtaggcaaccaatacagctacctttctggagagcaacttggcagcatgtactaagaaatatgagtgtattccttctgactcagtaattctagctctaggcttctctcctagtgaaataatcagatctgtagaaatacacttatatatttagaagtttgaggctacgcatggtggctcatgcctgtaatcccagcactttgggaggccgaggccagtgaatcacaaggtcaggagtttgagaccagcctggccaacatagtgaaaccctgtctctactaaaaatacaaacaattagctgggcatggtggcaggcacctgtaatctcagctacttgggaggctgaggcccgagaattgcttgaacccgggaggcagaggtagcagtgagccaagatcatgccattgtactccagcccaggagacagtgcaagactgtctcaaaaaaaaaaaaaaagttccagtattatctagaatactagaatagtaacaccttggagccgtctgagagccctactggtggctctatctctattataattataacactgttcaagtaagaaaacatggcccccttagtgatgacagtccctctctatgtggcttccagcaatgtgttatgatcgcaggttggggtggcctgtattaggaaaagactgtgatgacagctttgctgttgatctattgattcaacaaatgcttactgaccgtattgggccctgggccagagctgagggcaaagagtaaaggacatctatgggattgtaaggaagctgcaagagtctggccagggagatggttatcaacacagagacttcacagaatacttggtgttttacttaaaacttgaaggattgataagaatgaactgcagctgaaaagccaatgaattcatggaatgcagtatagatcctcactgctcacgaggaattctgaaggctctgatgaactgcagctgaaaagccagtgaattcatggaatgcagtatagatcctcactgctcaccaggaattctgaaggctctgcagcctgaagcaggactagccctcttgtcaaagagctgcagtcaatagcggaaaaacgtaaacaatgcaaatgtcctttaatgggagactagtatattcacaccatgaaatactactcagcaatgaaaatgaacaaactattgacacgggcaacgacctggatggatctcaagggtattatgctgaatgaagaaaatgttcatctcaaaaagtcacatactgtatgattccattgacatcacatcctttaagagatgaaactgtagagatggagagcaaactaggggttgtggagatgggtggtggcacgaatgtgtctaaaaggggtaacccaaagaagtcttttcacggtgatgaaacagttctgtatcttgactgtggtgatggtctcatgagtgtgttcacaggatgaaattgcatggaactacatacataccacacacacccacacatacgaatgaatccatgtaaaaaaaataatgaaaatgggatcaggtctgtagttcagtcacagtattatatgaatgtcagtttcctggttttgatattattattctacaaggtgttcccattaggggaagatgagtcaagggtactcaggactctatgtgctatttgtacaacttcctgtgagtctataattctttcaaaataaaaagtacaaaaaatactgacaaattaaaattcctctgacacttcttctgtctccaagaattttctcaccacttgtatggttccagagccacttcagttggtgtttaaatattaatccctcatggtcctcacatcatttccaggggtcttctcatgatcttgtaggatagggaggtaaccagcaactgacagcagaagagaatgggaaattcattttcttgcaaatctccagtgcagggggccaccccgtgcctgccatctcccttaaccgctatcaggagcatcatttcccaaccaccagctttgaaggaaattgggtctcttgttgtgaaactgggctttcttctctctcctttgtcaactctgaatgagagaggggaaatgggtcaggttagagagaggagatgccttttttgaagaggagatctgagtgagataaagatatagatagccaagagtaagtgagataacagagtaggtgctctggcataatagaaaatgcacaggcttggaattacagctgcattcattcattcatctgatatttatcaagtgcctaatctgtgccaggcatagttttacatgctagggatatggagtgaaaatatggtccctagcctcatggagattatgtcagatgactgcaatttagactctatagctccccagtcatgtgacctctgaaaagtcacttaatatctttgaagctcggtttctactctgtaaattggggttactagtagtaattggggtaaccaagccaacctcattggatttctatggggttgcataagaaggtttacttagttcttagcacaatgtcttaaacatagtagacgttccctttttctcattagttctcttcatcctcactctttgctcccctccttggtagattggttagaaccatctaaattcccccagggcagcacagggctgtggatatagctctgcactgtaggttcagctgagttaagccatcctcagttgagttgactgctacacagttttgtagcactcaggccaaatgaaaccatgaagaagaaaagaagcaatactttttgcatttctgtccatttttgctttatatttttaattgtctgtgttttggtgcatataagcttatgattgtaacttcttggcaaatttttcctttttaacatgattcctcataatcatatttttaatgtttttcttcaaatcttatttgctattttatatatcaatatcaactttcacttagtaactggtttatatttttctgtctctttatttttaacttttgatgtcttaatgtttttaggtttgcttcttgtaaactacagatagctggatttttaaaaaattaagtctaagtgtctttgtcttttaacaggcaatttaagcttctttatttattaagacttctaatatatttagtatatgtatactacattattttgtttgccatgcttcatctttgccttttctcacctcttgcctttcactgtattgattatgtgtttattattttctcctcttgtagcctattggtttagaagttatatattaggtttctattattttaatggaaaaataggttaaaaataaaacctaataataggtttctattattttaattttttaacacatacttgaatttaaggtctaacattaatcaatatcattatcctccttaccaaattggaaggattttatggcactttgactctaatctttctcttctcatgtcccaaactgttgtccactggtattatagtattatcttcttttcaacatctcccctccccattttagccattaggattattatcttggactttgcataccttcttttttttctatttagatattgcaaatatatatatttttgaaacatacatagtcttgctctgtcacccaggctggagtgcagtggcgcgatctcagctcactgaaacctccacctcccaggttcaagtaattctcctgccacagcctcccgagtagctggactacaggcatgcaccacaatgcctggttaattttttgtatttttagtagagaaggggtttcaccatattggccaggctggtctcaaactcctgacctcaagcgatctgcctgcctcagcctcccaaagtgctgggattacaggcgtgagccactgcacctggccttgcaaatatactttttattgtcttaagttattccatttacttcagttcttgattttctaatctataacgtgcatctgctgcccctttctcaaggtgggttgcttggttgtatggatcgtcactgtgaattggggcaggaggagcagggtatttatgtgtttttgcttatggaaatgcactccagagttctgctttttcctctgcttgaatcacttgtcaccatctctggatttgtttttattttaattacttggattagaattcccactgcatgtaagtagaatgacacaggttttgggttttaccttctctctttctttctctctccctatctttctttctttctttcctgggacccagacagaggtcaagcttcttcatgcccagggctggtgaacagtgtttctagtgcccaccttgtagtcaggatggtatttgttgagttaatccctgcctcacaagggtctggagcctgaagacatcaccctgcacaaacgttaaacccccggccccagctcctgggccaacatcctctgatacccaggtggcctccatagctttagtgcccacacactgctttagatttttccggatatttctgacacctgagaatttcttctttaccactcggatgtgattaagatgtctttgttatggtttattcagcatgccatgcatatgaagggggaagggcccagtcgacattaggtctgtctattacaggactgaaaaatcatacatccccatgttctcacattggcaaaagctcactttcatttattcagtcaacaaatgtcactgagtcaactagaatctaggtctagggtgacgcataaagagacacagtcctccctgagctcccagaacttaacacccagaatgggagatgggctggaatcagacagcccaaggaatccatgcgcgatgccggcaagcgccgcagagaaggaaagtcatgctgatgctgatgggagacggctgatgctcagaggaggcctggcctgggcaggggtcagggagggatagagacagggagctgtcacagaggccagaggacagcccaagagcattcagtgtttctggtgcccttcctccttccaggtccctccctccttccagccccgttcctccaccatggaagccaatgtgacttgtgagctagctggctcctgaaccggtggcagaaccccatggcgatgcaatcataaaggggtgggggtgggtgagagggcaggatttcctggggtacgatgccccaatacactgtgaactaccaaatgacacgtatattctgtgaactttcaaaaaaggatgtgaaagacttctgtgcaaacatttcacctgggatcttttcactagcaagatggggagaaaaagccaaaactgcatttctctcgccctctgggtctagatgtggggatttcttctccttccagatgacagccaggaagggcccccaattattctcgaaataaaacgtgtcggtctttcgaaatggtcagtggggtgatgtctgggtcccaggaaagaaagaaacataggatttgtgctttttgttgatatgaagttaaggggtacaagtgagagtgattttgttacatgggatacattgcatagtagtaaagtctgggcttgtagtgcaaccatcacccgaatactgtttattgtacccattaaataatttcctatccctcacccccttcccaccctcctgagtctccaatgtctattattccacactctatgtccatatgtacaaattatttagctccagatttagctttttatttcttttttgtttcctttttgtttgtttatttgatatagggtcttgctctgttgcccaggctggagtgcagtggtgcaatcatagctcactacagcctcgaactcctgggctcaggtgatcctcccatcttagcctcccgagtagctgggaccacaggcatgcaccaccatgcctggctaattttttattttactttttgtacagatgggggtctcactttgttgctccagctgttcttgaactcctggcctcaagcgatgctcccactttagcctcccaaagtgctgggattacaggcatgagccaccgcagccggcctggatttggctctttaaaggaaagagcgagccctggactgggcagggtgggaaaatggccccagctctccctctgacttcagggagggaccttggatagggggcttatgggctccaggcaccttctctgtaaaattaggtcatactaagggagctggagggcccttctctttctggtatcccaggtggtctccccaggggtggtggttgtggctgaggcccactgcctgcttttctggtgctctcaatgaagtacagtcctggggtcctctgtatgtggatggactaggctgtgaagtctatccgcccccctgctccgctccacacccacacactgctcttcactgataaccccgatgatgcagacagcctccctcaggaatttttctcatcctcctagtcatcatttcagtcagccctgccccgtgtgccagacaagcacactctatgtgttcaaaggtgatgcaccgatcgtgccctgtctgatgtttactaaccaacctgactgggtctgtgggtgacaagggcaggccctgtttcccttggatcttccttttatggacacaaatcgctgacctgtctgggcaggcctgctctaatccaggtctggccctgagcctcctgtcattttgctgacccagttcatcatcctggaggcagggcttgagttgaaaagttagagcctcagggcagcaccaggagcctgcactttccggggcctccccttctctctcccctaggctgacctgtcctcccctctccacttcctgggcgtgactcacaggcaggccctatcggcatggcaggtatgtgtcatttccttatgctggtgagacccagagtttcagtgttagcacccccacactgtggctcttctagcccaatggagaagggctaagggtttctaaagtcgttgacctagggatttactgttgggatgaatttctcacctaggggaggtgttctgtttttgctgagagatgactgtggggagcagggttctctgctcctctgacactactcatcctccttcccaacacctgtgggcctttagcaaagcaacaccccacccccaccttcaccctgaccccagcagtgttttctttccccccaccaagacttccttggggccctctggccttgccaaaccccctttgtagcagcctccccttccagcagtgacaggagggacccagcctcgggagcctgtctctgagagacagatgcaggcaaagagccgttaccatgcaaaatctagaactgttcccacgtgaaatctagaacttctcccacacgaaatctagaactgctcccacacgaaatctagaactgctcccatgcgaaatctagaaccactcccatgcgaaatcttgaaccgctgggtggaaatgaggttcagtaggtgcggcagtgtcacctctctggagcatcttcccaagtctttatgacaaacagggataccctcatggccagagtcagctgggaatttttgtggaagcagctccttggatagcatcactcctgttctcgtcatggtggaaaatgactaaaaactcaggatatcccactggccctgggcaaattccctcattggagtagggactaggacaagggccagcccatcctgtcaggccagagcacttctgtggtcttcagcccagttctgagggcccctcttgaaccagcttttgggaagctttgagggagagaggggagccagagaggacgtctcgtgagaagtgtttggaggaactgaggcaggtccagggaaggcctgggagagcagaggagctgttttccactagtgaaaggtcaggaggtggaagtgagatgggttttgttctgtgcatctccatgagcaggcccaggaagttacagaaaagtagatttgggatgaatataaaggaaggttttttaataattagagctccgagcaatgggacaggttgcagaaatgttgagagagtgagtttctcatcactagaagaattcaagcaggaagtgggcaagagggagtgcccgcatggtctgggatgcagggaatggactctgactgctcttgctgctctgagcctcttgattctgatttgggtctacccctgcccttcttgcaagtcctcctttttctcatcatggacctcctccccggagccaggcagaggctcaggggctctcccatgtcctgtctgagtaggctgcatgatgactattgattggctgaagccccagaaatacctgccatgtgctgggctgtgacagtcacttggcgttcctgggacatgttcatgtgaattctcaccggtggcttcacccacccccagtcctgtgggccacgattactctcccacgtgctggagatgaggaagtgaggaaatacccagggcgctgcagggctaagattagactagggcccggccgcctgtcttgacacatgcgcacaagcagctcccccaagttaagagcctgtgtatcagctgagtcccagggcctggggctctccacacactctacatacaaacacctggcaaggagtcctcacaacagcgctgaaacagctgcatcagcgtcccgttttacagagaaagaagccagggttcaggatagttggaaataagtctgtgcatgactagcaagggatagagctgtggcttgtgctcagctttgccctctgtgccactgactgccaccagaggctgtaagctgccttccatgcgatgcacctcaggcagctcagagaatgcacctcaggggcttcagccagggcagttcgtttccatactcctgggtgaatgatggcctcctccaagaattccaggtcctatgctaaatacaactgggaaagaagtgcgtaacgcattatttccagcttaccagaaacctggagccccaaagggtaaacatagcacatttacaataagccagatgtgctgaaaagggaacagcagccgtgaagaaaagcttcctgacggaggtgaaacttgaggtgggctttaccaagaggagtcttagataggcagagatatggaggtgtgaggcggggagacattcgctcagtactgcagggactgaacagaattttgccatgaattcttgagctacagttaagcaagcattattgactttcccactttgtctacctgcatatgagtgatcccagaaccttccagccccaccttctcatcctgacttgatgagtggcctcactgacgtccaattgacgggagaagattgtaggcaatattcgcttttcttctaactggctgtcaattcctgtggattccaccttgggacatcttccttcatctactcctttttcctcattatcgcccccatcttgagtaagacactacttcttgccaaaatcaatgcatttgtcactcgattgctgccccagggtttcttcctgcaaatctgtcctatgcatacctgtgggtagtcacctctgtaaaccttgacacttctgatgacatcttcagcaagcctcaggctttcctgcagttttgctcatatacattctaagtttttctgatagctttcaacccacgtcttcttgtttgcaaacctatccagcctggaaggtccaactcatatcctgcctttcccatgagatgaaattaactttcttcacccatgctgctccccagacataatttcatgtccccttcgcttgcgctaaccacactgtgctgcgtggtattatttgatggcgatatctgtctccccaacttggctgtaagtccctggatcactacttactccttttgtactctctctcgtctgccaacctggtgggtactcaaaggtgtttgttgaattgattgtagtcacaattcccgcagttcatccctagcccgagggaaggcaggagacccatgacaccttaatcttggcctctttctttggaaaaagaaagagtttagcaagacagggacctgcctaagccttggtttctttcctctgcaatatggcaaagtcctgtatgtttctttgagagacagtgtggtgtactggtaaaggaaataggaaacagatctgccatttcctacctctgtggcactgagagagttcctttaatctcctatgcctcagtttccccatatgtaacatggtagaagaatgataataccaacttcgttttgcggattaaatgagttaacatttgtcaccactcattaaaaataccccaaagatatttattattttaaggttattatgagtagtagcctgtgctccctcctagagggcaaaatgcacaaccttaaagctaggagggcctgagatgaccctggtgatggggactgtcccagccagacattgctggtaatttgccttcctttcaagggctgtaaaactgctcctcagttatgaaatgaaccaattaaggacttcggacttagccagtcctgacagaagcatttcaaacagaaccactaatcatacctgatgtttttattgttttctgttgacactgccccagaaacatgaggcttctggcagccagccctggcacacctgcctcatctcttcatgacaccatgtttcaaagaagcttccttgtcaaataggagaaggacccacctgtgctacttcctgtgattgacaggaagttctgaaacccaaagaagcaaatcatggctcttgggtcttggggtggcacaagtcactagaaaatctcactccattgctgatcctagaattagttcaggctccctgaggacagatccaccccagtacctcccaccccttccatctcttcatcccccagggggaggctgtctacttcttttggggctttggactaatccccccagttcccatcttctgaggttttgtgctaatcttgtttgtctcctatgtgtacaaagcaatcacccaggcgacatccagcttctagatttgggtgcccagggttcatgtggtgccatgttggcctttgcctaattaattttaggaagtctttccaccagccagatcatggtcttccaaaaatcctatggagtcagttctaggcagaagctgagcaggcatctgggcatggcaacaacttctagcctcttcctcttaccacttggcgtctagctcccaggcaggtatttcctgagccagggttcctgtgcaggtcagtctttacaatatgcaaatttcttgtgacccagcccatttccccccgagggaggcaggaagtcccttttgaaatttctgagcacacacaacagaggctaggagaggaccagctctgagactcccactcaagcatgtcaaggggtgtttgtggctgtgtggctgtgtgtggagagcagagggcaatgctgggctggggcaggggagggtgcagaggagagggtgtgggggagggaggagctgcagcctcagacacagaattggactgagaaaacaggatgcagcagaggaggaggctgagtgtggtggctcggctggcactggaatgctcaatgtgaggaggtagaaggtgcctgagaccagggtctctggagttctagaaaagcctgggcctcttccatgtttggagtctctctggattaagaaagaagaagaagagacagaaatagccaaataggacagcaaacattatgatgttgtttaaatgtttactttcaccaattaatagttttaaacacacacgcacacatgccacacacacactgactacatgaatggactcatttggaaataatgtcaagggctctttgtcctgtgaggcctgggcccagtggccatcctggttttgggagcagctctgcctgagagaccctcctgtgggcatggtggcagctggagggtgttctgggctgttgaacaaaaagtccagaaagtccatctggactggtcctgctggggatggtgagggactgaacagcccaggtgcggggtgtctgggcttgcccacctgtccatgtttagccaagtgtccatttcaacaaggaggaaggtgacaggcccccaggacgatggcctctctcctcagtcaccccaggtcagtccccagcaaatgcagtggggccttgatggggaaagtcctttcagggtttgtatcaatttctttgcattgttgtagcagaatatcagaggctgggtaattcataaagaaaagaggcttaattggctcatggttctgcaggctgtgcaagcatggcaccaacatcagcttggcttctggtgaggcctcaggaagcttccaatcatggcagaagggaagaggagctggcatctcaaatggcaagatagaagcaggggaggtgccagcctcctttttaaacaatcagatctcacatgaactcattaaactcattacatggggaaggcaccatgccattcataaaggatccaccacatgacccaaacacctcccaccaggccccacctcccacactgggaatcacatttcaacataaaattggagggaacaaacatctaaaccgtatcagggtctctgattccacaagagccaggggacaaagcaggccccacggaatagggtgctgtggagtcaggcccaggctggcctgctttggggatgggatgggcctctgtgggcccaaacccatgctgcccttgttagcagacgccagatggcctaggaccgtcctttctctctgccatggagtgagtgcgggacggacgggtggctcctgttagagctgatgcttacatgggtgagggaggggaacggctatgtccccaaatatcctgctctctttgctttccttccactgacaaggactccctccttgaccgaaccttaggcaggctcctctgagccctctttttggctcccccaccctgctccttggcctgctaagctccagaaagtccagcaagaactaccccctcaccccctaccccgccaccatcactacctcaccaaattccccttggtattcatccctccactgactccctcaccttgcccactggctgtgaatccccagctgttccccttgtggtaggaattgagttcaatctccctcccctattggaatagtcttggccctattgcaataaactggaaacaaggcttcctgcctgattaacttcacctggtgtgattttgctcctgcttacatgtgcaatcacacacaagctcttaacacagacacttagcaaaccctctggttccatcccattatctcattgtctcttctgctcccagcaacattgcttgaaaagggtattcaggtccagggagaaggaagccacctgtcccacttggccatggagcttctgtccaggaacactgaccactcttgctggggcctggagtgacggcagggccacactctgctctgtcatgtgcctgccctgggccccggagaccctggaaagaagaactagggctgccttgggctaggaaggaggaagcaggggtgggcagggcggaagtggaaagagatccaggagtgtctcccctctcaggacctctctcactccagcccttgtgaagggctgttctaaccttgttccctcagcagcagtctctgtcatcagaggcatttctcagcatctctattttggagctgcagctggttgcttctcagaataaacagagctgtgatattatgttgaaagcagaatggaataacatctcttccttatgccctccctcttccccatgttttccaacctccacttccctcttcttaaaggccttgccctaagacctcttcctccacaccccctgccctacagcttaccttctaccctcttataatcacaggatcccttcactggcatgtagggggacctgagatgaccaggccctgtgctgggcctgggggatccaggggtttctatctgcaaagaacccaatgccaagtgacacaggagttcatgtattaagaacttaaggcttagtgtggtgactcacgcctataattccagcactttgggaggccgaggagggtggatcacctgagatcaggagttcgagaccagcctggccaacatggtaaaaccccatctctactaaaaatacaaaaattagccaggcgtggtggtgggtgccttttgtcccagctactggggaggctgaggcaggagaactgcttgaatccaagaggcagaggctgcagtgagccgagatcgtgccactgtacttcagcctgggtgacagagtgagactccatctcaaaaacaaaagaacttaagtcaaggctgagtgtggtagctcatgcccgtaatcccagcactttgagaggccaaggcaggtggatcacctgagggcaggagtttgagaccagcctggccaacatggcaaaaccccctctctactaaaaatatagaaaaactagcaaagcatggtggcatgtgcctgtaatcccagctactcggaaggctgaggcaggagaatagcttgagctcaggaggcggaggttgcagtgagctgagatcacaccactgcactccagcctgggtgacagagtgagactccatctcaaaaaagaaagaaagaacttaagtcagagattatcagagctggtccagcattctgcttcaatgaggcaactgaggtctccattgaagatgtgttgggctcagggtctcagagctcttgggagttcaggtaggagccataacactctgtgcagttttcctcgtacctggctatatcattatcagaacagctgtgttgtattgaaatcagtgaaagggagctcgatgctgcaagagacagagaaatcagaccattgtttgtcttggacaaagcagatgtgcactacccagtggatttatggactgagatggcttctaggaagaacagggcaatcagagatgctttccggataccagagggtgggaaggtttaatcattaaggagcaaatgaagagacatgtatatgtggccacattcaagaccacgttattagcttactcttttgtaaaccagtaagtctgacagtgtgtgaaggcccaggcatatcactcacctcctctgtggtctatccagagcccttccgttacggccttcatcctttccctctcttgtcccttacctgtggttggtatgatttcccttttgtaaaatatgcctaactccactcaccacccatcctctatctgctgatctgctgtgtagcttcatccacatgagactcaagagcaatgcagaatgcaaggacagggagttcctggaaactgggtatgttgcctcacgaccttctacccaggcccaagtgtggtcagcctcatcttgctccgtggtctcacttctcagcctgtgcatcagacctttttccccctgttacctgaaagcaactctatgatgaaaagaggatgatctgagacttcagtgggtttcctctcttggttttctcttatttttaaagagaaaactgtggtgagactctcaagttagtctttttagtttatttttatttttttttgaggcagagttgcccaggctggagagcagtggtgcagtctcggcttactgcagcctctgcctcctgggttcaaatgatccttccacctcagcctcccaagaagatggggctacaggtgctcgccaccacacctagctaatttttatatttttagtagagaccaggttttgctatgttggccagttggtctcaaactcctggcctcaagtgatacacccgcctcagcctcccaaacgctgggattacaggcatgagccaacacatctggccccaagttagtctttataagccccagtggaatgtccaggagtaaagctgtcagcctgggggtagcttgggcttgctgagcattgagggagctacacagagggcattcttgccggctgagagagttgtgttgtgaatgccaaggtcggcggctggaggtgggcctggttcttccatgcacactgggaatgggcatagcgtgaagaatgtgagttttgaactcaagggacttggaggtatgtctcagctctaccatttcttagctctgttaccttgggctggttatttattgttcttgagattccattttctcatctgtaatatgggaatataaacagaatctatttttattatttatatatatatatatattttgagacagagtctcactctgtcatccaggctggagtgcagtggcacagtcttggctcactgcaacctccgccctctgagttcaagcaattctcctgcctcggcatcccaagtagctggtattacaggcatgcaccaccatgccctgctaatttttgtatttttagtagagataggatttcaccatgttggccaggctggtctcgaactcctgacctcaggtggtctgcctaccttggcccttcaaagtgctgagatttcaggcattagccaccatgcctggccaacagaatctattttaaagaagagttcacttcctgatttcaggagtaatctactgagcacctcgtgtgtgccaggcaccgatccaggcagaggcgcatggcctgggaagtaccaatatgacgcttgagctagggacactcatatgttctgcaaggggaacagggtgttatgtggattgcataagaaagcatatatgcattgcttaaccccatgcctgatacatacaaagcacttgataaacagtagttgctattgtgactatattcaacactagaaatatgatataaatgtggtcagtgagccagaagaggagtttcatttgataaaatcttcagtttcttcctcaaaggcgtaactgtcttttaattaaagggagtgtattagtccaagttccccagagaaacagaacagacaagatgtagagatgtctataaagagatttattataaggaattggcacacaggagtatggagactggctagtcccaagatctgcagtcggcaggctcaagacccaggaagagttaatgtttcagtttgattctgaaggcaagaagaagctggtgtcccagttggagggtcctcaggcaggaggaattccttcttactcagcaggggggtcagccttttgttctatttaggcctttaactgattgtatgaggcccattctcgttagggaggtcgatccactttactcagtctaccaactcaaaagctaatctcatgcaaaagcaccctgacagactcacccagaataatgttcaaccaaatatctgggtactccatagcccagtcaagttgatacagaaaattaaccatgacagggagcaatggccagaggacatcatagttgagatagcctagaggagagctgaggacacctgggctgtgctggcaaccaccctgttctggagggaagggtaaccctagctgaggttgggacagaggatgcaaactagtggtcctggaacttgatccagtccaaagatgtgtttttgttagcttatactgttttgcaaatctgcactagcatttaaagattagagagttcatatacaaagtctaaatttccacatagacatttccaaagtctatgtggccacttcaagtcttctcttgaaagactagaagtggccacatagaggtcaagcatccattctcataaggcaagcatcagctgaacccaagccacagctgcccccttagcccagatacccactggcctatcggcttaggctccaccagccatgcctgatgggcttcactcatgcaagttaccactgctgctgcttttggagaaaagacacccaggcctaaacatcagggtcctgcccctgccacagtggggagcccatggcagcagcatgctgtgttctctctgtgggagcacagcagggaggcagcatgagtctgtgttcaaagcacacatcagacatcttactccctagtccccacacagacttctccaacaagctgctgtctaaagtgttctccctgaccagagtcttcacatagttctttgcctggggaggggacttgggtagtggtgggaaaactcttccccctccaactagaaagtagctaaacaactggagagaattggccttgggcaagcagctaggagaggacccgttgctcctccctgcctctatattgtgtaagtttatcccgacatttaaaacttagagctgggtgtggtggcacacacctatagttctagctgcttggggggctgaggcaggagaatcacttgaggccagaagttggaggttacaatgagctatgatcacactactgcactctagcctgggtgacacagcaagactctgtttctaaaataaattttttttaaaaaaaattggagatttcacattaaaactctcatgaaaaaccagcagtggtcatatggaggtcaggcatcttttcagggcagggtgtcttctccttctggtttaaagcaggagaggccctgagagaagagccttgggatgggatcttctagagccacagaatagtgaaaaatacgcctcttgaacaggaggtgtttggtgggagaagaaaagcctctagggaacccagagctgctgcttgtaaaaagctgaagagacattgcaaggaggagggatcgaaccaaccctgcatgtccccagagggcagaagtccaagcagagaccaaagcagtgagaaagcaggcttgcagtgagtataatgtaggctttaccaccaaggagagctccttggaagtgggaacgctgatacataggtggtaaatcctgaggctgaggggcagcaggggctgcacattggggcttctaagtctttttcatgtgcagtgcacatagacaatagaagtatttgcagggcacacaaagtagactggcagggatttgaaaccccaaaggggactgcatttaagcctaaaggttcaaaccatgagtggcctgttttgaggatacttgggatctgttttaatccagtatggtaggacatgcagatgcagagatgactgtcatgaaggaagaagttcgcattcacagacccctcacaacaggagtcccagcacaccacatagggccccgtggggcagcacaggtgggtcaggaggcagagagagtaagaaaaaatgtaagcaggagcatttattgtgatttctgtgggaaggaacatgaaacagcatagcaggtttaggattggctcacgtgaataatttcagcaggctctgggctctcacataggcactgtccccagttacctggtacctactctggggtgattaggacagttggatagtggcctccagtgtgagtgtgacaggaggcagttgcgagtgtgggctctggatgggttggtttgcatatatgaaaggcagctgtcagaaactggctggctctgggagaagcagtccctccagggtcagtggggccccatgtcaaagcatcaaatgtagaaaccagaaaacgtggttattacaaagcctggcccacatgcccttgagagctgaggggatcagtttgcccaagtgcaccagatgcaaagcactgcactatgtgatgtctgcaattcctttcagccttgagatgctgtaaatctaatagcatagtgagctggaaatgacttgggagttcagccttatcttctctttgaacagaagggacctgagtccaaagagctgaaccaacttgattagtctcatgatggattataaagtggggactggaactcaaggctttcccaccatcctgtgaggctggaaggggctgatgggagtggcatgacatcttcatccatgtgatctcacaatcatgaggaggacatgggctcaggagtgccaaggctgcagcatagggagtttctggggcagaaggaagatgtgggcagtagcacagtccctgccagaccagtgaggccctcctgagtccccttaccctgtccttgacatgtagggaactcagagcctaaggtcttagggccaggatgtagcctgggatgaggagacctcaatctggtctcagctttgccctgaaccaagtgtctgacttgggcagttgagttttcctctctggtatcacccttcccagtggtcatccagtcatttccaaagcatgccatcatcatttctgttcaaataaagatccctttgccccacccactagttctgacctgtagatccagggcagaacatatgtgtttccctcgaggaacatccaggtcctagaatccaccagacccttccagtgttaaatcctacagtgctctcattgactgcctcctggtcataagctactaggtagtgaagggctgagaaccagaccccacgtctcctgcctccgggggccgtgttctttccctgtcccatgtgcctctccccgagtgggcacctccctcctccccagttatgcacgggtgcccccagctatatagaagcgtgccatgtccacttatgtctggtttagtattctgcctgtacgacctgtttgttctcagaagagccgtgggctgcactggtgagcagggtaccctgtgttctggagccttcattcccctcaccaggcacacggccatgcaattaggcacttgacacatgatgccaatgttgacagccgagaatagaacccaagagtgggaggttagtctgctcagccgtgctgtgggatgaagaggtttgtggttgccacctcagcttgaggctgagcagagaccagagctcagagtggacgaagcatcagacaggagccccaggtgtgggctgtaaagccatgggagagagtccaggggtgcttgaccttcaaagcccattcaggtctaaagtcctcagaacccaagacctagacccagacaacagggagctgtagagtgggttcaggccaggccaatctgggcaggaccaataggcttggctgcccccaccccaactagtgccattggccgttctgggagggagcagtctttggagacttctggtgatcatcactggtgtcagcagatcttgtccaaattgattcctgtgggcttcttgaggttgggactaaaatgtgtctgagcagcaggtgggcctggactggaatgatcttgaaccacacaaaccctcatgtttctttttgtcagaggcatgtgaaccagagcaactccatcttaaacaggagctaggtaaaatgaggctgagacctattgtgttgcattcccagatgatgaaggcattctaagtcacagggtgagataggaagtcagcacaagatacaggtcataaagaccttgctgataaaacaggttacagtaaagaagccggccaaaacctaccaaaatcaagatggcgatgagagtgtcctctggtcatcctcactgctacactcccaccagtgccacgacagtttacaaatgccatagaaatgtcaggaaattaccctgatctaaaatttctggtctaaaaaggggaggcatgaataatccaccctttgtttagcatgtcatcaagaaataactataaaaatgggcaaacagcagccttcaagactgctgtgtctatggagtagccattctcttattcctttactttcttaataaacttgctttcactttatggactcaccctcaattctttcttgtgtgagattcaagaaacttctcttggggtctggatcgggacccctttcctataacattttcactcctgcgtttagaaccagagactcgctgtgcaaagtgggagtgaggagggtgcaacttgtgtctcacagctccagaggcagagctgccccctgcgggtaaaaggtgtagaaaaactcctttaacatatcctaggaaagacctctttggtactgaaaaccaaccagaaatggaatagataggttgtttttgccaaaaggggcgcctgtcattgaaatatgcagatgcttgaaggaaccagaggaacttgggtgatctgtgatcacggccaacactcagtgttgggtatgtgtagtttaccacgtacatgatggatattatttttactcatgttcacaacagttctgggaaagatagtgctaacatgcccaattttatgggcacgtacactgagattcagggaggtaacaggatttgtcccagatgattagactgggccatgacagagctccagaaatgtgcttgtttcatgccagtgtgataagaactttgcacacctggcatccttctttggctgccatggggaggtcttagttctagtcctgattctgtctccagctgagtgtggtcttaaccctttctgagccagtgtctccttcctgtaaaggggccagggccacctccggaggcaggagagaagacaaagagctagtacactgtgagctctctgtcacatgcactgcctgtgtcacgggagggtatttttactgaagggcgccattacattaaaatggagactccatttctaaacaggtgggcacattatctctagctggaaggagcctcccccaagagcacagttcacaggtaaagattaggaggtgttgagtgcaggtggagaaggttctggaaaatgtaaacctcctcccctacttaacactattcctggcatcacctgcatagtcagtcctcaagggattacttgaaagctagcacaccccagggcatttactttggggaagggaacatccctacctttggttccctcacttgtaaaaacgagggaagtaaaaacaaattatctgacattccctttagctttggttcctgccattggtgagtttacaatcttagttgttacttttctcttttatcaatatctccttctatctttttctttctttctgcttttctctccctcaccttttcttccctccactgtctcatatctccctcaacaaccaaggtctctccttgtagctaacgagtttagctcccagaattatagaccaagacaatgatcctggaagcatcaaatctagtccaggggctttagcccagaccttaaggaatcttgggctatggtgagggattcaggggggttctgcaaatatggaagtattttcagccaaacaatgaagaaataaaccacttcaggagctgaacgatcactttaaacagtatgaaatattcatatgcaagactgttggaagaacgtccctctcacctaatcccctcacctaatcccctcactttttagatgagaaaagctgaggtcagatagataaggtgatgtctccaagttatccgagtgttgctctggggtttaagttgcacatgattcaagagtataaaatcttacagcttatctgtgtgtgtgtgtgtgtgtgtgtgtgtgtgtgtgtgtgtgtgtgtgtgtacacaaggcaatcagaatattctgtcaatagaagcagaaaagtagaacttggttccttctggggctcctgaaaactggggtgtagacataacccccacactctactcccacctgcttcatcttatcccccaccccaagtggagctaggggagagcagcacacagttcccctcctcactggctgtctcctccctgctgcctcttgtctgtggtgaggctgtggagaagtgggttgctgttcttttttctgacttcctgtgtgcttcagaaacctcaatgaacaaagagctaaaggaagaaagggccccggcaccgttatgccaaacatagactcacatccgacacgggggagctggatgcccgatttttatagagatgaaacccaggattcaggattctgactgccctgttcccaacgtggctgcatggggaatgtcagtgcttgggagctggaagtaggtcgcaggcttctcattcttttcaggcttaggtctaatgtatttaaagaggtagccgaagtgagtctttagatgtatcatggaaatcaaaccaacattaaaagggaacatttaatttcctctctgcaaccactgttttttgtttgcttttggagacagggtctcattctgtcgcccaggctggagtgcaatggcacagtcatagctcactgagctttgaactcctaggccacctcacccacctgggtagctgggactacaggcacatgccaccatgccggggtctttttaaaaattttttgtagagataggagtcttgcctgtggcccaggctggtctcaaacttctgggctcaagtgatctacctacctcggcctcccaaagtgctaggattacaggcgtgagccaccacacccagcctaccacagctgttttaatttctctgttttccttcagtgtacaactcagctgtaaccataggagcacatttccatagataatttgcatataatctctggaatcttcatattcccttaattgaatatgcctaagtagtctcctcattacttaccttttagcacatgcaagttaatttacgagtgagtctctccatccaggtgagaacagcatcgcagggaaaaatctgtgcattttatttttgagatggtatctaaaaaaactggactgcaatggcgtgatcttggctcactgcaacctctgcctcctgggctcaagcgattctcccacctcagcctcttgagtaactgggattataggctcccgtcaccatgcccagctaatttttttgtattttagtagagacggggtttcaccatgttgcccagggtggtttcgaactcctgagttcaggcaatctgcccgccttggcatcccaaagtgctgggattacaggcatgagccactgcacctggccctgtgcttttttgatgttgtttttgttattgttgtttattattgtttggacgacacattgctgagctttctgtccataagctcctattctcagggacttgctactcacatcatgatccacaggagactctcggggtcacgtctttctctgcccagccctggcttcctggtgctgtgttcatgtctgattttggatccctgagacctttttctcctacctttcttctgaaaggatagcagtcattttgtgaccttgctcaggaaattttcagctgggttttccctttgtattttatttgatgtttttcaccagggaggaaaactcctgctaccatgtgagttgtgccaggggagacttgccagagaagagctgcctgcagggggatttctcgctaccacatgcagggtttccctactttggaagcctcgtggctggaattttaaaggccaaagttcccccaaattttctgaacgctgaatgattgaaaacacctattttttttttctctttttacccaagcgccttttttcccaataaagggcttgggtaacgacaagaaactaaaactgaaaccacaactctgctctaaaataagagactcagagacacccaggaagggcctgcctttgagacttgtcactccctgagatccatcgtggcaccaaatgtttgccgagctccgccctgggagggaggcctgcagcctgggaactgggagacctgggtcccagtggagaggcctcaccatgtagtaagtctctctcgattcagttctcacagtgagttgagggccaagccagccattcttcagcctcaccgggtgggtaccagaatcacctgagatgttaggaaggtggggaaagagggaggtgttggtcaaaggggacaaagttatttacgtagaatgagtaagtcccagagatctaatgcacagcatggtgactgtacctaagtatgctgtattagatacttcagattggctaagagagttgatttttttaattttagtaattttttaaatttatgcataataactgtacatatttatggggtacagaatgatatttgaatacatgtatactctgtgtaataatcaaatcagagtaattaccatattcatcatggaaagcatttatcatttctttgtgttgggaatatccagaatcctctcttctatttaaaaatatacaataaattattgactctagtcaccctacagagctacagaacattagcacttagtcctcctatctagctttaatttggtatccattaaccaacctctctccatccaccttccaccctgcccttcccagcctattataaccacgattctgtctacttctgtgagctcaacttttttagctcccacctatgggtgagaaaatatagtatttctctttctgtgcctgacttatttcacttaacataacatcctccaggctcatccatgttgttgtgaatgacaagattttattctttttcatggctaaatagcactccatctgttgatgggcacttcggttgatttcctgttttggctattgtgagtagtgctgcaatcaatgtggacgtgcagatatctctttgacataatgatttaatttcctctggaaaaaatccctagtagtgggattgctagatcatatggtagttctagttctatttgtagtttttttgaggaatctccatacggttccccgtaatggttatactaatttacattcccaccaatagcgtttaggagttctcttttctcaacatcctcaccagcatttgttattttttgtctttttgataatagccattctaactgggtgagatgctatctcattgtagttttgattcatatttcccttatgattagtgatatcgagcatattttcatttatctgttggccatttctatgtcttctttgtttttctgagacggagtctcactctgttgcccaggctggaatgcagtggcatgatctcggctcactgcaacctttgcctcctgggttccaatgattctcgtgcctcggccattggagtagctaggattacaggtgcaccaccatgcccagctaatttttgaatttttaatagagaggggctttccccatgttggccaggctggtcttgaactcctgtcctcaagtcatccatccaccttggccttccaaagtgctgggattataggtgtgagccaccacacctggttatatgtcttcttttgagaaatgtcctttcagatactttgctcattaaaaaaaaattattattatttaccattgagttgtttgagttcctcatgtatcctggatatcagtcccttgttggatgaacggttttcacatattttctcccattctacaggttgcctggtccactctgtcagttgtttcctttgctgtgcagaagcttgtagcttgatacaatcccatttgtcattgggaggtcaagacaggaggattgcttgaagccaggagttcaagataagcctgggcaacatagtgagatgctgtctctgtttttttttttaatcccatgtgcctatttttgcttctgttacctgtgtttttgaagtcttacctgcaaaatatttgcccagaccaatgtcccgaaggatttaccctgctttcttctagtagttttatagttttgaatctcacattttagtccttattctgagttgatttcatgtatagtgagagatagggatctagtttcattcttctgcatatggttattcagatttttcagcaccatttattgaaaacactgtctttttcccaatgtatgttcttggcatctttgttgaaaatcagttagctataaatatgtggatgtatttctgggttctctattctgtttcatttgtctgtgtgtctgtttttatatcagtaccatgctattttggttactttagctttgtagtatttttgaaatcaggtagtgtgatgcctccagctttgctctttttgctcagaattgctttggctatttggggtattttttgattctacatgaactttaagattgtcttttctatcatatttctgtgaagaatatcattggtcttttgatgggggttgcatggaattcgtagagcgctttaggtagtatggtcattttaacaatattaattattccaatccatgaacatggaacatttttccattttgtgtgtgtgtcctcttctaattcttcccacccccccactctcccaacacacgccgagatggagtcttgttctgtcacccaagctggagtgctgtggtgcaatcgtggctcactgcaacttctgcctcctggttcaagcaattctcctgtctcagcctcccaagtatctgggattacaggcacgtgccaccaggcctggataatttttgtatttttagtagagacggggtgtcaccacgttggccaggctggtctcgaaatggctggtctcgagctcctgacctcgtgatctgcccaccttgacctcccaaagtgctgggattacaggtgtgagccaccgcgcctggcctcctctgtttctttcatcagtgttttatagtttccatcataaaggtctttcttggttaaaaaatatcctctcttattaaaattattcccagttattttattatgatttttgtagttatcataaatgagattgtttagttttgttttagataaggtctcactctgttgcccaggctggagtacattggcaccatcatagctcactgcattcttgacctcctgggctcaactgatcctcccacctcaaccttctgagtagctggggccacaggtgtgcaccaccacacctggctaatttttttttttttgagacagagtttcactcctgttgcccaggctggagtgcaatggtgtgatctcggctcaccacaaccttcgcctcccaggttcaagcgattctcctgcctcagcctcccgagtagctgggattacaggcatgagccaccatgcccagctaattttttgtatttttagtagagacagggtttctccatgttggtcaggctgatctcgaactcccgacctcaggtgatcctcctgcctcggcctcccaaagtgctgggattacaggcatgagccaccatgaccggcccaacacctggcaaatttttaaatgttttgtagaaacatggtctccctatttgtgcaggctggtctcaaactcctggactcaagcaatcctcctgcctcagccttgcaaaatgttgggatgacaggcatgagccactgtgcccagccaagattactttttctatttattttttagctagttggttataagtatacagaactggtttttatatgttgattttatatcctgcaactttatcaaatttgtttatcaactctaaacaatttttggtggagtctttaggtgtttctttatataaaatcatgtcatctgcaaagaggaacaatttgacttcctcttttccaacttgaatgcctttcatttctttctcttgcctaattgcactgattagggcttcctagagaatagatcttaagtgttttcactacaaacacaagaaaaggtaactgtgtggagatgaatatgctaattagcttgactataataatcaacttgctatacagctcaaatatatacaatttcagtttaaaatattttataaagaatcacctgagatgttatggagaaatacagatggctaggccccaacccccatggtctccatgcactaggtcaggttaaggcttagagatatttacactatatattccagcgatgccaacatgcatgtaaacagggtgaagaacccagggaccaagcgctgtctgaggttgtttctcatctaacagcaacgttttaccattagaacccagagccccagaggaccttactctgggggtgtctatggaatgaggcctccttcttaggtaggtctgtactctgaattatagccagaatcttcatcactgcagggcatagcggtaaagagcccacacctgtagccccttctgactccactcaaatcacagttctgctctcgacttgctgtgtggcctttgggaagttactctgctcatcctcggagacctcatccatgggacagggggtaatggtacctagcttttgggtttttcttaggatggactgggctcattgtgcatggaaagtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagagttggcgataactttctgtaatcctaggcatctcttctcttgtcacatttcattgagatatctgtctatcctatttaacccaagcctgattttggataggatccagaaatctaggtgaatttcaggggcctggttgcttcctcatctagcttggtggtaagaagctcagcccctctctgtgggccatgtggagagtacagaaaataaaactgtatcagggccgggcgcgatggcccatgcctgtaatcccagcactttgagaggctgaggtgggctgatcacttgaggccaggagttcaagaccagcctggccaacatggtgaaacctcctctctactaaaaatacaaaaaatagctgggtatgggggcgggcacctataatcccagctactcgggaggctgaggcatgagaatcacttgaacccgggaggcagagtttgcagtgagccaagatcatgtcactgcactccagcctgggtgacaaagtgagattccgtctcaaaaaaaaaaaaaaaaaaagacagtatccgaggaggagatagagattgatgcataggagagaggtccagtttttatccttgtgcaatagactttacacatttctaaaatatatttaaccaaaataacaatattataactgatgtaacttaagatctttaactgcatgcagttctaaatgtggattgtgtttttatgtagttctaatcagtatgtaaatttcattctctgtcacttaacatttttatataaatcttttcatgcactactcatatttttatcatagtttttcattattgctagtgctccgacttccccctgagcattttgttttgattctcattatttcactactataaatagtacagctaggaacatctttgtgcaaatgcttcacacccctcgccttggatagatgcggtatgtttcccaacgttgggtagcaagatcaacacatgtgagttattttgtatttaacttccttgcttcagaaagccagttctgagtaattggcaattgtactagttcatttcaagtccatgaacataagtttttcttttttttccctaggtaacttggcttgtttaataggtttatggtggttccttaaagttgtttttattagcattttcaactgctgagggcttttctgtctatttttaattttctcaagtcttttcacacacaggtggcatcctgtttgcttgaaggggcattaaaattgctgttttatccaatttgcattaaaatgaaaactaaatacatctacagattggggctcggtcatgttgaatggttttgaggtctgtttacataaagcaaatgtttggcgtatactaggtttgcaaagagtggcagactagggggttggcaggtgaagcttgttcaagacaatggttttgttggttttaaggtgttgagagatggtgggctacatctgtacagttagacttgggtttatactttctagttaaaaaaagtacctgaggtttttttttttttaatcacctacttttttttctgtttattacatgtatcataaaatataccttaatcaagtcctacatatccatgactatatacatattaacatgtcaaaagtctgcattcctttccatacatgtatgaggaatttgtgtttgagcagaattctgggggctacatcagaaaagcaggttcatctgggctgtactctttggcacagaaataagcttgatgtgtggagaccaagctcagatcaggggtggagggaaggttgggggtcactcactgctgggatgtaggctgtggactgtgtttgttggggtacagtggaaaatctgagctctggtcttatctctgccactgaagaaaggggaccccaggcaagctgctcagtcagtcgcttttcctcatcctcaaaatgggagagcagcctgccttgggagatatcagtgaggtagcaagggtgcaaatgctatgaagggagattcagcatgtgatatgcaaatgtgaagctcctcttcctctagctgttacatttcttcttaacgttgatttggatgaaggagtcagatccatctttcacgggacagtcctacaaccgttcaaaaccagcaatccatcctgcgttcccatgactcactctctctttggttttaggggtctgcaccatgtgatagggccttgttgaatgcccttgccctagaagacggcctctcaaaccccaggccctcagctttcactgctgaggtgggatcgtgtgtgcagagcccagagggaaatcaccatagtttcttaggggttttctggtaatcccaacactacattaactttttttggcagccacatcatagtgactaacagtgaatttacagttagcctaaatcctattttttaatccatccactgctaaaccacatctttctcatcctagactggggaaggctttttttttttttttaaatctacatgaagaatggctcatttatcccacttcacaagttgcgttttgttaaacttggcatgacttaccagcctgtgaggatttcaagaactttttttgatcctctgttaaagccataatctctcccaatcctgtgctcaacttgatgcttcttgtttaataaccacaagctccttcatacccaattaaaaggcgtgaacaggaacaattaaaacaacagtctgccatccaggttaatgcagacatttgattagcagtctttagaagaaaccatttgaccaactaggaattcacctgctatcatctgacctccttgttaaactctcaagaaaatggggaagaactcagacaaattgaagcattgattcatcatggtaccaaatttctccgctcagcaaccaactttgtgacccactcagagggggacatgagatttgcaggagttggaggttgagagggaaggaaaaagctgagatcatgatttgaagaggagaagttggaggataacttggtttggggttaaagatgacaaagagtgtggttttgaaaataacaactttcagaggactggagagtaagagaaaagaagctcttgggaggaaggggcacatggtaagatgctatgcccccatgcaccttgtacattgttgtcttgaagtactgggtggtgccaccactacaggcaacaagtgggacatcaactgtcagaggtggcttgaggccagggaccctgagatctgccctttttgcccagtctgtcgctgttcagacagtggtgtgctggaaccaactctcacaagccaatggtgtccatttctccccaactcccctttcagtgccatcatgctggtggcttggaatcagccacaatgaaagtatttacaccagagaaattggcaagtgctacaaatcaaggcatccttctctcagattgccagtggccacacacacaccaggcacttattctcgctgcccctgtggccttccagctcacacctgtgctgtatccttgtgccagatttatatttttaaaatgaaaatctgcttttccatggatgatgttcaaaaatttcttagcagattgccaccttctggtctcatttcccaatgacccctcacccaccctcttcaccagccctacaggcagcatgtcatggggtttcctgatctttctgggtcactttttcctaagatcctgaggcccagtaggcaggttctcttctgtgatcatctggtcccatgcttagagttctattagagaccgtagcaggctgtggctgtttttgtgtgttttgttccgttttatcttttttctttttactggattatgatctaatagatggggaccttcttccctcttctgtttatcttcatagctccaggtctgctatggttcctgaaacataggaaggcagagagaggagggaaggaaggaaagaagaaaggagggagggagggaaggaaggaaagaaggaaggaagacaggagggaagacaggaagacactccagccaaaaggcattcatgacctggcaagtaaggagcacaatgagtataatttttgaagaactaagagaagaatggagcccagaagtcaaataggagataagaaaaatctggctagctgcagggatcaaaggctttgaggggaggagaggttcctttagcaagaaagcccagggtaatgcatccctgttgctcccctcctgccccgcaagacccccccaagccagctggcctctgagctggcaggagctggcaacagggggactcccagtgggtaatgggtgcgggggtggggagctgaaaacgtggtaaagtctcaacaaatgcgttttgtattacattcaattatagctggcaataatcacaacctttctggttctttcctccgcaaggtaatggggagaaagccttggagaggagggaggtgatttagcaaatgctggactggagggccctggagcaggcagaatgctggccctgcgggaactgagggctgagagggctctggttggggagggggcactgtgaggagccagcagggcacagccttgcccagaaacctaggaccagctccctgagactgcagggtcattgccaattagttaagtggctgcactcagcaggcctttgggataggaaagggctgcgttctccatcttgttgatgtggaaacagcaaggggaagtgattcagaggcggagtggaaataaagtgtgtgtctcgtgacattgtgacttctgctagatccaaagggctgcacttgactgtctcctgggaagcttccttccatggacaggcgcctgtggtgctttcgagacaggcaatggggctgtgcaggagcagaggagagggaggcatgatctgtggaggtggggcaggtgcatggaggaaggcagggctgggtgaaaaggcagcctcagtgcacggagcactggaggtagaaggggctgccacagccacctgatcctgcacttaggaggtcagtttagattttttaaaagtcaggtttaaaggccaggcatggtggctcatacctgtaatcccagcactttgggaggttgaggaggaaggatcacttgaggccgggagttcaagaccagcctgggcaacatagagaaaccctatctctatacaaaataaaaataaaaaattgaactaggcatggtggcatgtacctgtagtcccagctacttgggaggccaaggcaagaggatcacctgagtccaggagtttgaggctgtagtaagatatgatcacatccctgaactccagcctgaacaacagagcaagcccctatctctaaaaattaataataattaaaattaaatttcagaattaaaaagtgggtcttagtattatgtttctaattctctcttcttccaagtcacagacacttaaaaaatgtatgtgccaaggagtttgcagaagtaatggaagtaacctctgatactccagaaaattctgcaggataagtaatagtgacctcatgccccaatggaggaaactgaggcctacagagattatcttgtccagatcacacaacgggtccatggcagagactcaaggctgccatgttgtcacactcacgtaatggcccagttgtatggcttaccagccctgaagaaagtggtttaaatccaggtttgaatgagttaaatgtacgcgccttctccctgacatcatacggcctttctgactaatgggcccctttccactctctctcaaatcaggaacagaacctttttttttttttcttgaggtgaagtttcgctcttttcccccagtctggagtgcaatggtgcaatctcggctcggtgcaatctcggctcactgcaagctccgtctcccgggttcaagggattcttttgtctcagcctcccgagtagctgggattacaggcacgtgccaccacacccaactaatttttgtatttttagtagagaaggggtttcaccatgttgatcaggctgatctcaaactcctgatttcaagtgatctgcccacctcagcctcccaaaatgctaggattacagtcgtgagccactgcacccagccaggaacagaactttcagtcctcaagaccatgcattttatgtttgggactctcagcatcccctctggtgtctgcctccccaagaggctaagctgtttactgaacacaacatgtgtaacattaccctacaatgtcttcaaaggcaagagttaagttttcctgtgatatttattcctgtaaccctagcatctcccctgtgccaggggcacagtactaggtgcagttacaacctggtgcatctggaggggacgtaaatgctgcttcagttccccctcctgcaggcaggtcaatgtcttgccattcaggaagagcataatttattttcttcctgaagatcttaagaactcagagattgtccatcctcctgtagtaccctttgcagattttggccaagaagttcttacagacaatcagaagttttcctgttttaatttgagcccatttcttgtgtttgttattctttgactttgattgtggcagatttgggggccaggaggcaaaccgaagcccaggatggctcagagccagggttttcactggtgccacaggatgtagtctcctctgactctgctccgacggtctggggcagaccaggaagcagggaggacagaatgccagggcttggagagccaggaaggtctggagaaaggggcagagtttttggctcatgagttgagcatcagaggattttgtgatcattaaaggccagagataggctattgacgagtagttcaaataatcagacaatatttagaggcgtgaacaagttctatcatcaagaagaagagctggagtcagcagattgttctcatctcttcccaactcagcattcagtggtgatgtgcattggtacctgaaggtcagtcatggtgggaatttttacactacggaaattggcaagttctacaaagcgagcttttttttttttttttctggagcactactgacaggaggagcaagatacagggaatacaggtcatcagacaagattttggaaaaaaggcaagtgaaaatagtcatgatgatagagcctttcactggtgtcccactttattgcttacgaggaactctcacttatgttttctcacttcatcttcaccacccttctatgaggaaaacagggtaggcagcattaccctactttataggggaggaaaatgaggctgggataggtaaagttacttgcacaagattttagagccagtcagaaaatgagctgggagcagaacacaggcagggtgagcgcaagggaagatggcatggaattgagagctatgttctctcaagaacctgaagaggggtggcagatgccttcctttcatggaaccgttcatttactttgcttcaaagagttctgagtgttcattacagatctgtgtctacagctcagagttttgggtgcacttgaggaagttgccatgtgtcaatagagacatgggcaccaccttcctgggcctgaggcttttgatcaaacctatattctagtgttgagtccgtctaggacctctcaagacaaagtcctggcacaagaagggtgattatctctaagccaggagaggttctggattcttcactgactgggaatattcgatgctaattgtcatctttatctttcgtggagtttgtgccgcccttaggggatttcaccttcttccaaggcagctggggaagtgggagaaactgtgggttttgattaaaacctggtttgggatctaagtttgctacttagcaggcatgaatccttgaccaaatggcttagacctttttgagtgtgtcaccatctgtaaaatggccatcttcactcctgcccacctcccaggattgggcagcagattgttgtgcaaagaacttgtgtttctgtatagatttttaaattgtaattacttttggaatgagcatccacagcagatgtttctgctgcaaagggctaaagggagaactgaggaacttgcatcaggctgaaggtagaggtagattctgggtgacagaaatgactgctgaaatatttctccttgagctatgttggtgactgcagttagtggctcttgaatcaggggccaagggagagtgaggaagataagacaccagagtcctccaagcacgctgatgatgtgtctgggtgggctgcattgggtctgatgtacagtgtgaatctttctctttggtcaggaccgatatgggagttggctcctgagtgggctagaccctgcccagccaggctgcggaatgggaggacaactatcagggtgtggtttctcattgctacatttttttcttaatagactatttttagagaagtttttgtttcacagcaaaattgagccgaaagtgcagagtgttcccacatgcaccctgccctgacacaagcaccgcttcccccactatcaacatccctcaccccccagagtggcgcatttgtcacagtccatgaacctgcgtggacacatcatgatcgccaaagatgtccaggggcctcagggccataggctcactagatacagtatatcctgaagctgggacctgctgtatgtgtgttgcctccatagctgcatatacagtcacctgtcacttaagggtaaggctgcattctcagaaatgcatcattaggcagttgtgtgaacatcagagtacttagagaaacccagatgctacagtctactacacacctggactattgctcctacagacctgtacagcagattactgtactgaatactgcaggtaattataacacaattgagggtataaataccctagatccctcactctctgggttgggtacattctgtcctggttcctagagtttccagcaggattaaatggcagttgcccaagtgatcacttacttgatcactctttttgactgttttcccttccctatcatcatttctctggtttacttacacaaacctagatggtacagcctagactatatggtatagcacatggctcctacaaccctatacagcaagttactgtactgaatgctgtaggcaattgtaacacaatggtaggtatttgtgtatctaaacataggaaaggtacagtaaaaatacagtgtaaaagataaaaaatggtgcaccggtctagggcacttacagtgaatggagcttgcagaaccgaaagttgctctcggaatctgcgagtgagtgtgagtgaatgtgatggcacaggacattactatgcactactgtagactttataaacacggtgtacttaggctacactaaatttattttttaaaactgtatttctttagtaatagattaaccttagcttactgtaatgtttttactttataaactttttttaaagcttgttgatgcttttgtataatacttagcttaaaacacatgtgcattgtacaactgtacaaaaatattttctttctttatacccttattctataagctttccatttctaaagatttttattttttattttttttactttttaaacgtttttattaaaaacaaagacacaaacacacacattagcataaccctacacaagatcaggaccatcagtatcactgtcttccgcctccacatctcgtcccactggaagctcttcaggggcagtaacagacatggagctgtcatcgcgtatgagagtaatgtcttcttctggataccccctgaaggacctggctgaggctgttttacagttaacttttttttttataagtagaaggagtatactctaaaataatgataaaaattatagtagaggaagtacataaaccagtcacataatctttattatcattatcaagtgttatgtaccacccgtaattgtatgtgctagacttctctattcctggcagtgtggcgggtttgtttataccagtgtcaccacgaacacatgagtcatgcgttgtgctctgaccttgccactgttatgatgtcactaggtgagaggaatttttcagctccattccactctttggggaccaccatcttatatgcggtccaccattgcctgaaacatgattaaatatgccatattgtgctgtgtgagtatatttgcctgttgtctctctgactagagtgtgtgctctttagggaaaggcatgcttttctcatcttcataccctgtagcagggctgccactgttccctcctgtgtcccctgggccctgccatttcagtacaatcctctcttctacccacctgctgccagctctgcacctctgtgcctgaggactttctcagctctcccttgtgcagaactggctggatatgctggaacaatgactgtaagagtggtgtataaataccccagatccctccctctctgggtggggtccattctttcctggctcctagagttcccagtaggattaaactgtggttgtgcaagcgataactcacttgatcactcttattagctgttttcccctccctgtcatcatttctctgatgtttcctggggttacctctcaaacgacttccccctggattccttgttgaaggtcaggggatccgggttacatcttcactacatagcagagtattgacacacaggacatgtccagcagatgtttgttggaaaatggtatggatacctctagaatagacagatacttccagaatatatatatatcttttagataagaatatatatatcttaaagcagattgcatattcttctctccataggtcttatgccacattttgctgcccttgtggactctgagcttggtgctgcctgttgtctgcctgcccctgacctgaaggacatgcccagctccttctctcatccttgcctctcttttgcatcttcgtaatacatattcactttttaaaaaaggaatggctctttgaagctaatggctatctaaatctttcttttctattgtccagcacagtgtgaataaatacatacaggctatgattccacttttcaaatgtgtgactccatgttcgtgttttaacattgtcaactccatcattttgcccccaactcctggtcaaggaatttccctccctctaaaatcacagtctcttcttagaaaggggatatttttctttaagaaggggtttcaggataagagctaagctcgttctagaacagtggtttccaacccaggccaaacgttagaaaagtcctgggaaacgaatatgtcaatgctcagcccagaccaatttgacagcagtgtctgaggttagggcttggtttagggtttctgaaagcttccctagtgattatgtggagctaaggccgatgccatccatctagagctagaatatccacttcttcctttgggcattccctgctttagatcagtgggagataaaccctactctactgagttgtattggacctagaggccaggaccaatgttgctgattcaaggtgaactacagattcctaggattcttatcatctacatctgtgtcaacccaggctgtctgcagaactgggctgggttttctagagtcccagctcagctccttcccatgtgcagcatgcccttccctgcggggctgctgggcagagcgctgttcctcttgaatcctcctgcatgtgatcagtgatgtctatgtgatgagctcctgtcagacggaagcctcccaccctgaaagtttttgttggcagctgaggatgggggtggacagcatcagttgacagcctggccctccacctgggccctttcctgccttctccattcccattccctcggggccacttcttctccaatctgtttcttctcagattttccgccttgtccctgttcctctcctgctattttctactgtctcactctttgctttttctgctcagctgtgccttggaaccaagctgtgaccgccttctctcacagctgcctttgctaagggtgggccccttgcctgggtgccagggtggagggaggaatgggtcagagagaggggcttccaggagacagagctcatacccctgggagccccaagtctgggtttcatacctggatgcttctgcaacttgcccctttctgctgcatctttcccagtcaagagagccaggtgccttgcaggggagcttttgggaatgggagaatatatagcatttgtgtctgtcttggagctcggtgggtgctgtccctggggccatgaggtatgtgggcctgtgtggggctctttcagggctgaccctctgctgtctctgcaggactgcaatgtgccgatcttagctgctgcctgagaggatgtctggggtgtccgagcccctgagtcgagtaaagttgggcacgttacgccggcctgaaggccctgcagagcccatggtggtggtaccagtagatgtggaaaaggaggacgtgcgtatcctcaaggtctgcttctatagcaacagcttcaatcctgggaaaaacttcaaactggtcaaatgcactgtccagacggagatccgggtaagtgtgaagtgtctgccctgtccatctgtctgtccctctgtcttcttcctgggcagctgagcagctctcctgcagcctcgcagctctcccatatccacccctgggtggaagaggtgaggtggcatcagagagatgtgctcagcctgcatcaccaggcctgctctccagatgttcccatactacttctctaggagcctgggaaacacatgttgtagcctttgcttgaaccccagataatttgtttggcctctgattcaattcatttcaacttattaagtatttatgatacttgaagctctgcaagggacttaaaagctgctgtcctcaaagagtttacactctgatgaaataggaattagagatacacaagtgattgcattaaaaatagaacaaaactggtataagccttgtgtgctgagcatgtacaggaaggcactggtggggcacttagaggatgacaatgaagtagaggtgctttgagccaggtggagggttaacaggtgccctgcctggcaacacgtccttttgctcactcctacccagaatcacaacatctgttttgcaggtccaggtacccaccttcatcagggcacctggacaccaggatgccagttcaccttaaccaaatgtatatgagattgtcatcataagcagagctccaacatgctgaactaatttcagtcatctacatttattgaacaattactgtgtggagcctgggccaatccctctacacacattattccattaaatcttcccagcatccccatgagtagatacactgaggacatacctttcctctgcccagagcacccctttctgatgatgggagggaaatccagattggttctcaggttgcttagtgggtaatttgaacaaaggaagcaggaacttttgggaaagctaatcaggtctgaggacatgggatgagccatctccagctcatagccaacctttcccatgtcctgaaagccagtgtccctaaactccatgaatgtttcctttcgttagtactgctgtgccctggccacatcatcctggctgccttccgtctgctatagcacacgctgtgcttccacacaccagagcagagtgtaattgattatgtcactgtcatggccagttatcaccattgattacagtttgattggctctctctgtttcctgtaactgatttgattagggccttgtttgctcatctttctgatataaaggcacaattgtgtcctgagagtaagccctggtcatcttcctccaggaggatgttttcctctctctttatccacttcatgagtcttcctttgggtatatcatttttgcaaagagctgatgccatccactgtgaattttactagtttaattttcagaagttaacctgatttccaagtttagggaggagcacctcattgttcttttgtgctgaaaaacagagagcagcaggttagttcatattaggacatgttccatagagtcagcagtgaaaagggtcctgaaaaagaggtaggatttaaagcagtgacactggggacaggaagaggctttccaagagtggggaacagcatgtcaaaaggcagggaggcctctgaacagtaagtagttcagtttgactggagtatggattatatttagaaaagtatctaaaatcaagatcaaaaaggaaagttgacagcagagaatgaagggcctagaatatcaggcagagaaatttggaaatggacaggcactagggaacaacacatatttttaagcaggggcaagatattcctggagttgtatgatataccctgctgggtgtttaagggatgaaagtaacacaacaggcctatggagaaggcaatgagacccaggcttaagaagaatggctttgaggcattatctggggtcggtggggaacagaggtggagaacagaagtgactgacttccaggaatatgtccaagccttctgatttttcctgcttccaatgtctcctgcaggcaaaatgccacctgcttattgcaaatagctgagggtttaaagccacttagacttctagccaagtcctgctccatccttactggttgtgtggcctgggacctaatgattaactgatctgggcttcagtctcttcacccggggatcatgctgtaaggattggagatggtggaggagaagcacaaagcacacagcagtgcccataactggaggctattgactgtgtgggtattaggttattacccagctcaggaatctccaagggcctctaattgcccagagaataaagtgcaaattgtcttcttttggtgtctatccaggtatctgtcttattttcaaataaagaagtaatatgatcagatttgtgttctaaaacaacaacatggtgttctgcaagatgttaagaagtgtgccctcgggaagggaatgtgtggtcaaaaagattgggaaatgtttggttaaacaattctgaacagattcttttgcaataagacttctcagaaccttaaataggctgatatgcctggtaaatcactaagaagggccacagaggtgatattttcttaaataaacaatttcttatttgcctaaaaaaccctccttttaaaccactagatctctggccaatcatttagggaactttttcccctaaactctgacagcagagaaaaaaggattgaattaaaaaaaaaaaaaaaaacctggccaatgggagatgggttaggaggctgtggtcatactgcaaaaggaaaatgatgaggacctggactaagagaatggtgttgggaatagagataaatcaacgtaattgagtacatctaaggagacagagtcaatagaatttgatgattaactagatatagggagggaaagaaaggaaggagaaaaggatgactcaagcttttgcttgggcgactaaatgggtgttggtactattcattgagatccagacagagaaagggagggcattctgagatttcagctttacatgtgttgtgtttaaagtgtttatgaaacacccccacggaggagcgtgggtctggagctcaggagggagaaagaatctagagacaagattcgggtgtcattatgcaatggatgccatgcaaatgggtaggcttacccacaaggaatgagtagaacagaagaaaaacagatccagcacgaggtcaggcgttcgagaccagcctggccaacatagtgaaaccccatctctaccaaaaaattagctgggtatggtggtgtgcacctgtaatcccagctactcaggaggctgaggcaagacaatcacttgaacctggaaggtggaggttgcagtgagccgagatcgtgccattgcactccagcccaggtgacagtgtgagactccatctcaaaaaacaaagagatccaagtgggaaacctggggaaatcgacttctaaaaggctgatacagaaagagcagccaatgaaggaaaaacaagaatcagtcaagagaaccaggagaacaagagcaagagaaccaggagaaccaggagaacagaatctgaggagcccaaggcagagggggctttaaggaaatagtggctggtagtgtcagatgctcagaaaggatcccagataaggttagaaataagtgcatggctttagcagcaggtgccaggaatcatctttgtttgggcaattttagtggcaagatgggggcagaacacattgtgcaatgaattatagtggagacagtgagtataagtaacatttaagagaggttttgaccaagaaggaaaagaaagaagggaaagctaaaggaacagtgttcactgcggagggaacagcatgtgtaaaagtcctgaagtgggaaggcacatagcgggtttgagactaagaattgctaaagtttggctatttaaaccatgttaaccattttggttttcattccatctcttatgggaagccactgatataatttaaaactatgagtgacatgagattgtgctttttaaagatcacttgggttacataatggaaaatgcattggaggaaggcaggaatggatgtggggaaatgttatgtggctattacattgaatcaaatgagagatgacagtagcttaaattaagattatagccatggggatagtgatggtgatggtgatgatgatggtgatgatgacagtagtggtgatggtagtgatgatgatggcagtagtggtgattgcagctagcactttggaaagcaataatatgcatcatcatattgacttctcaaaagaacccaataaagcacaaactattattatttccacttcatatataaggaaactaagcacagagaatttaagcaaattgccagtaaggggggaagcctatttttaaacctaggcaatgcccttccaaagcctgcactcttaaccaccgtgatcaatggagagaagtgattataatccatagaattgaggagatgaaaggcttttgtaatgacaggagattcacgaatgaggaagagggaggtgtgaagaatggcagccctggtctgggtggtcagggtcccattgcctaagatgagaaacactggaggagaaatccactgcagagtggggagttcacatgcccagttttggacctgtggagtacaattgagacacattaacatcttcacatggaaatgctgagtagatccttggatacataattctggaggagggagccaggttggtcgtagacacttgagtgaggtcagtccaaccatctggtggttgaagcatggctgtgaatgagatcatttgggaaagggttctgaattactccatcatccactccacaaatgtttgttggatccttccatgtgcctggcatcatggtagcatggcctagggtattagcatatcccaaaacacaggtgtactccctgctttcgtagggcttcctggccaagagtgagactgacatggactcacactaatgaatgaaccttctcaatctgaagcatatgctcctacaggaaaacataggtcttgtgagaacaggtcaccatcatcatctccatggctacaaccttcatttaagctactgtcatcactcatttgattcactgtaatagccacataacatcttcccacatccgttcttgcctttctccaaagtattttccattgtgtatcccaagttatctctaaaaagcacaaccttatgtcactcctaggttgtgagagcaagactgggtttacatgcagaggagcagctttgctgtgtagtgcctgtgtggggatgcagtgtccagttgggagtctaagcccaacttccttgtctgggaccctcttggagcagcccttcttctctctgcttcctgacttctttttgcagtctcctttcctagcttggctttatcctttgatggagttttctacttccatctttgtatcttcctttcctcattttcccagtactcagaatgctgccagccctttcaaatttgccaagcacatgtccttccccaagaacacttctgagatcctgacacccccacataggagtgtctgatcaaatggaagcagtcgcgaatcgccctgaacagtccacatggcaacacatttccaaaacatagttactccatgcatatttgctgatttcatgttttggtctttattctctgcttttttttctgcagacgtagtagcttcattgtgatttctccatgttgtaaaaagctttgtgaataagcgctggcccctgtgcctaggacctaaaagaaattaggcaggtgttgcagagaacaatgagaaattgattttgctcttctggattttctatttcctttttgtttgatattcataggaaattgtgtttgtttaggagctctgaatttctggggcaagcagaggctcatatcattatatttttctctacagtgctaatttgcttgtctgggaaaaggggtaagatgacactctgaaaacaactggcagagtggcacccagacgtgcccacacagggcggctctctttggctcttgctgctgctgctgctgctgctcctcctcctcctcctcttcttctttctttgttcttctttcttctgtcttctttcttttttcttctttcttctctcttctttcttttttcttcttctttctcccttctttcttccttttcttctcttcctcctcctcctcttctttctccttctccttctctgcctcctcttcctcctacttctcctcctcctctctctgtctatctctccttcctttccctctcctttctcttcttctcaagccatatgtcctgatttgtctcatccccagtttctatacattgcccagggatgactatccacagtgcccctgtcctgccagtctcaaatgtatcatgatatgggtgacaatgacacaataatgacatggtcaccttcgtctaaggccctgctctctcctctccctgcctggcacactgaccggctgactcatggtgttttctccctccagcttcctccagttgacccactcttttcatgtgctcatctctgcctatcacaagaccatcttttctcacccaggaagacattgagcagaagcagagatattcatctggggtatggtgttgttcagaggtgccgatggagtcctctctctcagccagtttctaccaagctggaaacctaggttcaagattcatccttgttttgtcctgaagcatcaccccactcagaattcacattcacatcctcaggaggggcagaggctgcagccatcctgtgccctccccacccagtctggatgcatccctcccacccgcagcagggactccaggttgcaggggtggccttgggcattgcttgcctggtgcatgaggaaggctgtccagttccaaatgcagcctggtccacacacacctgtcctcaccaccacccgtgtgcattcagtgatcatacaatcccttccagaaatccccagaggcagactgcagatgtcagaacccattgactttccccttcgctccttaaacccatcacacactcatcccagttagctttgagtttaatctattgttactcaaccagacacaaggtgcacagggtgttatggactggatatttatgtcccctcacccccaattccatatgctgatgccctaacacccagtgtaatggtgtttgaaggtaggggtattgaaaggtaattgggcttaggtgaggtcatgagagtgggggccctataatgggattagtgtccttataaaagaggaagaggctagattcctctccctctccccctccctcccttcctctctttctcttcctctctctctctctctctctctctctctctctcttagccatgtgaggacagaaggagaaggtgtacttctgtaaatgaggaagctcacaccaggagccaaatctgctgtaccttgatcttagactcccagctctagagctgtttagaaataaatgcttcttgtttaaggcgcccagtcagggtgatttgttagagcagctcaagatgaccgggacacaggccagcagttccctgtgcctggaagagcagtctcaggcacacaggccattggctcaggttctctgtatctggaacaatctctgtcaccctccttcagatgctgctagagtagggcccaaggtcacagtgcaagaggtagggaggaggaggttacttgtcctggtaagttgccatttttgaaagaaaagttaccctagagagaataaaatggaagcacacaaggctggtctcccatgcatgaaaatagtccctgaaaaagaggaaagggttcatccaggaaaccacaacccagtgccgcagtatttaaaaaggtatattcacaaggaccttctgcaccccctccctgtttcctgtgtgtgctctgcaggccagcccgcccccacacagacacctacagaggccagcacaaggtagacacgcaggttccgggcctttgtggatctccacgcccacattcattgcatccacaaattggcagtcaggtgcctgggctttcatttctatttttaatctggtagttgcattgctgaatgtccttgttagagacttttatcacgtcaaaatgaatgctttcagggtgttaagttatgctcacttgtattattttgttcttcaatcacttattttagaatgatcccttacatgtgttgcaaactcagaaggtatataaccagtgtatcagttttctatggctgccactgcaaattatcacaaacctggtggcttacaatagaaatgattctctcacatttctggaggccagaagtcctaaatcaaggtgtcagcagggactcagttctcctgaaggctctaggggaggatctctccttgcctgtcccagcttctggtagctctaggcattcgcagcttatggatacttcactccaacttctgcttccatcttcacgtggacttctcctctctctgtgtctcttttctgtatcttttacaaggatgcttatcattggatttggggccactcagtccagagtgatctcatcttgagatccttaacttaattacatttgcaaagccccccatttttttttccaaatgaggtcacattcacagattctggggttaggacatggacatatcttttgggggccaccattcaacccattatgaccttcaattcagatcatagtatctgtcactggtacctccattcaggcacacacagaccagtgtacccagatgtacagcagtgagtgggccttttgtccatttaaaagctttaattatgtcattttggggtatgtgcagaagaaaatagagactcaccgaatgtgtgagtcagctcttctccccaggagccgttccacacctcctggaagttggcagcgggaaatgtgtaggggccctttatagttggcacattgtcatggttctcacgatgattggggctggggcttggcatttggtgggtgggctgttgccatgggtgaacagtcccatacaacaaagaatcctcctgccccaagtgccagtggtaccctgttgagattcactgatgtgaattaggaagcattatggtaccatgaatgctctgaacccagtccccatgtgaaaaataaaactttacctgtcatgttgaagcgacacctgcccctcctgctctgaggcaggcactgcatgtcaccggaaagaatggtatagtaactgctttaaaagatattttagtagggggactttggggggaaaaatctgtgaaggccacctggtactctcccaactgatctttattgttcttcatccctcctcaatctcagcgtggcatcaagaacgcttcatacggtttatgggtaaatcagaatttttgacagaatggtctcatttttaacagaacatttttatttttcagagacacttatattctgctcaatatagtgagcggaaagaaagggccttctaaagaaaaggccttttgttaaccttttcagccttttttctgccttctcagaactctacttcccgtcttcacacacagcagaaggtgcaagggaagagcctgctatccaggccctgggaacataaaacccttcatgattctcttgctccaaacaggaggaagtcatttttctttgccctgggaacataaaacccttcatgattctcttgcttgaagcagaaggaagtcatttttctttgcattgttcatcccagtcactggcatggccggatcagccgtggtcatgacctgatcatcctatgaggctccttgactgcacttcacccacctgctgctggtgctggctccagctcacaaagggcctcagatccctttcttcagggattgcttccttcaaccacctgtacccctctatagggctcagcctttggaagaatttagagccactactggacaggtgctcccgggaggtgggtctccccaggtgccagttcccacccagtcaggggagtcagaggaacctctggcccaaggaccccgaactccatttccagctcacatcttcatgtcttaattctagacttcttgggttaatcaactcctcaggttgacttgacccttgagccatgttcatccttccccccttacccatcacaatgctagctaccattttttgagcacctgctctgcacctaccattgtgctaagctcttacgtgtctgtaacccacataaagccagtcagttgttctgaccttgaagccagtctcagtacagcatcacattccaacatatattagtctgccatctaaaaataactggaaatccatttaaatctttactgtaatctctttgagggagagaactgttggggctcagaaaacaatatccccaaatgaaggcctcagcagcagcctcagaagcaaaagtttttctctgactttctcctgccccctgtctctcagccccactctcccccgaggtgccatagaaactaggattgtcttccccaaggtgggtcatagaaaccagaacctcttttcccccacagaaatccggccataaaacctaaaagtattccatgtaaaaacaggccataaagaaattatctgacctacattgttggactataggtcataaggccttgattccagagagggcctgccctgcacccagcaggaaggaacactgctcagagaggcccagaagaatctagacagacaggcctgtctgggtttccccactcagcctgtcaacattagatcagacccttctcctccaatcatatttctacatgactgtccattgtttgctaaacctaagcataaaaatggacaatttctcctctatttttgggtcttcattctgaaggtacctgtgtatgcatattaagtaaatttgtatgccttttctcctttaatcaatctgcctcatttcagtgatttttttcagtgaacctttaggaagccaaaagccttggcccccacaggggatatcactgggggatcgctgtccagataggtagtaaaatttattaaaattctcataaccgtataccaattaaaagtaaaacaactgtctgtgtctgtctaacccaaggtcagacatggagcattgttttagctctaactggtcaatgtctgtattagtctcctaggtctgctttaacaaagcaccacaaacagagtgatgtgaaacaacagaaaggtattgtatcacagttctggaggctagaaattaaagatcaaggtgtcagcagggccctgctccctctgaagtccataggggaacccgtcctttcctctccctggctggtgattcgccaatggtctttgacactccttggcctgcagctgcatcactcaaatcttgcaccatctccccgtgtgcatgtctctctctgcattcacacttcccccttttttaaggacaccagtcattttagatgacagcccacccgaatgacctcattttaactcgattagtctgtaaacactctataaagtcctgcgctaaggcactagaggttaagatttcaacatatccttttggggaaccacaattcaacccatatggtatcttactagatagatgtataaagttttttggaatccaggggaagaaacaaaaaccttatcacagggagtcagggaaggcttcccaggggccctcatagtgctctctgggccttaaagcataacagggagctcaccaggaggaaaggacaagggggagaggggagccaggggtcccccaggcaggaagaattaaatgtgttcagcacagaggaaagcaagagcatgctgtgttgggggcgaagaaagagagcaactttggagaccaggcacagagcacattgtgggtacagaggggatgggactggaaagaacatgtgggaaaaaaacccaaagggagatttacgccttgtgttcattagtttgggtcttatctgattgtacagaaaatgaggaaccaatgagagattttccaccaaaatcacctgcattgattttgtcctcaacctcagagtgacaccttcttaaataaaatgtaagcaagacttatttttatttttgagacagttttactcttgtggcccaggctgaagtgcaatggtgcgatatcagctcactgcaacctctgcctccgggttcaagtgattggccttcctcagcctcccaagtagctgggttttataggcatgcaccaccatgccaggctaatttttgtatttttagtagaggcagggtttcaccatgttggccaggctagtctcgaactcctgacctcaggtgatcctcctgcctcggcctcccaaagggctgggattacaagtgtgagccaccatgcctggcctaagactttttttcaacaaaagcttaagtgtagtttatttattaaaatgttaagtatagtcatcttactaaaacaaacaaacaaaaaagaatactttgaaaagagtaaggagggtgaattgaattaagcctgggaagcagtttgcaagccactgtcccaggtggggttcctgggaagcagacctgggtgggaggcttgcattggaggaagcgtgttgatgggagctcccaaggcacacagctagtgggagggaagaaagcaggatggggcagaggaaaaagttgggctgcgatgcagccacagcaaaggcctcagcccattccactggagccttagagccagaagagctgtcccaaatcaggatgaaaggacataggtattatgtgtgttcaccagtcactcaatatggatggcccctaggaaaggtgtgaccttaggcaagggccactctttgagtgagagcaatcctggtggaggacagtgggggactcagctgtcatgttgttttcaaaaacccagccactaacatcaaacatgtttaataagcttattaagaaaaaagccaaaaagattaggtattttattagaaataggtgagcctgagaaaatagtgagacaatagagatcactgaagaaagttataaatggatgagcactgacaaaagagaaggaaagtgagctgagtaattaattcattcaaccaccttttcctttttggaagtagattatccagagcacagagacaagccatccggtcctgttgcttctttgtttctgacctataggaagaaaggccagagaatagggagagaggcaaaggtagtttgaagtctttacgctatttgataaagcaactaaatcagtgttagccaagcaggaggaaaagctatagacattttaatgtttgcaagaaagcattcaaaggttcttaataaccaggctgtgagccatgggcagtcggagagcctggaagccctcctgtgggaagaagcaaaggtcttcctgtagcaaaaaacagtcctgggcttacccaaatagcaactgataaaattaagacagtttttaaaaatcatggcacatatggcaatctagtgaatagataatcattatatactgtcattttttaaaagtgatttattaatagagaaagaaatattgactcagtggtagcggtcagggagctctgggtggagtgctgatcttgctgcccctactgtttgcttgagaagctgtttacatattagaatgataaagaagaggattcaggctgaggaaggcagggctcgtgcaagagccaatgcaggtgagagcatgtcaaatctcagcacttacctttctgttaccccaatctggccacccccctgaattcacaccatacctttcctcctacctatgaaatgtaaggagctccttgaggcaagggcctatgtgtgtgcacgagagcccctatctctgttttgcatagtgagtatgtcatagacagttgctgatggtttgaatgaagaagccattctgcagcttaacatgatgaggctggagggctgcagagaggggactgtggctcagggagcttgtcatcctattggaagtacatgtcaaaattgggttctcaccctcgtttgtatgactccaaagttagagctctatctgtgtcactcatggtcaaaaaccttgtttcccccaccttctgtgtgcctaaaggattggcacactttgcaaggcagtcctgtcacagtgcacttctagagttagctcagacttcacaggctgagggtgcatcctccacaagactccctccccttacaccccaattgcaagctccaggattcctaggccattcacacttctgaccaattggctacaagtttgggggtttctgctatcccagcaggttcaacagtttcctaaaacaactcacagaatgcaggaaagtgctatccttacagttttatcatataaatgagagccagccaaatgaagaaacatagaggacaggtctgagggaccccaaacaggaaggtttcatatcctcacaaggctttgccctccagacacaccaacaagatgtgcatcaccaaccaggaagttcacctgagctttggtgcccaggaatttattaggccttattatacaggcatcgttgattgattgattgattgatggaatcactggccacataattggactcaatctccagctccccttccctccctggaggtcaggctgataccatgtggctcaaagcttcaactctctgattacccggttggtctttccagcattgcagcccccatcctgaggctagcagggacccaccatgaatcacctcattagtatagattcaggtgtagtctgaggaacccacagtgaaggacaaaggccatcctaactcttgggaaattccaagggtttaaacaccccctctgcagaaccaaggacaaaaactcatcaaattctttatgatacaccatcagtaaccagcagtggtgacattggtggcaggtgctccctgtcccccaagaacttcaggtttgccccccaggaaagaatgcaccactggtaagaatctgcccagcaccaggcacctcccaaatagcacatttcatgcttagaaagctcccaaggtcttccttacctgaagctgaaatctatcttcctatgaagatatgttgggtgaagagtctcttaatgaatttcaaccccaaggacctcgagttaaattttcctccaccatgtctacaacagaaattggttgcttcttagaaggaaatctgaaaaaaaaattttgtgcaagcagagtcctggagagtttcaccaactagaatcattagctggatttagtctgacccctctcagagactatgggtaggggagaaggtgcacggccgtgtctggcctgatacaaatcttattcaaccccttgatatggtgcctttacttctcaagtggctgggaatctccctcaccagagtctcttctttttattttgaaattatttcatactttttaaaaagttggaaaaaaaaaaaacaaggctaaggactcccatatagctttctcccagatcctcaatggtttaaatttattgttttctgtattgccagctcagtctcttcataagcaggcatacatgcatacacatacacaaatatgcccattatcgttattcttttttctgaactatttgagagcaagttgtagtattgctgccccatcaccggaatgctccagggtttatctccccaaacagggacattctcctacagaagatgtgctgcatgcatctaaatcaggaagtcagcgttgctataacactaccttccacaccatagacgccatccagattttaccaactgtcccagcagtgtctgtttttcctgtctgatccaggagcacacattgcacttagctgtcatatccctttagtctcctccaatctgggagagttcctaaatccaaaagagtacaggccttttgttctataggtccctgaggaggctcttcatcctgggtctctggtctcatgactagatcaggccacagactcatggcaggaagatctcagcaaccttgctgctctcttcttggtgcatcgagacaggaagcccgctgtgcttacctgctgcaccactagggacgtaaaccatgatgatcggttgtttgtgtctgccagatttttttgtgcatttgtttagtacattctgaggctgaatgccctgagaccatgtcaatatcctattcatcatcaaacctccaccctctagcttcatcacccattgatgaatcctgcctgaatcaaccaacactgagtttgttgccaaatggtgactttctatttccatcctttcttctacatttatttcttggcattctacacaaggaagagtattttcttcttccccaattatttatctgtcttagattctattttatttggcaggatgtaactcattcctatcatatattttaatacttaagtaatcctagatgtggccgatgtgagttccttcaggctaatcctgatttgtggttatgtgtccccaatgttctctcaacactttgtttttatatggcacaaaataacgttccaggcacatcttgtacttttccccctagccctggaatcagccatttctgcaaggagctttggattctttaagtggagaaggatatttgaaaactgcaacttggtgctggggtgtgcaatcactatcggctgtcactgcttcttctttttttttttgagacagtctcactctgttgcccaggctggagttcagtggcgcaatctctgctcactgcaagctccacctcctgggttcacaccattctcctgcctcagcctcccaagtagctgggactacaggcatccaccaccacacccggctaatttttttgtattttttagtagagacggggtttcaccatgttaatcaggatggtcttgatcttctgacctcgtgatccgcccgcctcagcctcccaaagtgttgggattacaggcatgagccaccgcgcctggccgggctgtcactgcttctaagtcctttccataaatgaagctcagtttctctctctctctctctgtgtgtgtgtgtgtatctctttctatctataaaaccatgagtcacacctgcacttccaattccaatccttcacctccaaagatttcaaaaatgatgagataggttggctagactctctaggctccccatctccataagagtttcccattatcctcaatacatttacttctttgctcactcccccctttggttacttctttgctcactccccctgtttggttctttgctcactccctgtttggttacaatctcctaatcactccaaccatctctcttggcccaactcctttgacccctgaccttgccaccacctccaaaggaaggaaaaagaaaagaagatagaaaggtagagaaagagaaaaatagaatgaattttgctttgttttcccagtctggtttacagagcaccagtctgcgaaggagattgctgtgtcaaaataaggctaatattttgttgtttggggggctgtttttttgtttgtttgttttttagtatttaccttgggccaagcaccgttctatggagttttatctaatttaatcctcataaaagcattccaaattggtactattattttgtccatattctagatgagaaaaccaaatccagagaagtttagtatgtacccaagcatatccagctgggtggtggtggtgggtggatggggcactgctgcagcctggcaccagggcttgtactcctggctattgctagtctgcatttcagttatccatgacttaaaaggtattctctgctccccaaccctctcccatttgcagagaacacagatttgttaataaaatagcacaaatatttcaaaaatgatgggatagcttggctagactaatctttctccagataacaatgataaaatctggacaaaatataaaagggaactctctgcaagcactggtgagtgcccatagcaagcacaaactaaaaggaaacctgctcttgagagctaaactgtgatgaatgagatctgcaagtttgtggctttttgcctgagagaactttccagtctggaatgggctccaggggcaaaaatctgcagccttactagcttaaagtgtcagaggatacaatatgagattggcagagcagcaagaagattagcagaaaatcatggagagagtaagccccaaaataaaacattaatttttaaaaataatttatagaagcaaatttataaactacttagaaataaatttaacaaaagacctatacaatatatatgttgaaaatgataaaacattactaaaagaaaataaagaagacctaaataaatagagagatatgccatgttcatgtattacaggcatcaatgctgttaagatgccaattctggccaggtgcagtggttcatgcctataatcccaacactttgcaaagccaaggtaggaggatcacttgaggcccaagagttcaagtccagcctggtcaacatagcatgacccaaactctataaaaatttaaacattaaaaaaaaatgccagttctctccaattaagctatagatttaacacagtcccactcataatgcagcagactttttaaaaagaaagtggccagctgattctaacatttatgtggacatgcaaagacctagcccaataatctaggggatggggaacagcggaagacttaaccctatttgacttcaagatctcatgtaaagctacagtaatgcagacagtgtggttgacattggtacagtatagacaaagatcaatagaaaagaaatgagagttcagaaataaacctagatggccaaatgatttttgacaaagaaaagcaattcatttgggaagggaaagtcaacaaccaatgctgaacaaccgtagatctatatttttgaaaatgaataccatatacaaaaattaattcacaatagatcacaaaactaaaaattaaaactgtgaagtttataaaagaaaacatagaatatcttcatgacctggaggcaggcaaagatttcttaggatacagaaaacgctaaccatgaaagaaaatgttgacaagttagactctgtcagaagacattgattaggcaatgcagaatgggcacactacagacctggagaaaatattcataaaatacatcatacaaaatacttttacctagaatgtataaaagcctcctacaactctcctgcaaatgaaaacacaacagaaaaaatggggaaaagattcaaacaaccactttacagaggaaggtatatgaatggcctataaacacatgaaaacatgttcaatatcattagtcatcagagagatgcaaattacaagcacaatgagacactacgcacccactgagatggctaatattaaaaagactgacaacaccaaatgttagtgaagatgtggtgtaacaaaagtctcatgtcacaggagaaatataaaatggaataatcctgacagttgctcataaagtcagacatacatctatctttgatccagtaattcctcttctcagcatttatccacaggaaatcacaatgtatagtcacaaaaatacttgcacattgatgttcatagtagttcaattcacaatagccaaaaattagaaatagtccaggtgttcggaagcagaagaccaaatcaacatattgtgattcatttacaaagcagaacattaccgattgataagtaggaatgaatttctgatatatgcaacaacatgatggatctcagacattatgctgagtgaaaaaagacaccaaaaaagtgtatgctaaatgattccatttatacgaagttctagaacaggcaaaaccaattgaaagtggtgggggtagggtaaggttgactggagaggcgggaggtagtggggccatgagggtggactgagaagggatatgggggagttttctggggatctggaaagttctataccttaattggtatgtgggttacacagttgtattcatgtgtcaaaattgtatagcttcaatttatgcattttaatgtatagaaattttacatttaaagaagaactgtaaaaaaataatagttgagtcacagctggggagtgggtggtgatattgatgaagcaagaaggcagaaggttggtaattgttgaggctgggtgatgcgtacatgggggtttattatactcttctgtttactttgtatatgtttgagatttttgataatcaacagcacaggagttctagccctgaggaaattagatattagccaagtaggtttcagctggagcaggagaggactgtaagttcaaaagcaccagtggtgggggctccaggagggacttgggagtgacgtgggggctctgagtaatgcattattccggatgacagtggacagagcagggcagaaggtcagggacaggagaaatgggtagagaggatgacaaaatggttaacttcacgggcttgcactcctcccccaaccagatgtccctctcactgtaggagtgccactgatcccagtcttcatcccctccagggcctcagttctgattcctgcactggttgttacaactgctcacaagtgcattctgtgcctctgtttccccatctatctcacagagcagtcgtcaccctctgtgacgggcattttctttcctaatggggaagggatttttcaggctgagggtcttctagtttcacaactccctggagtccagaagggctagcaagaggcagttagcccgagacagatgggtgcccaggcaagcaaataactgggcattccttcaaaccaggattatctaaatattagcatgacattttcctagtggagagagaaagaaatttatttacttctgagaaaaataatatgcctccttcttttcattccaattaaggaactgattacagttgattgactaaattagaaactgtcttgggaggcatgttaagaaaatgtaaaatctaaataatcaaatgcccctcctctttttggtttgacagcaacctattatgcattatttggtctttaggctgatgtaggcttgatggcacgcacattgcagacatatccaacagagatacgtcggtgccttcgggtttttaaatttatatcccagaggacactctgctctgtcaggagtgagctcaattcaccaacaatatgtggaactacatgagaaacctaagttaaaatggcaccaaagtccgggcgcggtggctcacgcctgtaatcccagcactttgggaggccgaggcaggcagatcacttgaggtcaggagtttgagaccagcctggccaacatgataaaaccccatctctactaaaaatacaaaaattatccaggcgtggtggtgcctacctgtagtcccagctactcaggaggatgaggcaggagaatggcttgaacctgggaggcggaggttgcagtgagccgagatcacatcactgcactccagcctgggtgacagagcgagactccatctcaagaaaaaaaaaatggcaccaaagtgatttcagaactaggcagggccttacagatggacttctaggcagctgcccggttggcccacctgttaatccatctctggctctaggccaggaagctgtggcatcaggctgggagacaggcagtctattaacctccggttaacaagaaagcaggaacaagagggcacgtggtttcttgccagcactcatttcttgtgtccttgctcatgtggggattgtggcacttaatccttccaagtgaatcttgtccttatcttttccagccccaccactccatgaatcagcttggcctagtagaaatcctcagtctagtgtcccaagattccaaatcccagttccattccgtgggttgtgggacatatattagtttctccatcagccacacgggatggtaacacctgcttccctgtgttgtgtggattcaatgaaatcatgtctgcaaagggcctagcagtgcctggtgcaggagctcagtgatgctggctaaattgcaaaccactcagaaggtctgctgttcacatagtggatgttccgtaattattaattggttagattgtaatgaggtgcagaagcaaatttttgttattctctgcctctttgcattttctccttcacttctgctctctcagttcctctgtctctgcctcatttcacccatttgtcaatttatcagatagagcccattgtgtacaaatcttcccctaaatgctagagaatcagagacaaatcgaacatgaagacagaatcccaccctagagaatcccacttttcaggtctgtgtgagaattatgggagcccaaaggtgggcacccctgagtcatgcctctctcttctcctctgcaggagatcatcacctccatcctgctgagcgggcggatcgggcccaacatccggttggctgagtgctatgggctgaggctgaagcacatgaagtccgatgagatccactggctgcacccacagatgacggtgggtgaggtgcaggacaagtatgagtgtctgcacgtggaagccgagtggaggtaggagtggattcctgggctctggaagtgggaaggagaggaatttagggtggggaggccctgggagtttctcccttagagcactcccctgcctcagaaacttctagcaaacctgagtggcattctaggcttagtcttcctccagtatccaatgcatgtattttccaggacctaacctgggcttcatagactatccccatcccagagccaacacctaaaggtaaccctaaacgggatgctgacagtgctaggggaaaagagagacagaagggtggggaggatggaaagcccaggtccagggctagcctgtgaacctaagagaaacagctgccatgagggagaaaggtggagagtcagggatagctcagaccaccacctgccagccacctccctgttgatggtctccagcccaaccgcagaggagggaaagagaaaaaccagccctgaatgagtggccacgagactcatgggcagcccttccctttgcactaggggatgggcttgcttctgcccttggggtcctactcctttcttcaggcaccagcttctctgtgtcaaccagagcctgaatgtcttgttgcaggtatgaccttcaaatccgctacttgccagaagacttcatggagagcctgaaggaggacaggaccacgctgctctatttttaccaacaggtaaaaagtactttatcttcttgccccgaggctcccattacacctcaaatgccaagcatgaaccgttctctcctagggagatggaaagacaaagcccagattatggagggcccaggctaggaagcttctcttgaagaaggtccttggtctatggtccgcggctccaaccctgcttttctctcagtatttaagcactggctaaactgccccatgtgctcccagctcctcttggacttttctggtggcccaggagacctggctagtgaaacagcaagagcaggtccaagatgaatcctgcagtgcttactacacagctctgcagactgttgtccactaatctagctctgccattcactaatctgatagcctgggggacctcatttacttgcatgaagctgtttcctctgctgtaaaattattatgggaatcataataataatacctactttatagggttgttgtagggaccagatgatatcattggctgctaaattgactctccaaagaaaaattcccttacacgtagcacttacctatttatttatttatttatttatttatttatttatttatttatttcaatgggttttttgggggaacaggtggtgttggttacatgaataatttctttaatggtgatttctgagatgttggtgcacccatcacccaagcagtgtgcactgtacccaatgtgtagtcttttatcactcaccccttcccactctttccccagagtctccaaagtcattcttatgcctttgcatcatcatggttagctcccccttatgagtgagaacatacaatgttggttttccattctggagttaattcacttagaataatggtctccaactccatccaggttgctgtaaatgccattatttcattcatttttatggcccttgccaatttctatggtgtaaataccacccccctcctcagcctatttcaagctactaataggatacctacttggcttacaaaacttctgaaaacttaataaccagctctcagcagctattttgagcatctcaaacttcctggacagaatgcgtatggagtgccaagcccagcaccaggtgcagagcaaagcgcagcatcagcaggagtggccattgctgttttctgtctgatattagttccttccaagatctccctcctggtttgccagagactgagctagacttttcttggcctgtgaatgacatttatcactacttaccaacagagctttggataaattactgacttcttgcaaaatctcagttttcttctatccaaaatggggggcaggggaggggaatctgaacttcctgcctgtggagcagggagagaatgcctgtaaaagcacctcgaaaacctcacaggctcggcctgtggaggcacaagcaccctttcccctcgtgctctccatccctgctccatgcttgtttgtggtggggtgggtggctgtcactcagggaggcagaatgaggcccttaatcttctgaggcctctgtgcagggaagtgggaggtgagggtgcaagcctgatgcttgacctttctccccaccagctccggaacgactacatgcagcgctacgccagcaaggtcagcgagggcatggccctgcagctgggctgcctggagctcaggtatgtggccctgaggcctctgctgggagggcgctgtgctgagctctgggcaggcccgacctttccccatgtccaagatgggaagcaggaatgagtgtgtgggagccaggaaggggagaggtggtgaccggcagcaggtgaggctctgaggggctgggtgttgggtcttcaggatggcaggggtagatgggccagccccctccctagtctcactctcctggcttccattgctgccactgctcttgcctgcaggctgctggcttcttccatctgtcaaccacctttgctgctgttcaagcgattcatcagatgtttcttgagcaccagactagaatctgggggacattcgagcctagagatgtctatctgtgttgcccattgctgtatccccatctccagtaggcacttgatcaatatgtgtgatattagtacatcatccagagaggccctcacacttccatgttggggaggtgacagatgtgtatacaattaatcataatacgaggcagaatgaggatggcaccaacttccatgtaggagccattcatcctgcctgagagcatcagcaagagggtatctgaattgccactggaaggaggagaaagatttcaatcagcagagaacaggggtcaggggagatacactccaggctcagggatcagtggaaggaaaagcatagactggagaatcgtgagcttggagggataagttggggctgatggtggaagacaccattgagacaatggcagtccaatgatatcattagaatgacattgttagaatgacataattagaatgacagtctaaaaaaataggccttattcttagctgccagggggtcattgccattcaggactgaggagggtgatatggctgacctgtgttctagccctgtcttgaccagggcagcaccattgagtttcaccatcccctgccttttcaccctctccttcccttctctctaccccttctctgtcttagagcagtggttttaacatctgcttgcaaatcataatcacctgggagcttaataaactggagacgtcctggccctacccttgggagatttgatttggcaggcctgggtgggaccttatcctaggcgtttttgaccagccccccaggtgacttgaatgccattagatatatgggttgatgggatgactttcaggatgactgccaaggaaatcgttggccaaggattacttcctgttttctagaactgcatttccggagccttatctgtgacctcatggttaatagagagtagaactctgctgctgcttctacggagccagctgaggggcactggggaattctggccccattgtgattctcagtcagagagaatgctggggagtcctccggtggggccagtaggatgggaaagggagagtcccactttgatttcagcatctgaggcttttggtattagcgacagaataggtcaagggcagcttcgagggcttcacatttcgtgactttgtctcaagaagcaagggagcattcgagtcctctgtacagaggaggcctgtggtccctgcagctgcttagaaggcagcccagctcactgccattagtaataatcatgatagctcagtgctggcagaccaggggcagtctgcaaagtttattttattatctgtgcctttcatcccttctcagactgctcggctcctatgacttgcattacatcctgtactgtctcatcttcccctctaaaattagacaagtcgaaaaagcttatctttacctttttatttatggatctcatacctgggatgctagcatcactttgagacacctatcacttgtcacctgtcaagcagtcatcacttagttgtaaaacagcaccacaaagacccattaacattctattttattttattatatcctccaatcatccccaaactattactggtggtggcctaagctccaggcactgcactaatgtattggaggacagggcaaggcatccgacatgactcctgtaggtagtcttgtcaagagtgtaactgctgatatctgctataaccaatgcaggatgatattctaaaagccacacttgttttgtgcaagagatgtattgtttcacatctcctgagtgtgaggaacagagtcagagagatgttcctattcttactggttgaccactgaaatgccgggtgtatgatatcagggagaggatatggaaaacacctattttgtaaaccaaatagaagatttgcaggtctaataatttttaaagttgaatgcagttatttgttatgatgagccattttaaagtcaagttacaactatttctcacccaaagagaattggacacacttcggaaaattaggccataaggcagaattttctagggctgtggctcttgcctaaaaatgtcccagagtgtggggctacctacaaatcatgggcaataaccccttgtcctattaacatcattgattaggtcacctgcctatagatatacaacatctccaggaaaaaaaaaaattgtatcatttcctagcttaaaaaagaggtatgatgtatgcctgagatatgagattagtgaaatgaatcctccatggagtcatgtgtttcctgtgttactctgggcaagtcgattacccgctctctgcccagattccttcatctgtaaaataggaatgataatagtaacattatagtcacgttgtgttactataaaacacgttatgtttctatataacatttgttatactatataacatatatctgttagtatataacatatatatgctactatataacatatgctactatataacatatatatgctagtatataatatgtatgttatgttactattgtatagtattgcatagtatactatagtatactattgtatagtattatatggtattgcatgctatacaatagtaacgtaacaaaccttgcagggttgttacaaagaataaatgagttaatatatttaaagtacttagagcaacgacagggaccaaagtattcaataattatttattatattttacttacttttttctctttacccttcttttgtttgtttattttgaatagactttattttttagagaagttttagattctcagcaaaattgagcagaaggtacagagttcctatatacccccttccccacacatgcacagcctcccccactatcaacattctccaccagaattccccaccaaagtggtgcatttgttacaattgatgagcctacattgacacatcattattacctaaaacctgtagtttacattagggttcactcttggtattgtatgttctatgggtttggctaaatgaataatgacctatatctaccattatagcattacgcagagtagtttcactgccctaaaatttgtccatactccacctatccatccctccttccctctaaccctggcaaccattgatcactttattgttgccatagttttgccttttccagaatctcatatagttggaatgatacctagttaattttattcatttattggaggtgctttataaatgccaaatgtttgatctaaataatgcctctaaatgaaagtttgaaattcagggcctctatgctagaaatcagtacctgcccagtttgaggaaccaaataacttctcccccttgatctgagacacctaggaccattgtccacccccagcagagccctaaaacaacagcaacaacaactacaacaaaacagagaatacgtaaccccagattagctaagtaactgttaataaataaagattagagaaacgacacacagcttgctttgcttcaaaaggcatcttggtttgtagttaatttctattgatgtttagaagaaaaaagtaaccaactggatttggtttagttatttccttattttctgctgtccttacctgggtatcagtcataggcttgtatctgattatagactccaccgctgtccacctggtgttagctactcaaaattgcaggcttgagctggaaggaccagtcaggcactagagggcactccaggtaggcacagcctcactcagtgttggcggtccaggcatatttgggagacgtgggtgcccctggagagcagctgagatgggactcaacacagaaaattgggaagctaccttactggggagagcagcgtctcccttgagtgatggttactagttctcccagacattcccaagatgttcagttgctccaagacattcccaagatgttcagttgctccaaatgttagaaacacccagattgtggcacatctgagtgattggacagttttgtcaatggtgactatataaatgatcttcgatgcctgagagaagggccatttgggacacagggagtggcctaagcaagctggattcaggagattggggtgaccttgatgtgctagctgagcttcctttaccctaataaaacatttttccattcactaccaccttgatcatgctaaaatgctcttattttttatgtgacttaattgttcagtgttaatttcaaaatgtgtttaccctttcatttagctaaccctgttttaaaaaatttaatatttaaatatcccagtcttccaaattctttcttcacaagtctcgaagttcatttattcattcaacaacagatcataagcctggagtggctttaggagaccactctccgtcgtggctgggaagcagatctcaccccgtgggtgggtgatgcatcctcctgcttggcacagtcttctcatttcccttttcagcgtagtaaactcttctatcttctggcacctttagaaaacatactgagcccgtgttacctgcttgtcctctacatacataggaaacctcagcgtgagcctatgaggtgtcaattacaagcagtgtgaccatctgctcttcccatcaagccagcctaagggtctcttcatcttgaagccttttctgccccatcctgaatccctccagccccctttgcaaaaccactgtacttgcacacagctctgtgaggcaaggacatgtccccgtgcaccagattgtgaaaatctgtcaaatccttagagtcagaatgggtgctgcctttgcctggcacatcagagctcaatacacagttgaataaatggataactgaaagaactgaaatcttcttcctcagtggacctttgccaacatttattctgttagaattaaatagttgtgtacagcaagccaatgtgttcagttacctaggagtatattttatggctcactcaacccaggggaactgtagatgaccaagctgcctataatcacccagaggtgtcttattaatgtggaggctgagcaggtaacactggcttgacatgttttctgaagctgccgtggtcagtcgcatggaattttgggatcttaactgcaggcactcttcaggtgggaggaggaagaggaggaggagcttccatccaggggagaatcctgggtaggcttctcatgtcctatacctcagaggcccccaaccttttgggcaccagggaccagtttcgtggaagacaatttttccatgcaccctggttggggtgggggatggtttcaggatgattcaagcacattacatttattgtgtactttatttctattattattacattataatatataataaaataaatatacaactcaccataatgtagaatcagtggaagccctaagcttgttttcctgcaactagacagtccatctggatgtgataggagacagtgactgatcatcaagcattagattctcataaggagcgtgaaacctagatccctcacatacatggttcacactcctatgagaatctaatgtcaccactgatctgacaggagatggagctcaggcaatatagcaagtgatgggagacagctgtaaatacagatgaaacttcagtcactcacccactgctcacatcctgctctgtggccagcttcctaacaggccaggaccggtccatggtccaggggttggggacctttgctacacctgaatatcattcctatctgccagtcttctggtttccaataccgcacatctgcccttagcaagaacatcccatctcaggcaccattgcttacctccctctgtcagacactcagtacagagaagtaagggtagggaagaacccatcttcttagtgttctaagttctcttcttggatcaaattcccagggttttctagcctcactactgctgacatttggggctggatacttctttgttagggaggattgggggtggacttcctgtgcattgaaggatgtttagcagtatccctggtctctacccacttgatgctggtagcaccaccaaccccctactccaactagctgtgataaccaaaactatctccagacattgcccagtgtttcaggctggggcacagagtgcaaaattgggaccatatttcttaagaggtaattacttattttgcttgacagtatattcaaagataccatttattaaaaattattaaggatatagcgttttacattttatatttttattagatatttcctctatgatttcatgccttgagtgtcttctttttaattcttttgagacggagtttcactcttgtcacccatgctggagtgcaatggtgcaatctcggctcactgcaacctccgcctcctgggttcaagtgattctcctgcctcagcctcccgagtagtacgtgccaccatgcctggctaatttttgtgtttttagtagagacaaggtttcaccatgttggccaggatggtctcaatctcttgacgttgtgatttgcccacctcggcctccctaagtgctgggattacagtcatgagccaacacattcggcctaaccttcctattttctaaagacaatgaactgtctaaaagtcattgcttttgaatcataagttacttccctcactctgcttatattattagttgcacaaaacttttaccagatatttataaggatgcccgaattaaaggaacactgaatgactttaatataagatcaggagtaggataatgtctgcaacagtcaatgaaattactagtcacagtggcccagacagggaagggaggctggcacatgtgagaacattagctatttggtctcagcttaagccacaattgcataaaagtatttatcaaggcatacatttttaggggaaatgagacttaaataatatgagtaaaatattaatagctgcctcctctggtaagactatgaataattttattttcttctgtaagtcctaaagtttgtatatgtacagtggtacctttaacaagtgtctaaatgaacacacaaacatacacacatataatatctcagagatagcaaataagtgaaaaggaaatcacaagagccccccaggacctgcaggtgaaggtcagtgttcctaggctgatcattcaagcattggctgccttgggcctttgttcttagaggccacagatggagccaccatcttcctcctcagcccagtatctgcccattcctaaagtgagtttcctaggatgcaaggctggagtcttttcttggaatgacatttgtggggtttccttttcctcacaggtcaaaatactaaattttatgactctcctaacttcctttctcctgatgattcccacgtatggcaggggaagggggcttctggtggcatgaggtgccctgggtctgactgcctcattctccagccttcagcctccctctccaccacctatttctccaggcggttcttcaaggatatgccccacaatgcacttgacaagaagtccaacttcgagctcctagagtaagttctgggatcacccatctcccctcccttcctgtccttccatgtgtacttttcctcctcaccctctcctccacccctccccagaccagagccacatagggccgtctctaggtcccaaagccctctcacctcttcctgattggcccgcagtcctgtggtgggggtgagggggagtcacatgctgcctttttcttccttcttgcagaaaggaagtggggctggacttgtttttcccaaagcagatgcaggagaacttaaaggtgaggaaaccaatgggcgaggacctcttcgtgctgattcccgagactagagtgtaagggatgaggctggggctggggatactcagagaagccagggtatctgcgcggcctcgggcatttggacacaggaccactaaatgtacccaggggtcctctctggggctggggatccaactgttacatgcctgggctccggctccgtatcgaggccgtatcagctctgcggccccagtactgggaagctacccctcgccccctcaacctccttcgtagggttacggggagtctcccttgagacaatgggtatgggttttaggtcatagatcacagctgcttttggggcaaaggccctggggatcattttcgagcagtgggcagtctctcagcgagaccctaagggaaggagtgagacctgggaggagcaggcattgctcacacggcccatcccctcccccagcccaaacagttccggaagatgatccagcagaccttccagcagtacgcctcgctcagggaggaggagtgcgtcatgaagttcttcaacactctcgccggcttcgccaacatcgaccaggagacctaccgctgtgaactcattgtaatggcgggctctcttgatcctctccctgacctggattccaggcctctcggaaaagggggccaggagggggcagggagaggctgcaatcgctgcagattctcactcaggcagcaggacctcgctgacctgccgtcggtggaagtcaaaagcatccccttgcctgaagcaggcactgaaatgttggcctccagctctgggaggtgggcaggacaggcaaggtgtcaggaggggaagatccatatggccagggtttcggtgagaaggagctggagacccaggaaacagtggcttgtgtctagcttagggagcttttcttcaagtttctgaagaatggggaggacagctctggaacaacagtccactctccttttattccagcaaggatggaacattactgtggacctggtcattggccctaaagggatccgccagctgactagtcaggacgcaaaggtagagagacccggggcagccccacccagccccaggcggggaggtcgtcccctctctgctgcctcccgccctgtctgccccttcagttcttcttgcccctgttgctgaaagcagagttcttctaaggccatgccctggcgtgagcagcagtggagagcatttagagatggcagcatgggacagatggccctttacatccctgtgactgtcatctgcacagaggtggtgggagggggagacaaggcctcaatgattactcgcagagctcagcagtgttgctctttcagtgacaatataaggcatgattcccttggaagtcaggggacctgggtccagtcctggctccactgccagcttggcacatgatgttgagcaagtcctggctttctctagacctcattttctccttggcatagggaggggcttggtctagatcaagcctgtggtcccaggatggctttgaatgcagcccaccacaaattcgtaaactttcttaaaacatgttgagatttttttgtgcgatttttttttttaccttcatcaagtagtgttagtgtattttatgtgtggtccaagacaattcttcttccaatgtggcccagggaagccaaaagattggacacccctgaactagaggatccttctagccttaatagtgtttgattctctcttcatctcccagagaaactcccagttcctcctcaccccggctcccccatactgaccaatctgcatggcctagtcctggtagtgggatggtctgaagctcccccttcttttcccacagcccacctgcctggccgagttcaagcagatcaggtccatcaggtgcctcccgctggaggagggccaggcagtacttcagctgggcattgaaggtgccccccaggtgagtgtctctgggcactgggcacctggcagctctgcagggggtataatggcagattgggagctcttgctcagaccaaaagtctgtgacacacaggaagccaggagcttcctggctttggggatcgtgttaagaaaactgcaccaagttcttagacaaaaggtaccaggatgatgataaattgtaggaaaattcgggaaacaatttttttaatgtcaggagaagaaattgggaaggttttcaggtagtggaatgttcaaggtgaccagaaatcaggtataaatcacaggcctaagttataccaagagaacaaggatgcggacatcaagacctcaaaaacatgggtttttttgtttgtttgtttgtttgttttttacagtaaaacacccagagagacctcaggctgcatctctctctcctttcacccatctgtgccctgccccattgcctccccttcctctttctttctttctttcttttttttagacaaagtctcactctgtcacccaggctacagtgcagtggtgcaatctcagctcactgtaacctccacctccacagttcaagagattctcctgcctcagcctcctgagtagctgggactacaggtgcatgccacaaggcccaactaatttttgtacttttagtagacacagggtttcaccatgttggccaggctggtctcaaactcctgacctcaggtgatctgcctgcctcggcctcctaaagtgctgggattataggcatgagccactgtgcccagccccctcttccattttctcagtttctgcttctatttattgagcacctactaggtaccaggcatcgtgctatgtgctcagaggccaaaataagtgaggcctgggactggcctttggagagcatgggcgtacaggtgaaaggggtgacagagtgcagtctggactccagggcagggccccaggagaggtgcagacagcattggcatccaggcaagggttgtggcaggggtcctgccatctcttctccagccctgggggtggtctctagccaaggctctggggtctcacccttggctggtctctgctccgcaggccttgtccatcaaaacctcatccctagcagaggctgagaacatggctgacctcatagacggctactgccggctgcagggtgagcaccaaggctctctcatcatccatcctaggaaaggtgggttccatttaaaggtaaagtggctggaccacgggtggcagcacacccgagtccccagaggcggagtggcagaagctaagccactgatggataagtgaatgaggattcttcccccacagcccagcgggaagcttccagtgggcccatcttaggctttaagccctggccggtccacctacccacagccctgctaatcaaggtccacatagaggcagcttctggaggagaggcgttttagccccagcaagctcaaagccattgctagtagaaggctggtcccgcctgtgtgtgtctccatcttgggtcagattcaggaagcaggggtcacagctggagcacgtgaaatctggcctgaggcagcctccaaggaggattccacttctggcccaaggcctcactagctcccaggctaggagagaatggaattaggggctgggatgggaggagagtcccttgtaggaatagtgaggaggtcagtcacccatccaggtccctgtgtccccagctccaacctcctccttcctcctctcttcctagatggtgagaagcggaacagcctgccccagatccccatgctgtgagtacaatggggtgcagaggacagggccctgagctcagcctgtgctgctgagaggaataagaataaactgggagtccccacctccatagtttctggctttcaggcccaggagaaccctgaaaaaagatgatctttccctcccaataaatacctgcaggaatattcctatgccttcatgccacctggtgttatcctggggggttgctgctgtcccccaactccagcccccagcagcctgggctgtgctcccaggtcattgctaatttggacagactacttctccacagggggcaggaggagagggcgggccgaggctgcccaggggaacattaccggcctctgagctcacctggcttctgctctctcacctcctacagaaacctggaggcccggcggtcccacctctcagagagctgcagcataggtgagctgcccgctgcatcctccacctgctccagttgcctcccgtctgcttgctccccactgcttgctctcgtgacattgccgagggtttcctccaagtgacagaaaaatgatcctctcccataacttctcagtgatggctttaaaatatcgtgaattatggctgggtgcagtggctcatgcctgtaatcccagcactttgggaggccaaagtggatggatcatgaggtcaagaaatcaagaccatcctgaccaacatggtgacaccccatttctactaaaaatacaaaaattggatgggcatggtggcatgtgcctgtagtcccagctacttgggaggctgaggcaggaaaatagcttgaacctggaaggcggaggttgcagtgagctgagatggcaccactgcactccagcctgtcaacccagcaagactccatctcaaaaaaaaaaaatcatgagtagtaatcgctagtgtgtattgagtacttagtacatggcttaagcagcttgggctgccataacaaaatactatagactgggtggcttaaaaccagatactttattgctcacagttctagaggctggaagtccaagatcaaggtgctggctgagtctgcatctggtgagggctttcatcctcatttgcagatagctatcctttcactgtgggctcacgtgatgaacagagagttctggcctctcttcttctgtgtacatgagcacagatcccattatgggggctccacgctcaggactgcaccacctcccaaaggccccacctcctaatcccatcgcattgggaattagggcttcaacaaaggaatttgggaggtacacaaacatccagtccttaatggtattaaacatgcaacaggtattatttgattcaatctttatagcatcccccaatactcatttcataaaagggaaaactgagattaagggagattaaccaacttgccctaaataatgcaaatcgggaagcagagagcagggagttcagccaaggtgccctgggctctgtggccactctaaaacctgggctgggagcccgggacatgcctggcttctcctcctacccccttgggctccactggcctccagcagggagccccacacctgattcctggcggtgcccaccaagggcatcttgtccacggctgagcctcttcctgttgttccagagtcagacatctacgcagagattcccgacgaaaccctgcgaaggcccggaggtaggttctcgaccccgccacagcgaccgtagtcaaggccctgtgaaatgacatggcaaggactctggtgacaccacagggaacattcttttcctcctttatcctcccttcgtgctagacttagacagtggcaaacctgagatgccttggatttgaaagctgagatttttttttctctccctatactgattgaccttttgtgtgcccatggagctgtgcggggattctagtaacgtggacctgggacctagccttcagagggagcagggtgatggctcttccctgggtctgagacagtggaacattctagacccccatttccccagcccagtccctggatcttggctgaggtgttatagatctggtgacgcctggctttagagcctgcagacactcaggttccctaggggataccaccgatctctgtgatctgcgactgttttctctgtctgtgcaggtccacagtatggcattgcccgtgaagatgtggtcctgaatcgtattcttggggaaggcttttttggggaggtctatgaaggtgtctacacaaatcacgtgagttctaggatcttcccttacactcctcttccacatgtctgtagggtgagacagagctcgaatctgagcaggttggagttggcacagccttcatccacttggggccccttgtccctaagggcctcttgtccactgggcatggtggtatttattaaatactcaaagagtggtggagacaagagtcatttccaagaagggtagcaaaataccaggggtggagatataggcagaacctggagaagggtcagtattcttggtgggagaatacaaagggggaggcgggataaagacagttctgagaaaaggtgaggcaggatctggagttagtgtcaaggccagtgatggggcagggtaaggctgaccgctgtggtaacgcttctagcaggcccaggggaagaaagaaagaggcagtaagaatgaaaaatccaatgatagagaaaggcccagcccccaggcatgataatggcttgcaggtgcctctggctttgggcaggtcacacggcccctcagtctcagtgtcctcatctggatggccaggggcttgactcatttgaccactacagcccttttcagttctaacagaccctgatcaagaagaaggggagtggagaaggagaagagaggaagacaaaggggagaagaagagagacataggagaaagggccctttcctggcagcaaaatctgcaggaggccatggggaggccaggagggaacattctgctgagcactgggctggaccaaggggtcctgaacacactcttgttacagaaaggggagaaaatcaatgtagctgtcaagacctgcaagaaagactgcactctggacaacaaggagaagttcatgagcgaggcaggtagggacccctgagaccaaccaggcctccaagatgggaggggcttcagcctgggaagagaggggtgaacagtgcagggacccatgttggaggaggggttcccgtcctcccagctagaagagcaaaggccttttctgaattggacctttgagccgctccacctgtccctcttgccccaccacactgcagtgatcatgaagaacctcgaccacccgcacatcgtgaagctgatcggcatcattgaagaggagcccacctggatcatcatggaattgtatccctatggggaggtgagctggaggaccctgcgatgacaactgggctgcagcatggggggcattcagagcacagcccattcctcccagcttcctgacttctgtgttccactgaaataagccagaggccctgtttgtcaaggaaattgctggaacattttgccagctttgggtttgtctcccaccgcccccagggaagggtcaggggttgccagcaccctggtcccctggctccatactgggaccaaccaggggtcttgatggcacctccccattcctgcagctgggccactacctggagcggaacaagaactccctgaaggtgctcaccctcgtgctgtactcactgcagatatgcaaagccatggcctacctggagagcatcaactgcgtgcacaggtaggggtggagggagtggccagcggtatggaagccaggccttcaccagatcctcaaggcctctgggtagaagcagggcttgtgggtgacacagagcagtgttggaatcccagcaattggcccagcagctttgagcacttgagcaacctctctgaccctgtgtcctcatctgtaaagttgcaggcactgtatgtacctcatggggttgttacgagtaactctgaagtccgaggtgtctgtctatatatcaagaccttctagcccctcccctgtgagtgccaggaaatcgcccccaaccttgctcagagcttgctcacctccagctccctggcttggtggcacatggcccaggaagaagggactgggctggagcagggccaagaagatcctggggtcctagcccagacatcaccctggttgccgacacccctgggctgccaaatccaagtctccctgtggctgtggagttggcccctgctttacctggctttgttcccattccctgccatgagaacctgacccccaagggagtcagtggttgggcattacccaccattgacattggctctgtggccttgtgcctgattctatggaaagccacatcaggggataaaaccctgcattcattcattcattcattcatccaacaaataccatggaacacctctcagtgccaggcagtgacctaggctctgggacaaagtcgtgacgaaaacaagcaaaactccttttcctcgtgaagcttactttctagcatgagagtcaaactggagacatcaattgtcaggacaaaggtggtgggaggatagatttgtttcttttgtttgtttatttgaagtggccatgcttttaagtcatcatttcaactataaaaacaaacactagagagtggagcctgcctgtgagaagcaagcaggcaaactagtttggggttgggagtgatggcaagaacacagggtaaactgagtcagcggtgtgtctcctgggaggaatgagagctcagctctggagtagcctacctgtgcgacacccttttccactggtgagctgctgggcaagttccttcagctctctgggtccggtctcctcccctgcaccaggggggtctgagggtctctatgtcatgactcagggtgtgtgaagctctcgtgcgatcctggtatcctaagtgccccatcagagttagctgtgctgccgctgccactcctgctataccaaagacctaaccagtcctgtggaaatgcagatgagagagaatacctgtgttcagggaagtggttggagtttatccttgaagaatcaccaggtgacagcctccctggcatgggggacagtgtaggcaacagcacagaagtggagtgtagcagatgccaggaatctgagccaggcttcaagctggagatggatgaaggggtgatgggagacagagcccaacagcaagagggaaggagatggcaaagcacctgtgcatgttggggtgcagaggggccagctgggctcccacctgaggtgtgctgtggcaagaccactcgatgggggcagtgacccacagaagctgcccgattctgctctggagtccgagtccctggcttagattcttggtctctttttccatctgtctgtccatctctctgttcctgctcccatgggggtgggcagtgcctcatcctggtcttgatgcccttcttccagggacattgctgtccggaacatcctggtggcctcccctgagtgtgtgaagctgggggactttggtctttcccggtacattgaggacgaggactattacaaaggtgagggggcttcccagcctctgcattggccttggaggggtcgctgaagccaaaaattccagaagaaggaagtctacagttggacagcccaggctaagggtcttcagaaagtaggatgtatttctggataattctgatctttcttccctaaaaatcaacctctttgcccacccaaagcctctgtgactcgtctccccatcaaatggatgtccccagagtccattaacttccgacgcttcacgacagccagtgacgtctggatgttcggtgagtgctgatttgggagggcatgaaaaggtgttcagattctcacttctgaaccaggctaagggggtgggtgcagggagcaggggtctgacctccaccctccgttcccagggttctattttgctgtggccactgagaagtctcagaggtggggaggccagtaggggtaggaaggggagtgacccaggctaaggactggcctgggctgtgcaggctcatcttcctggaagaggctcttgtgacatgtgtgctccacctaccagccccagaaactaagacgaaactctgtgacttattctgagagaggtacaggaaggagagagagcaaaggcaggtgtagagagacagccccttacggaacacctcctgcaaaccatctcacttagtgctcccacagccaaccctgtagaacattattattactctcattttcctgttacgaaaactgaggctcagatgagtcaggagcctgcccgcaatcacacaggcaccaagtgttggtgcgaggcttccatttccagctttactaaggagtggctcccctccctcctaagagaagacacttgtggtcccaatagcatgccatgactgccacctcttgatcctgcagcaccctgacaggggtctagcgagcaaggccttaggtcacttactgcagaggtaggtcacttgtccctcgggcagaccaccatggtaggcaggaccccagggtgctggaggaggaggagggaccgcaggagctgctcctggtggagactgagtgctaatggcgatggtgcttctgggtgggagggactggtctcccccacccagggcctgacgctcccttacaccccagccgtgtgcatgtgggagatcctgagctttgggaagcagcccttcttctggctggagaacaaggatgtcatcggggtgctggagaaaggagaccggctgcccaagcctgatctctgtccaccggtcctttataccctcatgacccgctgctgggactacgaccccagtgaccggccccgcttcaccgagctggtgtgcagcctcaggtgagcatggagtgtgggctgtgggctgggggcccacccggctgcaccagggagcaagaccagcacacagagaggtttgcaccacatctccctaaagaagacgggccagggtcaaggacaggaggctgaagccaggttcactgtcagatatgagctcagagataaggcagccgtggggaagcctgactcatctgggcatctgtcaacacagagcacagagccttgttcaaaggatgtgctcagaaaatattttctaggttagactcaaaagcctgagccagactctcatcgaagtgcctgtgctctttgtgatgttgaggcatcctacctgctttcctctcgccttgtctctcgactttgatctttcctcccagatagcaaggaagggagtgatctttgacctgttttcaagactatgacccaggggccacctctcccttctgaatgggggataagggacctgagggcccgtcggtgcccaggagccatgattccctaggtctggggaggtcactggggaagaaggtcatctgtttcagaggttcagggtcccccagttttcttggtggcaagcctgccattagccctcctgtgggagatctgacttcttttggtttcctctggggtgggagtcagtaagcattttctataaagggccaaatagtaaatatttggggctttgctgtttatgcaagtctctgccaaaactgctaactctcttagctcaaaaacagccacagacaatacatcgatgaatgggtgtagctgggctccagtgaaacaccattttggatgctgaaatatgaatttcaaataagtttcatgtgtcatgaaatattttttgtcttttaatttttttcagtcattgaaacaatgtgaaaaccattcttcatttgggtccatacaaaaatagatgaaaggccagattttccctctgggcgcttatttgctgaaccctactttagggagtctggaacttaattgacttgaaaaatatttttaatactgtactttaatactgattttaaatactgtagtcaacatgttgccttgtttgattttagggcaagtaaacagtccctgaaaactgcctggtggggaggcaccccaggggatgccagcaatgcccaggccaggggcactgagggtgaccctgcatgttttctgtggggcagggccttcaacatcatctgtaaaacctctggcttaaaaggcatctctgttcctctctatcccttcagtgagcctcccagttaattctagactcctgtgttggtcccttgtatgggaggtttgagaagtcaaaaggctgcaggataaaagtatttgaaggatgtaatttgggaggttaaaagccctggggggatggagctgggagtcctgattcactctgaggccttgagagccacagggagctgtgcaggtgtctctcctgggctgagaggtgttcccatcatctcctgggctgagaggtgttcccatcagaggcatcgaccaggcctctgccacaagtggaggtgggagcaggtttctggtgtgatctggaaaacactgaaagactcagaagaccccaggttgcttcctcagaccaccacctgactcttcctccttagagttcagaagggatttgatcagtgtttcctaaccgttccagggaggaaaggcccttctaatgtcaaattttgagtgtctctgtgtaacaatagttatattttaaaaatcttttgctgaacaaaatgtagtgggctatataatgcatttttattatacataataaaatatatacacacttgaaaatatagtatcaagtgtcacatattcagtagtatataatacttgctacccatatgaacatgtggattcatgggcagtaataattccagagtcctctggggtctgtgattccaggttaggagcactggattgggtaagaaaggtgagaggcgcgcacatggctagcctgggagtgaacccacatgcctcattagcacataccggggatgcgttgggggatgtttcatgagaaataggagatgtagattctaggccagggccatgaagttggctgggactttggaaatctacataggggtttggtgccaatcacaagcccaggagggcaaaaggcctgaggagtggggctgcagtcaggctcctgctgcatgtttgggctgggactggctcaccaaggacgcttttccaccttggatccattcctgtgatcctcccaacctcagtgtggcctcagggcccatatccaagcctgtctcagggggctctccccaggacactctgcagtgaagatcgaaacggaaatgggacctagcaaccttgcccaggcctctctgggcctccacgaagtacaaagaggagccccaaggagcgtctcactttgacctagtttctctccttatctgacgtgactccctgcagtgacgtttatcagatggagaaggacattgccatggagcaagagaggaatgctcgctaccgaacccccaaaatcttggagcccacagccttccaggaacccccacccaaggtaagccaagccatggcctcataagtcctgtgagtcaaagcaaagccaggtccctgtctgatccatgtcccccttactgcacaggcaggatgccccctacagccctttctcagtccttcacccagcatccaccatcactgtcagcgtgtcacatcagtgccctggcaggtggacttggagatagcagccaccttgtgggatagctgggtcaagaatcattcctcaaaagtgtcccctgaggggctgggcttctcttctaggtgttttcttaggaacaaatgagatccccctgaggacacatgggtgggaagtatcctgggtcttttaggtccagtccctacatctataccccgcatggccaccctgagctcaggagccagggccctgctgccattaggtgggtgggtctgagaggccgtgcctgtcttagtcaactggagctgctgcaacaaaagaccacagaccaagtggcttaaacagcagatgtttatctctcacagttctggaggctgggaagtccaagatcaaggtgttggtgtcttgtgagggctctctgcctggcttacagacaaccaccttctcactgtgtttttacctggcagacacagagtggtctttctttctcttcttataagggctccatcctcataacctcatctaaccctaattacctccaaaaacctgcacttccttaatgctatcacattgggggttcaggcttcaacatgcaaattgaaaagggggacaaatattcagtccataacaatgtctgatcccatctaaggccttttctcacttgtccctcttgcctggcatgtcccacccctccccgcgggcctggctcagcgttcatctcctccatgcagcttctgtgaatgcccaagcccctggtgagctcctacctctgcatgcctgtggctctggagctctgacttggtgggtgctcccacgtatagggaagcaacacatgcaccaatcattaaccctccaattagccatagccccgggagggcagtgaggtggcttctttgtaccttccaccactcagtagataatcagtgctcaataaatggatgcaaaatgagtttcatgacagctttgtccctcaactttccttcctttggaacaagcctgaggtgtctttgacctgatgttccccttggtgagttgtgttcactcaaggagagggacagagactgacccatctgtgttctctctccagcccagccgacctaagtacagaccccctccgcaaaccaacctcctggctccaaagctgcagttccaggtaaagatagaaccagaggacgggaacttcaggtctacctctcatccaggtcctgaaactccattcttgtgccttagaggagcagcagtcacccacttgggtgatggagatggcctaggttgactcttctttggcacccagaacagaatgcagactcagatcacaagaattaaaatgcagttctcccaggctgtgctcagctaagacctgccttaagccccatccctctgtctacatcatctgctgctttgtgtgcctgcctgctgctctctccccacatctaaggcctccctggcctccttaccagaaggaatcccagggaatatttcccaacaaatggagtagctccatgggactccccaaagaggccccatccagaacctgggtggccattgaagagacagcagggttttacctgagctttctcccagctccattatccccaaccatgactctttcccaggctgtgcgtccctgaccctgaatgtctctgttctgtgtctctcttgcctctaggagagagggagtccagtctcctcttatttcttctcttgcatcccccagctcagagccactgctcaaaaattgatcccctcaaccaccagaaataatgtccatttagttggtgccctttatagaaaggtggtgtcccatggtcctatatttgttctcaaggaaatgcctgagtgccaaaacaagaccatctaaggactaatagataaatcctcttcacgtgaagagaaagcctgattcagaagatggaaaaatcgttctgaaaaaaaagagatatacccatgtgcaatatttaaaacagggagttaggtagggtggaacacacctgtagtcccagctactaaggagggtgagatgggaggattcattgagctcaggagtttgagaccagcctgggcaatatagtgagaccccatctctaaaaacaaatagtaatacaataaaattgtgatatacttattttttaattaaaaaaaattcaaggcaggcatggtggcatgcatccgtagtcccagctatgtgggaggctgaggcaagaggattacttgaggccaagagtttaaggctgcagtgagctgtgatcataccactgcatcccagcctgggcaacagagcaagagcctatctgaatttttaaaaaacaattcatacatatctgtataaattggtgtgttaaccacatcagtcagtctgtaatgcaactgaaacaactattttttgaagagtcctgaaggaagagccctggtctcagtgggtccgtaaccagcatggaccccactgtgtgcagagcatcttgggggaatgttggatgaatgagaggctgcactgctccaccatctctctcggagcaatggaaggcccacgttttgttctttattaactcctggagagcaagccccattccctgtggtgctcatgcatagtttctttgtgctcgtgtttgtagcagctaattgtctaccttctcgctttgtcccgtgccttgtgcttctttgcttttcctgaataggttcctgagggtctgtgtgccagctctcctacgctcaccagccctatggagtatccatctcccgttaactcactgcacaccccacctctccaccggcacaatgtcttcaaacgccacagcatgcgggtaagagggctctgcatgctggtccctgcccggactgaggaggctgctggagggaggtggccggggacactggaaaccccacgtcctcagctcaggagggcccttcctgttcccatgcaccagtcaggccactgaggtggcactctgtgacttccttccctttgcaaacacatcagaggctggcagccacaccaggccctgctctggaggacaccagctggacctaacctgcccttggccatgctggtgctatggctagagatgtacaaatctccccctctcctgagccccaggggtagggggatctgtggcagcttggaggctcctaggcagggcacagcacagcttagtggtgctggagagtatccttcctaaatgatggctttgggtgtgaaatctctcctcagtcaaaggaaaggctttcttgtggctgctcccctttctgcttttgttcaggctgctgctgggtgagaaggagtttagggctagtgggaatacagcctcattaactggctagagcagggacctaagccacttcccttgtcagctctttgtcacggggggttgttaactgctggtgaagcccggagtgcttcatggctggcttctgattgtcaggtcttgtgtgaaaaagacacttttgcttataaccagatgcccactggtcaccaaccaccttcttccatacaaatggcccctagtggtcagttgccacgaacacttgatctattttactaaaccaactaaaacacttattttagctctaactctgcatgcatgcacaatatttcaggctcactaaacatgactaaaatattttttgaaaaaaattagatgtttatcataatatatttggaagatgtaggcaagtatgctgatattactttcatgccattatgcttaatttagtagaattttgaaatgagcatgataacttagaattccagacactaagattttttgtgaaatcaattttcctctgacctacctcgtttttctcttttatattaatttaaccaatttctgtctttgcgtgtgcttaacaataataaactacatttttaggcatgtgctataatttaggctgtgttcggtttctccaccctcctgcctttgactctctattcataaatgattgttttagtaagttttgctttaaattgtgttattttagaaagaagctattttgcacatttgaggggtagcattgccttcgtccaatttcctgcttctccacaaggaccttgttcagttccataaagagattgtgcagtaggaaaaaagaccttttgtatcagggctttagaagtaattgacataaggaaaatctgcctaaaagaacataatgagcatgtctttaaataaacaaacccaaaaaagttaaaaatataagctccattttatgacacagatcagaaacactgagaaagtctcttccaggtagaatgctgagaaggtataataggctcctcacaaagcatttggaagcatttaacaaaaatacagaggtggtgttcccagaaaaacagtttttctactgagtggctctatagcctgactcatcagggagtctgtgggatgccataccagcattgggatggcagcagtctctctcctgaagacctcacaattgagctttaaaaataatacaattcaaggccaggcgtggtggctcacgcctgtaatcccagcattttgggaggccaaggtgggtggatcacttgatgtcaggagtctgagaccagcctggccatcatggcaaaaccccatctgtactaaaaatacaaaaaattagtcaggcatggtagtgtgcacctgtaatcccagctactcaggaggctgaggcaggagatcacttgaacctgggaggcagaggttgcagtgagctgagatcacgccactgcactccaacctgggcaacagagcaaaaccctgtctcaaaaataaaaataaataaaataaaaataatacaattcaataaacagtagggcttgctgtgattgctggacgctgtcctcggtgctgaaggggggaggcgctgctttcaaagcgcttacagtcgaccagaaggatcagaccaggtgcacacttacctgtaatgcaagccagaaggtcgtgggtaccacaaagtgggagttcagagaggaggacaaccctttccagcttctatttaaaagttgggccttgaaagatgggaaagatgtggacaggaggaaactgagattcagggaatggaagaggcaggggcttcagtaggaggcaagactgagtggtgggaaaccacaggacaagtgcaagaactgttggactacagcaggaagggtacttgtggatgtggaaataaagccaacagatgggtcatagccagattatggaaggtgtcacaacttacgagagtcattttaaaacaccatgagtacccaattccttttaagaatagaatgtaatgagcaatgtaagtatccattacctaataagaatattggaggcgcatttcagcaaaaccaacctcaaagagattccatttttttgagtgttcatttttctccttgagttttattatgaaattggaaggcatcaggatgtctcctaatctgtgtttgttagaatatgtggtacgatcaggcctgaggcatgctaggcattttagtggtggaatcttctgtcaacacttataaacttacaaatacttacaaatacttgtagaattttcttgattctagtagctcatccaactggtacttaccatactcttccttaacccatacatttttctcacatccagaaatccctaactctatatttagaacttttgacacttagttcctgtttgtcactatttgtcaacagcctggggcagccatgccattgtgtctgcaggtgttgacatttaactggggatttttatggccttaaaatgtcctcatttttgagtatcagcctctgatcaacaaaacctattttatttttatcaattccatgattataaaatactcttatatgctggaatttgttttcctaaaataaggtctagctcagtggttctcagctaagttattttccctctgagaggacatttgacaatgtctggcagcatttttgttacaactggggtggtgctataggcatatattgtggggaggccagagatgctgctaagcatcgtacaatgcacaggaaattgccctggaaataaggacttgtctggctccaaatgtcagtagtgctgaggttgaggagccttggtctgactagtatttacttaaccccacgagaataagaacatcgtatagtttaacatcactgtcctcccagcacccagccctgccacatagtagttgcttaataaataattgttgaatagattaatgaataaatatttcagcaagaaacctaactcatggggaaacgtgtgattagaaattgaggttagtaattgaagctcagtgtgcactaagtaaaacatcccaatataaccacttttagaccatattgtaatattcaagtgtgttttgtagggcttagtgaggaaactcttttaagaggcttggtaggaattattgcttgctaaaagtagatagagataattgttagcatcttctgcaagtgacctgtatgcaaatggccacttcaaaggcaaggaactgagggacctgccagcttagatgtcacagaagaatcctgccctagcaaaggcaactcctgggctttgtgcaatcaagaggatgccaataatattcctcctccatctgtccaggaggccagggtccccatgtgcagcacaacaagagcaaaatagtttagagacactgagcagatatttatacaaatgaaccgtgggggaagactgaatgaaaataggaagacatgcaatactttctgtttaggaactagcagctaaaattatgaataggtccaaagccccagaggtaagttaaagcaagagttagattactagatctagggagaggaagcatttatcttctctctatcaaactatatttctttgaattttgtttttcattttatctattagttcatgaatttcttctaatcattggttaaataactcaagctatgattgcatttatcttatctctatagagctgtatttcatgaaattttgttccttattttatctcttagctcatgcatttctcctaacatttagttaaataacccaagctattatcttaataaagaatgtgtcttaataggaaggcatggttggtgggtgcatgctgttgcttgttctctcaggctctgctcattcatggacacacgtgggactgcacaccgtgaggctagaggcagcacccctgtctctcgaagcttccagacctgccaccttggtccttaggtggagatagcatcagaagggtgtgatgctctccaactaagcaaagccagccccttggaaaccctttggatgcttttagtagattttaaaatagattttaatagactttaatagcttttctttttaaaatatattaaatgacaacaaccatcacaaacactgagataatagtagggcagtcacttggtaaaatatcatgagcagatcgtgtaatcatttgaatacagcgcacgttgagcagtgggttcttgggtttggtatcacattgcaacgcagatacatgctcggggctgatactggatagctgtctgcacatatagctctgggtttaagaacaaacttatgagaaaaaagcagctggccaggccaaggcttgcagctgccatgaggttcttcagaggactgtccctccctgagtctgagagcagggctcattgcatcctctcccttctctctgccgtcctcccaggaggaggacttcatccaacccagcagccgagaagaggcccagcagctgtgggaggctgaaaaggtcaaaatgcggcaaatcctggacaaacagcagaagcagatggtggaggactaccagtggctcaggcaggaggagaagtccctggtgagcaccccaggaaggatgtcggtgccctgcacccatctgtgtcctcttccacctccccaggtggctggggcaagggtcccctgcattcttggtgctttcagctccagaattcttagtccttcgctcttgtttcttcctctgcaggaccccatggtttatatgaatgataagtccccattggtgagttgccaggagaggccgcctcctccatgccaaggcctgggaaggcctcgcccaccataggaccccccgcccaacttgctcctacccccaggcctgcccagctcctcctcaatggctttccatgttgggagggtgtcttttccttttctgccaatccctacatggcccttttcctgaactctcctgtgatcgtgcccttagtgctgtctgtggccctccccagggcccctcggcctcccagaaaggtcacattgggtcacgagctgctcccagaagcacccccgaccccatggctgtaatctctaaacacacagtggagggactggggaatgggtaaccagggagggggttgtctccacagccgcatgagtgacgttcctgttctctttcctccttcctccagacgccagagaaggaggtcggctaccgtgagtgttcccgcccttcttcggggggtttcctcttggcaccttgtgcagagccaccatccttgcccaccgcccagggcagggagcagcggagtctgtctgcattccctgcagcatcggccatgatttaattcagagcatgtggggcaggccagcttcccctccgctccctccaccccattcctctccctgcctagcaccctgcccttctctctctcagtggccacatccttaggcccctcctcagatcatccccctcctgcattagtttggaggagctggaaattctctcttcctcatttcctgctctgttggaagctcccgtgggaaaagttaagcagtgccacctgcctgtcccagttcagattcatcttctgtaggcctgagggacagaggagagaaagtgagaggggcagctgagccctcaggctctctccagaagaccctgttgcaggcagggagggaagagccagcagtaagcccggggcctggaggggtggcattgaggaggaggatgatgacagccatcacagagaactggacacaagtcaggcatgggcctgggaccatttattatcttctgaggcacagggtgattaggtaacttgtccaaattcacacagctaataattggcaaagttcagatttgaacccaagccttctgactttagggtcccttctgagctcaccctcttatcttacaaatgaaaattaaggctcggaatgtgagctgcctagagtggtcacagagctctttggcggcagaggtgagaatagaaggccaggtgtggtggctcacacctgtaatcccagcactttgggaggctgaggtgggagggtcacttgatcccaggagtttgagactggcttgggcaacatagcaagaccccatctctacaaaagattaagaaaattaggcctggtgatgcatgcctgcaagcccagcggctcaggaggccgaggcaggaggattgcctgagcctagaaggtgaggctacagtgagctgtgatcacgccactgtgctccagcctcggtgcaagccctgcctcaaaaaaaaaaaaaaaaaagaacaaagtgtgctgagtggacttttatgtgtctttgctcttcaaagtgggagtgaatagcatgtttctgctgcaattttgcttccttcagccccaaacactctgggaaaaccattagagaatccacacaaatttaccccatgagctgctgtctccccaggtcaggggcaccacagacacctgctggcatcagagagagaggtttcttcctttcagatcacccagtactgttccttaggcctggtgtccatcaggcaggaagcccaagccagagctggggcaccactgcaatccccccatcttgctgggactttgcctttttcttcctataaaagggacaacagtgctgtccctgactactgcaaaaccagggagaccaggaggttccttcccctgcccgcttcctggattcagagttaatttccctgaagtctcctggtggtagaggggaaggggctcatttgatgtcagcaggtacgaagggaagggttggagtgctgagaactgccccccacttgctgttctttttattgcagtggagttcacagggcccccacagaagcccccgaggctgggcgcacaggtatgtgttggctctgctgaaactgataaatgagagtgggggttgcacaaaactgaagaccatggtctatgaaagattcacagttctcagatagaatccagttcagtgtcctcatgatacagatgaagcccggggttagggggcgggtggcggggtgccttgcctaaggccacacagctaattcatgaaaaagcaagaggaagaaccaatctcccactctccatccccctcccagacttggagtagagctccctggtccagcttcagggaaagtggtgtgggctgcttccctcttctgagcctcctcacttggtttccagcatccattgtccttacagccatctggggtggtgctggctttctttcctctggaacagtggttctcagccttggctgtccattaaaatcacccaaggagctttgaaactctctgcataggccaggtgccgtggctcacacctgtaatcccagcactctgggaggccacagcaggaggatcgcttgagcccaggaattcaagaccagcctgggcaatatagcaagaacccatctttactaaatttttttaaaaaagattagctggacttggtggcacgcctgctactcaggagactgaggcaggaggattgcttgagcccaggaggtcaaggcattagtgagctatgactgtgccattatactccagcctgggcaacagaatgagatcctgtctcttcaaagaaaaaaagcctgcctgcaccctatgtccaggtggtggttctaatagtctgttgtgaggctaccactagtattccgttaaggctccctggctggaaactgccccagaagtggacagaggcaatgcaccccgggacagggcacaattattctaaagaagagtcctttccaatcgggctggtggtggagttggccacagtggtgcctgcccaggaaagaatcattccgtgcccctggctctccccaactcactggccacctgcgtcttcccctcagtccatccagcccacagctaacctggaccggactgatgacctggtgtacctcaatgtcatggagctggtgcgggccgtgctggagctcaagaatgagctctgtcagctgccccccgagggctacgtggtggtggtgaaggtgagagcagggctgggttggggaggtggaggcggctcaagtccgccctggaaggaaaggggactgcgcttcctgttggctggcccagcagatcctcttagagcaagctgggccaggggaattgagtcccaggccactcgcgggggacaagcaccaccccaggagagctcttcccaggggaaacctggctctctccaatagctaggagtggcggccatcctgcccctttcttcccccagaatgtggggctgaccctgcggaagctcatcgggagcgtggatgatctcctgccttccttgccgtcatcttcacggacagaggtgagcgtcccattccagacagcaccataggctgttgctttgctcctgcttatgagcctcattagaggctcatgatggctgcctgggcaacctcatgtctgtccactgagtccccaccaggtgggttctatgtggcttatccatcagctaccaccagagggctgagagggcacccagggacctggccagaggctagcagggatttcctagttcaggtctccagatgacggcagtgaattctttctgagtttatgctaaaggggacacaccttcctttcccccctcctattattgtttatctggttgccttgccgtctgtgttaagattaacatggatgtgtcatagaaatatcacttaaggtttctttatttaatctgattttctttatttaaataagaaacaatcactgaaaatcaaaacaagagtcttggtgctccatgagatggttcctgtagtagggagagtaaaggcccccaaagatgtccacatcctaagccctggcacctgaaaacatgccaccttccatggcaaaagagactttgcaaatgtgataaagttaaggaccttgagattgggagattgttctcagttatcagactgagcccagtgttgtcacagggatcccaggatcaggggtcctgatcttacagggatctctgtgacaacactggctgggtgtggaaactcacatctataatgccaaccatttgggaggccaaggcaggtgaattgcttgagctcaggagtttgagaccagcctggtcaacatggcaaaaccatacaaaaattagctgggcgtggtggcctgtgcctatagtcccagctgctcagaaggctgaggtgagaggatagactgagcctgggaggtggaggctgcagtgagccatggtcataccactgcactccagcctgggtaacagcaacaccctatctcaaaataataaataaaacaagagggaggcagtgtgtgacaagagacacatggtcagggtgacagatgtgatggatgaaggaggccgcaggccaaggaaggcagcagcctgtcagagctggagaaggcaagtctcctctgtagcctccagggagaacaagccctgtggccaccttgactttagcccagttggacccacttcagacttttgcccttcagaactataagacaataaatctgtgttgttttgcgccactaaatttctggtaatttgttgccaaagccataggcacacaatacagtgccatgggacgtttgttggttctccgtctggagccctttgatccactgcctcccagcagccagccctgcggcacagatgactaccacatcccaccactgtccccactgtcagtggccacccaaggaaggagaaggcaggagagtttgggccaatttctggcctctctctcaggggcagtgacaacacatacaggagccctaggtggggctgtggggctgtcttgtctcatttaagagctccttacccttgggatgccaacccattcattcattcattcattcatctacttcatttgtaaatacctcttgagcaccagctatgaacaggcacacctcattttattgcactttgctttaattgcacttcccagatatttcattttttacaaattgaacatttgtggcaaccctacaatgagcaagcctattggtgccatttttctaacagcacgtgctcactttgtgtctctgtcacattttggtaattctcacaatatttcaaactttttcattatgattataactgctatggttggtgattggtgattggtgatcagcgatgttagtattgtaatcgttttgaggggccatcataaactgtgcccacataagacttatcaataaatgttgtgtgtgttctgactgctcctccgaccatgcatttccctatcctctccttgggcctcccttttccctgggacacaacaatattgaaattaggccaattaagaaccctacagcggtctctgcatgttcaagtaaaaggaagggtcacccacctctcactttaaatcaaaagctagaaatgattaagctgagtgaggaaggcatgttgaaaaccaagacaggccaaaagataggcctcttctgccagttagccacgttgtgaatgcaaaggaaaagttagctgctccagtgaacacatgaatgataagaaagtgaaacagccttattgctgatatggagaaagttggagtggtctggatagaagatcaagccagccacaacatccccttatgccaaagcctaatccagagcaaggccttcaattctatgaaggctgagagagattcaggaagttgcagaagaaaagttggaagctagcagaggttggttcatgaggctcaaggaaagaaatcacctctgtaacataaaactgaaggtgaaggagcaagtgctgatggagaagctgcagcaagttctctagaagacccagctaagatcattgatgaagatggctccactaaaccacagatttttcaatgtagatgaacaactttctattggaagcagatgccatctaggactttcatagctagaggagaagtcaatgcctgtcttcaaagcttcaaaggacaggctgactctcttgttaggggctaatgccagttgaagccagtgctgattggccattctgaaaattttagggcccttaggaattaggctaaatctactattgaggtttactactcagaaaaaaaagactatcttcaaatattactactcattgacagtgcatctactcaagagctcagatggagatatagaaggagattaatgttttcactgcatccattctgcagcccatggatcaaggagtaatttctactttcaacttctattatttaagaaatacatttctaaggccatagctgccatagataatgatttctcttatggatctggccaaagttcactgaaaatattttggaaaggatttaccattctagataatattaggaacatttgtgattcatgggaagaggtcaaaatatcattaaccatttggaagaagttgattccaaccctcatggatgattttgaggggttcaagccttcagtggatggctgggtgtggtggctcacgcctataatctcagcactatgggaggccaaggtcggaggatcacctgaggtcaggagttcaagaccagcctggccaacatggtgaaaccccatctctactaaaaatacaaaaattagccaggcgtaattgcaggtgcctgtaatcccagctactcgggaggctgaggcagaagaattgtttgaacccaggaggcgggcattgcagtgagttgaaattgcaccactgcactccatcctgggcaacaggaacaaaactcagtctcaaaaaaaaaaaaaaaaaaaaaaagatcagattcgcattttagaaagtatgaggtatgaggggatgtttccatgaagggacggtcaggctgggcttacacagggttggctgggttctgagatgtctgtgatgtcagtccttgcagacctgactcgaccctgcacggggtgttgcattcagccctctcctaggtctgatttgcttccagggaacttctgattgctttggccagcatgcaggtggacacctctgtggcttccctatcctccaagcacagactttgtggcctctcaacctgtcctgtgtgatcttcctacagatcgagggcacccagaaactgctcaacaaagacctggcagagctcatcaacaagatgcggctggcacagcagaacgccgtgacctccctaagtgaggagtgcaagaggcagatgctgacggcttcacacaccctggctgtggacgccaagaacctgctcgacgctgtggaccaggccaaggttctggccaatctggcccacccacctgcagagtgacggagggtgggggccacctgcctgcgtcttccgcccctgcctgccatgtacctcccctgccttgctgttggtcatgtgggtcttccagggggaaggccaaggggagtcaccttcccttgccactttgcacgacgccctctccccacccctacccctggctgtactgctcaggctgcagctggacagaggggactctgggctatggacacagggtgacggtgacaaagatggctcagagggggactgctgctgcctggccactgctccctaagccagcctggtccatgcagggggctcctgggggtggggaggtgtcacatggtgcccctagctttatatatggacatggcaggccgatttgggaaccaagctattcctttcccttcctcttcggccctcagatgtcccttgatgcacagagaagctggggaggagctttgttttgggggtcaggcagccagtgagatgagggatgggcctggcattcttgtacagtgtatattgaaatttatttaatgtgagtttggtctggactgacagcatgtgccctcctgagggaggacctggggcacagtccaggaacaagctaattgggagtccaggcacaggatgctgtgttgtcaacaaaccaagcatcagggggaagaagcagagagatgcggccaagataggaccttgggccaaatccgctctcttcctgcccctctttctctttcttcctttactttcccttgcttttccctcttttcttactcctcctctttctctccccaacccccattctcatctgcacccttcttttctcatgtgtttgcataaacattcttttaacttctttctatttgacttgtggttgaattaaaattgtcccatttgctttgcggtttgttttgtttgtttgacctgccctttgggggataatggggactgtgagccaagtcctggaagaaacctattgtgttcatgttggacagagatcaagggctatccagcgctggtcatcagccaaggaggtttgaatggtgatatccggcagtgggtcaggggtgtgcgctggcccttttgcccttgcagggacagtggggggcaactttccaggagggacccagagcagtcccctccatggccacatgaggaatgccatgtcatttctctcttagtgggcccccaaaccacccaggctctggaggggcttgggtgacactggcgatgttgaagtgcagctggcaaggagggggtcgcacagttgagtcagcagtaggtgcagctttatttaatctctttattcacatgcaagatggatgggagacatggataacagaagtgaacatcactgtctcaggagagtgggtctgggagcctggacccgagagctctgaggcctccggagagcaagtgggaggagagggggcgctgggggctgcatgcacacgagtagacaggagccagagaccagatgtgccatgagcaggggggttgtgggagagaagtgaggcatggcagggcctgggccagggcgtcacagccaggctggtttcccctgagagtgtcagggagagacattttggggtttggaaggaggggacccctaggaccaaaaggaaactggaagctcgccctgctcggcttcctgcctggagcctccatgctgtcccgagaacccgatgcccacatctgttagctgccaatgtcccaccctccagtctggacagagttggggggaggtctgttgcccgatcccaggagcagcagctcggcctgggatcctgggtgcagcctcagactgtggggtggtgcattgcattccaaggtgcacacacaggctgctctgaagggttcagagcaggtcaacacacctcggggctctgggagagacgaggcaggctgataagggacgggaccacagctttgccatctacacaacagtcctggggcccaaacaatccagcttgctcccctcaaccactcagaacaaacgccctaagtgctgaccccactcacccggcgctgtgctaggtgctgggggtgggaaaaataacaggcagagtacctgcctttgagaagttcagaatcaaaggaactaaaggcaaagatcttcaactcccaagtgaggcctcctcctgatggagccaggcacagggaacagggttcctggggagggaaggaggggtgaagggagggaggacaggccaaatgagatgagtttgaggtgggtcaggagcagctcaggatggtctttcttgtttgcctgctgcacgcgtagggacatatggagcccct

SEQ ID NO: 17405 - DNA, 22538 bp, Human
  misc_feature (1)...(22538): n = A,T,C or G
tggctttctttttgtgttatgtttgggagtttcacttgcctttagtgttacagctggaagttaattttggaaaaacattcttttcactttttttttcttaattctgctacaattatcatatttattgttgctattttaggtttgcctatgtattacaaatccaaacatataaaataattccattcagtttatggcactggtaatagcagcaacaaagaaaaatgagactatacatgttttctaggttgttatattttataaaaagtaagtggaattttttcttcatttcacaagagcatcactgtgcaggaatgttccaatagttccattaccagagttaggaatacaaacgcaaattaaagaaaaaaagaaaaccagattttgtataatcatcttattccttctcacctgatgacataaatatggtattagaaagttagtctacatctgtcaagatcaatttgcaataatatcaattaacttaacttgttagcaggtaactaattaattttcaacttacacatatgatagtaaaaacatatattgacattttcttaaatatttagattagatgatcatcctacttcaggatatgttgacttcattgatattggcatcgagcacttagaatgtattataaaatactgccaatctttagaaagtattttcattaacttcctaaacttcatgttttttatgtgaaatatctatgaggaaaagaggaaaaagaacaaaccactaaatgcagcataaattgagccataatgctgtgagattttacacctgtgcactttaatggaaacatcatataatactttgtagggtttaaagaagaatgaaaatgaaccactatggaagttaccagaaccaattttcctccattgggtgggaaatttcttatggaatgtgttctgtaatagttgctgctccattaatcctttcattttataggtctagttccttgttttggtgttcaactagtctacaatgtcaaagatgtgtatcaaaatgtatatataactgatctatattacagtttatatatatagttctatgtaactgactctatttaaaagaattaatgtagataggccttctgatgtcaatgcttttattgaatgtcataatgatcaaatttttggcattacctttgttcaaaattttgagccaatctggaactttattacttctatatttcttatttataacaacaagctatatctaggaacaaaagtcgtttattttttaaggcaagaaaaatataaatagaaaattattcggcactgtgtaatgttaaaatttacaaatatatgttatttctccattgtcacaagaattctagtgggtagacaacttagataatgctcctatatacaaaagtaaaaacagctaggcatggtggctcacgcctgtgattccaactcttagggagacagaggcaggaggatagcctgagcccaggagtttgagacctgcctgggcaatataacgagaccccattctccacaaaaagcgggggaaaaagacaacaaaacaaaagtaaaaacaggttcagaaaaattaagtatgtccctaaagtcacagaataataagtgatggaggtggaattcaaatgtaatattttgtttgttggtttgtttagttttgaaggtaacatactttttagtctacaacctatttaactacaaaagtgtgccaatcactggtattaggattggggcagatgtatactctgaaaataaaagtgcaaaataaatatcccatctggaaataaaagtgcaaaataaagagggaggaaaaatcagcccttccatttcttttcctttgtaatgccagttgaattggtttagtgagtagttttgcaagacttgtttcactttgtttttggacatagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaaggtaagtcttggttttccttttagttagttttggttgttttgaaaacttttctcatcactatgttaaatgttactgcttctacaggatttatggttagttgcatttaacatgataagtcattcataaatctttctgtagaattacattggatatttatattttaggaatcacaaattacaatatttttgttctacttagttaacaaatacaagtaaaaataagataagtttgcttaatactggctcattgtactcttggtaagttaccatgagaaagaagggaagaatgtgctttccctctggtagccttaaaagaatgtgtttttcctttccttccccttgaaatatttcttcccaagagctgtgtgttttacagagaaatcgtgatgggggctgctttttgggggcaagaacaaaagtgataggagtgggctgcagggaactgtttcaaaatagtaggactttcataatttattttcttcttttgtaaggaaaacaagatagattcagacctcaaagtgctaatcatgctctttgtaataaacatttaaaaatatatgttatatttgcttatgctatttaaaataagaaggtccgcttattacttttttcatttaaagagggtgtggccacattccttttcttgtaggctctgtgtcatatacagtcttttcaagtgctggctggaaaacctaaaaagaagggaaatactttctgggtagtgtcagatacattatcctaggggaatgtcagtgaggccctccaacagctattccacttgattgttgcatgagctaatggccataaaactccttagaaaagcacaaagcaaaactaaagaagagtatttactagtgttggatatatttgtaaaagtgagattacaaatcatgtatctggctatttttttcttaaacatgttccttcaagaatttttctgttcgttcattttaaatatttattaaatgttctgatttcttatgttcactgctagctaattaacaaggatggaatttttcttgccttggttatatctaaaagattgtaaaaactttgagaaagcaatgttgccctctttccacaggagtattttggtagctgtaagagaatgcacattgcaaatgactcaaatgtggtaaaatgttggtttcataattctgaaatggcctcttccccaaaagtgacagtaacaccctagctccaggctcaaccacatccagcacatagccaacatttaacagatgttgacaaaatggttaataataatattattaaggaaccagccagagtttcatgcttattaaatactttttcaaccagaaggtctgcaaaggttgatttctgaatatgacgttagctctctctagacctattaatttacgacatttcaaatcagaggtaaaccagcagacctattatttttcaatgataaactataaacagttttttgaagtcaactatttccttttcctttaaaattggacagaatttcatcaggaagctcagaacaatccaatttatataatgccttccttcattatgctaattttcttcatcttcatctacttgaagtaatatttaagattggcacttcagagctgtaaatggatcttagatgataattacttcaacattcttattttataaacgaagaccctctggagaagctaaatgtttttcttgaggtcagatcgccagataatcaagaaccagtatacttcaatttgtattttatatcctatagttgtgggtagaaaatgttcattaaattagtgtagatatgttttttaaaatattagcaatgatacatgatattcattcaataatacttattaacatcctaaattccaggcattttgctagggattggaagtacatacataatgaatattattatttgtatgttagcacgggcctcatggcctgctcctggggaatataaacaagccaatggaaagtgataatacagaaaggtggggctggtgtaggggtgaagtcaggatgctttgggagagcatggaaggtcaccgaatccagtgctgaggaactaatgaagggtttctgaagaacgtgatgagatcaatgctgatgagtcacttagaagtagcaattagttaggcaaagggaagtgaatgtggaggaggaacaagcattccaggcaagaagaacaccctatcgaaaagcctggaagcaaaacattagtgaggctacctttcataaattgctttctgtaagtcatgccattgtgtagtcttaattgctttctctcaccagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtgtgagtgattaaaagaacactgatcatgtcattttctttttggtcactaattccctccctcccttctctttcttttcttttttcttttcttttctttttctttctttcttcccgacagagtcttgttatgtcgcccaggatggagtgtagtggtacaatctcggctcactgcagcctccgcctcttcctgggttcaagtgattctcctgcctcagccttctgagtagatgggactacaggtgcacaccaccatgcctggctgatttttgtacttttggtagagacggggtttcgccatgctggccaggctggtcttgaactcctggcctcaagtaatctgcccaccttggcctcctaaattgctgggattgcaggtgtgagccaccatgcacagccaaaatatataacactttggaatcaaaagggatggatttatgtctccattcttgccactactagcaggaagactgcttgaaaatagcactcagttttcccagatagaaactgaggataatgattaaaggctattattccaagcaagggttagtcattgctgttactatcattgcaaaactctgatagttctagattgtaaccaggaagatacaatcaaccacaaaactcagcttcctctgtcacaaattctagatagaggtagcctttcatgaggctgagagatggaaaaatgaagcggggggactctcttaggacacataaatatgcaaaaaaattgctacgctttagaaagctatacattcaaatcatagataagctgacattagtaggcagtgcatgttcacaaaaagaccattaattagaagaaatgtgaaatattgttaatttccttatagatttgcctatgtataaatggccaatttcaccgtcaatgagctcatgctaagtactgaaataaacttagttttagagcttatctttggttagttgaaatctgtattgagttagttgaaatctataagttgatagaacaggctctttaaaatctattgcaagctttatacactacaaacaaaaagatagaaaaaagaaaacctttcatgaactcattggcttaggcaggttttcatgcagagtgtaggtattgaagagtcagaacggcttaaggatagaatttggccaatatataaaaaaatatatatttggtatttgttagttgtattataattattcagaagttcagttaatacgtgcagttggctttgagcccttaaccagctgtatgtgataaaatctgtttcctttagagcaatttcttatatcctgccttgatgctcctgtctttaatctttgctaagagctggtggtgaatttggctgaattcagattccgtttttctctaattgatttcttgaagaaaattctctattggttgcttttctttcctagattatgcttttagtctatccaaatacttcaggctagaatgtaggaacttagaagatacaaatcacaaagctgtctcctctagggatgctctctctttcaaataagtgacttaaacaacttatttttgttatcttgtgttatgtaattaatataccttttcctgggctttctctggctttttttttaaatggacattattcaagtattttttagaagtaaaaaaaaaaacagtacagtaaagtttttataacgtttattttgaagttgtcagagacacctttaatattagactggacaatatctttagtctttcttttgctttcttttgaagtttttatttgctaattgaaaagaatggaataataataataataataaataaataaataataataataaataatataaataaataaataaataaataaaataaataaataataaaaacatgtttttataagtgatggagtagtactttgccaagtgatgaattttaacactcattttgatgattcttccttatcaaagccttggatgaaatgatgaaaatggaaattttgagtgcctgaagctgctagaattgcttttaaagtattgggtgtgccaattaagaaggtggaatatgaaactccatgtggcaaccgcaattgcatgaaactagactgtaatgggaactaaaaccttgtgcaaaattgcgggttgttactttatcaggaagcaattttaagtctatcaattatatttaggaaacaggctgctttaaatgaatggaaaaagtattggttcttctcacagatgacagaatagtaataagagcaatcccatgcgaattaagtggggatgatttctgctttggatattattttcttcatgcattcagtgttattacttgcaactccagttactttttagcaggtgaaaatggaaagagtttgtctgaacatgctgttgaggaatcagtttatggaatcagtttatgcctcatgagtcatttatcttcatatcaagaatttaaaactgccaagattgtcctcccaacctctctcacaaacattcatgagagtagtctctagaggggtgaaacagaatggtgtagatagacagatcagtgtagaccttgagcaaggcctctgaaaaacatccccagactaaaaggatctgtgatggcattttgtgtgtgtgtggccaaaacagagaacacattaattttcaatatacttaagatcttaaaaatatatgtctcattaaataaaaatattgccaagtcatgatagcaattcaagaaatttcctttaagatagagtttgccaaaagaacatgcatgttacaattgcacctctaggcttcctgctacaacaaaaaaatccagtataaaataattcttttctgggttttttgtgttgggtgggaaaatatgtaggactactatttagacagctcaaataggaagaaatgtgaagatagcaattacttcaatgctgagtacttttatatcaagaaatagaaaaggaaactaaattattcagggagaaatatcacctggatatctttttacaattaaaattttaaatctgaattcacttgtacagattggcacaagttattttaccttataaatgtaatcattggctgggagtggtagctcacacctgtaattccagcactttgggaggccgaggcgggcagatcacttggggtcatgagttcaaaatcagcctagccaacatggtgaaaacctgtctctactaaaaatacaaaaattagccgggcgtggtggctggtgcctgtaatcccagctactcaggaggctgaggcaggagaattgcttgaacccaggagacggaggttgcagtgagtcgagatttcaccactgcactccagcctgggcgacagagaaagactccatctcaaaaaaaaaaaaaaaaaaaaaagcaatcattaagcttttcatctagccattacttttgtacaggctctcattaattccacatagatggtctaatggtctactaaatagtattctaatcctccatcttgtctatctcttagccattctccatgataaaggatgaatggtctttcggaaacataaatgaaaccatgctgctttaaaaaaacaaacaaacaaaaagaaacccattaatgttttcccaaagctttgtggacacattgaagcttcttgtttcagcttctgccaacatttctcgctccagcaaactttcttctgcttcccaaatatgacaagcttcttctttaacttttctgccaggttaatcttgactcatttcaagagaggcttgggtcagccagggcctactctaagaagtttctttagcccttatgttttcctatggagagcacacactagctttaagtcctgagggtacttaagatgatatttcaatgtttttgtactcttagtgcttggcatatggtgggtggtctacaaatttagaacaatgtagtgaaccacaaactcctctcttcagcctgtgtgcttacttgtagtagttgtctgatctctaaaatttagaactgaatatgccaagaaagagttcaatttcagagaggagggtatggtttcattttaagtataaaagcttcctttaaaaaaaattacgtcttacattttgttatgctcctaagtgtaattgatcctggaaagtaagcgcaaggctactctctaatgctaactcttatgtatgtaagaggtgaggaaggagaggttgtgtgtggtgcatttgttttgtaaaagcatctaactgttttctttccagacactttttcaaaaatggcaatggtatcagaattcctcaagcaggcctggtttattgaaaatgaagagcaggaatatgttgtaagtagagtgataataaaattatgattacaatattgaaataaaaacgaatataagtaaatggccattaatttatttctctctcattcttagcaaactgtgaagtcatccaaaggtggtcccggatcagcggtgagcccctatcctaccttcaatccatcctcggatgtcgctgccttgcataaggccataatggttaaaggtaacgtgtttcctcaaaacagttccctcctggacatttcagaatggctatttgaatgactgtcaaaaaacagacatgtgcaatggaaagaatctgtttcattttgaagataaaaacatttctttgccaaacgaagatgtaattatttacttaacactgaggaaattgtgttcacatcagtggaatctctattgttacagcagatattactggctcatttctagcagaaattccatgctgaaattaaaagctctgttcacatatagagttgcaactagtatcaaacactgcaacactgagggccaggaaaagttaattgtctcttcctttctcactcgaatgaaatgtcattctcccaagtgcttccttgatatgtagtatagcatcgattttttaggctgatatataatttatatttcttaatttgttaagaagttcttttggagcatctcagtaatgaattattttatgtcaattgatgatgaagaaaattggtgttaaaggctgttggccctttatttccaggtgtggatgaagcaaccatcattgacattctaactaagcgaaacaatgcacagcgtcaacagatcaaagcagcatatctccaggaaacaggaaaggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagttttctaaagcaatgaaattagaaaactatataatttcagtatctgattatactgcttgttatttgagaagtacaaacctcaaagattggaaacatgaatatattattttaaaagtaattttacttctgttttctgttagcacacagtcctctgtgttttgatctttgtgatttctcccctgtgtataagattactaaccctatgctttaagaagttattgatgaattcagtaaattttattttaatccctctagatctggaagggtaagataatgtttcaaaatatttggtacactttgtatgtgaagggaagaagctctaaaagatggttgggtttagggatgagttgtacgatgacctaaagtcaggtaatatcacattttttaacctagcatgttacttattggaagtcctgattctaatctttttttttgtagcccctggatgaaacactgaagaaagcccttacaggtcaccttgaggaggttgttttagctctgctaaaaactccagcgcaatttgatgctgatgaacttcgtgctgccatgaaggtaaatcgcccaatttgagcaaactcctttcctcaagaggatgtattgggcaagtcacttatgcttatgttattttcaaaatctagtatagtacctgtcaatcagtgggagtttgaagaataaataaattaatacctcaatgaaggaattaatatataaatgaaaacagaaatgttggcactaacaccttccatgtcatgtcactatatgagtcatatatttgcatttttatttttacccaaaatattgatgataaacttgttttgttttagggcaatgtaatagagcttattgtaattattaaatgttgtgggtgaaatttactaaatgacagagtcaaacaaattttggaacaccaaaaactcattgatcctcttgcatgaagatttttttctacatttatccttttcttctcttcaaatttagggccttggaactgatgaagatactctaattgagattttggcatcaagaactaacaaagaaatcagagacattaacagggtctacagagagggtaagttgtaatgtccaacagtccaaacgccttatttgaaaaggaaatctaatatactttcttaaaattgactgtctatggtaattatggcagctttggaatctccacatatcaaaatgtttctttattgtttggcacatgtctattaaatgctgttaccaggcaacgcttgagttgctaggttgctgacaagggagatggtgtcccaatccgcatcaagcttgcgttttaatagaaaatgttcctctaggataaatggccacatacgattataatggaaacctcaattcagagcattgaatttttaaaaatttctgaaaaacacttttctattattctggaatgtattttataaaaatgtcccaaggtcattttttttgaaaagaatatataataacaaaaaaatctcctaacaaaatgtttttcatttgtccttgaaaaagtaaagaattaggtgcttataattctctgttggaaaccttaactttatcgttatgaacataagagactcactttatctctagttaaattcacagaataaaagactagtcttagcttattttatctctccagtgaagcatctcatttaaatgatgtgctcaacactgaaaagagggtaattgcaagtctcttaccattttcctactctcatttccctgagctgctggctttttggctttcccaatgcaatatatggcatatagaagatctttctgcttgattctcataccaagcatggagaatacaatagcttttgcatatcattttcagaggaatttaataaaagaataaaaataaggaagcttttaaacctcattttctgcaattcttatttaattaccaatgtttatgttagatccatgtgtcagtgataataatgatgattatttttgtttgataaaacatagtttataaaaataagtgtttatatatttttcatatggccaagatataggccagtgatagtttattacattgcccagtttcaagttgttttagtccgtttgtgttgctataaagaaatatctgagaccaagtaatgtaaaaagaaaggaaatactgtacaagtagtatgggaccagcgtctgcttttgatgagggcctcatactacttctactcatggcagaaagcagacagaagcagatgtgtgcagagagggagagagagaaaaggaggtgccaggctcttttcaacagccagttcttaaagaaactatgaatgagaactcactccgagccattcatgagggatctgcccccatcatccaaacatctcccaacaggccccaccttcaacagtggagaataaattgcaacatgagacttggcagggccaaacaaacaatatgaaaaccatagcactagtcaattataaattcaattattttttcctattacagtattattttatgtagttaagcagaagtgtttacacacacataaatcatcaaactgcattacttataagacatttatagtttttaaactaaataaataatttgcattcaagcaagtacctcattttgttcttttaaacaattattttattcattctattgcttaaattctgccatgttgtatttcagaattaattactaatgtatacctatacaatttattcttaacgaaagctttatgactgtgagttttcaatcacagtattatctaaattgctcccattgcttcatatgaaataaattcaatgatccaaaaatttacctgctttaatttttctcttcttatttaaaaatgataatattttgcaacatgttccataagtcattgaacactgtggcactgtgaattttcaaccaacttagagatgtcagatattcttattattattcatcactggtttactataaaatctatttttcttttttctcagaactgaagagagatctggccaaagacataacctcagacacatctggagattttcggaacgctttgctttctcttgctaaggtacaactcagatactttaggaaatgcctcttgttttataaagactaatttcttagtccattttgtgttgctataagggaatatctgaggctaggtaatttttaaagataaaaaggtttatttggctcaggattctgatggctaacaaattcaagtttgggtatctatgtctggtgagagcctcaggctgcttccactcctgacagaagaggaaagggagctggtgtgtgcagagaccacatggcaagaaaggaagcaagagagagaatggggaggtgccagcctcgttaacaaccagctctcgtggttctcatgagcaagaactcattcccagtgacggcattaatctcttcatgagagatcagccccaggacccaaatacctccctctaggccccacctttaacactggggatcaaatttcaacatgaggtttggaggggaagaacatctaaaaccattgcaagtaaaatcttgtatctgagctccttctagaaatgagtaatagaatacctttttctcaaaaaatattatttatctgagtttaagataattaagtaaatcatgcaattacatgctagagaagagcttacaatagaatgggatttctttcagggtgaccgatctgaggactttggtgtgaatgaagacttggctgattcagatgccagggtaaggaagtgcttacaaaatactgctgcagttcatcttcctaccttaagtggggctaccacatgatcccctgtgaaagcaaatctaagatcttctgagagaccaatggcttcttaatgttcatttcctgaatgaggcatgtctttctgtagcccccacacacaaaaaagtagtctttgtaagttttcaatatctctcattattcgtaaaaccagagagaactgaagaaggacaatacaaatttgatttgtcattcccaagaattgtttgttaaaaaaaactctgacctttcgttgtactaggtataagaaggggaaatgtaatttttttattatgtgcaatggaaagagtaagcatatttaacgttatttttaacagagaactttggaatggtttatagatgtcaatttatattgtcaaaatattactgcaatgatataacaagagtataggataaattataataatatatgctttctaacatattgttttatttagtttcagtgacattgctgattatttatatgccaaaccactggcaacataagaaaaatcatatcattttaaagcctggaatttccatttaaaacaaacaaacaactaatatttgcattatgccttctcatggaacagtattctctagagaattcattacagtgcttcactaaggatagagatttctttgtgcacccccatccacttctgctataccagtacattatcatgtacataataggcactcatgaactttttgttcaacaaatgcatacatatcagatcaatttgcttgaaaaatgcaaaataatttttacatacattgaaggttttatcattttaatagaaattgttcaagcatattaaggaacaagagttagcatttgaataattgcccataataaaaaattcttatttgcttttgacatttctgaatttgctttccattttaagactatcagggttcttaatatatatttatggaggttacatggattagtgtgacccaagagaatgatggtagtcaacatttcaaagttaataaagaccgcttgtgacaatagggcagggattatatttttcatatataaaagaaaaaaatctgtcatttagtaaggttgatctatttgtctaagattatgcagctttgaaattgcagagtcagaatttgaatacagaaattctaacatcaaaatgcaaggtccaggttacggttgaattattgatttataagtaacatttgctgataattactttgaacaacacagagtaaaaaatctttagagatccccttggagttgtcttactatagagcataatcttaaagcaatttagttcagcaaacatttattctgcaaacatatattcagactctagtgtttacaaggcaccttgagagaaactgtggaagatatttgacaaacaaaataaggtccctatctttaaagaacttgcaatcttattgttgactactctgattgtattgggcacaaagcgattgcctatataatctttgacaaggtctaacattattgtgcagatatcatttcagcagatagtgaagtgtttacttttgtgtttcttgacaggccttgtatgaagcaggagaaaggagaaaggggacagacgtaaacgtgttcaataccatccttaccaccagaagctatccacaacttcgcagaggtaacaataaatttctttttctggaatctgtttatggaagatgcaattttcttttttgatgacaaataagagaaagtaaaaacagaaccctttttcaatatcactcctgtatcaaacagatacagtgttcctgacccattgttatttgtcaatttgtccaattttgtacagccgctactttatcatatttaatacattttgtgacttgggcatgtggaacataattttgttattttcactgcttttactcccctaaaagatttggaatatgtgtgggaaaagacatgcataacagaacaaatgaaattagaatgaagaaaaacaaaaaaaaaaaacaaaaaaccctcagagctaaatgaagaaagaaatatgtaggtgctttggaaaaacaacaacaagacaaaactcagaaaaagtcctggcctttgagtgcaagatttagctctgggcctcttggaagtgaaggcgatggaaaagttatgacaattaccaaagttcaccatcttataatagtatactgatttctactgttaaatgtaagagaaatttagtgcacaggtctttatataagggaagatccatttgctgtggctcttagaactgctgtaggaagtgctatagttgtcaatcacatgccgtttctaataactgtcaacatttgcaaacatttcgccaaaatatataggaataccaaaatggccaggtaagttacattcctaggagaggatgaagtattcacgttatgattaattgggtatattgctttaaaaggtgtagccaaagttgttattctaaaaaattctttgagtcagttgccttgattttgctaaagctttctaaagaaaaggatgttttgcatgtatcttagtttgaatttaatattcagtgtttcagaaatacaccaagtacagtaagcatgacatgaacaaagttctggacctggagttgaaaggtgacattgagaaatgcctcacagctatcggtatgtagtccagcagttgaaagagttttctaactagaaattgtattttcaaagctatcctatacttaacaagaacaacagcaacaaaaccaataaaagaaaacaaaaaacaatcagaagtagtgcatctgtttcaattgaagcaacgtaaaagattggcaaagtactataaccttaataacaatagatattattccccttttcaaaaatagagagagatagactatacttattgagcacctacttatatcaaacaatgtaccaggctgggcacaccacagaggcaattcagaatggtcactgagagcatgggatctggaataaatgtaacatctggataaatgtaacttcaagtcctggtctactgcttgttaattgtacaatcttgggcaggtccaggagagtctgattcagtgggtccgagttggcctctaaaaatcggtactttttaaagatctcccaggttattcagacaaccatcagggttggggaacctatgttctcaagcagtgtttctcattcatgactatgcacttgaatcccctggaaagcttgttaaaatgcagattctgattccccaggtctggggtggagcttagattctgcttttctaacaagctccccattgatgccaatgctgttggtccatagatctcgacaagatgaagaacactatgaactggaatgtgctagtattatttgggttctgttttatatttaagcccatcctatcccagagttttttcttcatttattcatttatttttacttatttgtttgtgcaactcttactttagacacagaggtacatgtgcacgtttgttccatgggtgttctgcactcaggcagtgagcatagtacccaataagtagttttttgaccaatgccccttctctccctgccctctctagtagtctgcagtgtctgttgttcatagggtgttctttttaaatgttcttatagtaacataaataaagtatttacataggcttgaacacctagtggcttctccactcccaaggagaatatatgttggatagcgcaaactactgaagttgctcttgagatgtatttaaggtaataaaaaaattgatcgtcagggaaaagaatattcaaaaccaccatctagagagtcacaaataccttctcagaagttaactgccctatattgggagatgagaggtgaagaatgatgatgagggatagaacactgttggcaaaattctatatttcctgtttctttcatatggatatttcatttttttcatggtaaatacatcaactaaaattttcttctctaacagtgaagtgcgccacaagcaaaccagctttctttgcagagaagcttcatcaagccatgaaagtatgtaccattctacttatatgtcctgcttagaggaaaaattatttgtagaaagaacagaaaacctcatgttgtttgaaaatctcacatttaatatcttcccattaatgagaatcattgttctatttgatgaaagaggtaatacactaccttctcagaataaacttctgttagattcggtgcctttttttacagatgagattgtaaagtgagcctgtaagtgatttacggctcacttgtgatttgcttaaaacatgtgtcaccacgggaagggtgatgtactttcttttttaacgtgtaattttagtggcctacttcctctaaggttgtgagttttataatctcccactttatgagtctgatttgttgtttttattattctgtcttttatgccacagattaatagttgaaacttttgaaatgtcattctatgattaaggatgtagaatgatgtatttgagatcaactatgtcactttaactttactgtctgacatgcatggtattatacaaggtacctcttctattctgacattttgagcccacaaatgaatagttatgaagttatcttccttttttctttgcagctccaaaataaggaggttttcagagagagagagaaagaaagatctaactatttgaataatatgaaggaatattttgaatatatatgaataatttgaataatatgaaatgatagacatgctaggtactgctctgtagtggttagcatagttgctgccccctttctgccatagtctagtgtgatatttcgttgggtaatgatgaatacctggtgccatggaagagaaaagtgggacatatactccagactttggaaatccaggtagcattgctgtcagctaaattaacacctgaagtttaaatagaaatgagccagatgagggcaagagtggaagagatggggataaagcaagggtggtccaagaggaagaagtaacccacacacaggcttgaaggcaaaaggtaacataaccttctcaagacagtaagtatagagtgatggtgcacactggaagagatggtagaattaggcaggatattgtaagccttgaaaaagaattaggcaggatatcggaagccctgattagattctatcctaagagcaacagaagatcactgacagtgttttaaatagatagactagtttattagatttgcagtttagaagttccctttttttgtaattattggacagtgtagagaccggatggtgagagatgagttaggaagttgtgacagctctctatacctaccgctaatgtagaggattatttattttcatttcattaccattcgtgtaaggtgtgtgtgtgtgtgtgtgtgtgtgtgtgtgtgtgtgtgtgtatagctagtttctctatagaaattatatggaagagtaagaaggcttcactttaaaattcatgtttttaatgagagtattttctgaatatgagacacttaccctcatttattttggccagggtgttggaactcgccataaggcattgatcaggattatggtttcccgttctgaaattgacatgaatgatatcaaagcattctatcagaagatgtatggtatctccctttgccaagccatcctggtatgttttgattcctctaatgccatcccaacaaatgaaagttctttttgcaagatcttcaaggagaagagttgacttattgtatctataaatttaatatgtaagattaatttaatatattatggtgtatacttcatgagtaaattgaactttcactggtaaaatctactagtgagttctctactgaaatactaggtacatttttcaactaaagtcatggaaacatttagtttcccatgcataaattcagcaagcagaatattctagtgttccccctagggtagatagacattgtggtttattttgccattaatatttgtcagaggattagaaactccttattcaaaatatttatcttaattctatcacatgtaaaatgtttaaaatttatgttcaaattgtctcataagaatgttaaaaaataagacaaagaacagtcaagggttttggacttactgaaaggtagataacgattcaaatttaattaattagtcatattggataactaaaatctacccagaaaatgtgagaaaattacaggcactatacatttctcttcttctggtgagtgaatcaggtatctcctcacataagatatgagattatattgtgttatacttatttaattttgtgtgatatttcattcatagaaaataatggcactaatataaaacataattaattcagaaaagtttgtaatctcagtcttgaaggctattgcttttttatgcaatgataaaaaatcagttatctgttgtatatattgtttaattaagtgaatggtaatgtgtaatctcatctacagctaagtctaaaaataattcttctataagtaaaaaaaaatagagaattatggtttcgactaacattaagtatacctttttttgaatcaacaggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaattggtgtgtcattgactcttctattttgattttcttttctgtgtaattcagtggtttaatttgacattaagggatacaagcctgaattctagattataattatttaatgaaatagagttcacattctgaattgaagaaaatacttatagcttttgaaaagggatactacattttatcgtatgtgtacagactattgagattgtgtctctgtataataaatttattgcactagcattataacaatttgatatattctatatttcattaactagtataaagatgaaatggcaatacttgtaaaaagttctcatgtttgtttcatggtaattttaggtttactttttctaagaaactgccaaattgttttccagagtggtaatactattccactttaccaccataaatctaacagtggttcagtttctccacatccttgccagcatttgaagttgtcactattttgtatttttagcattgcttattatttatttatttatttaatttatttatttattttgagacagagccttgctttgttgcccaggctggagtgcattggcgtgatctcggctcactgcaacctccacctcccaggttcaagtgattctcctgcctcagcctcccgagtagctgggattacaggcacccaccaccacacccagctaattttttttttttgtatttttagtagaaatggggttttgccatgttggccaggctggccttaactcctgacctcaggcgatccacccgccatggcctctcaaagtgctgggattacaagcatgagccaccgtgcccagccgcttattttttatttattgttgaatcttgaaaattcttcatacattctagatattagtcgttcatcagatatgtggtttgcaaatattttgtggtagtctatagcttgtcttttcatcatcttagcaggttcttttacaaagtaaaaattttcaattttaatgagatccaatttattatttatttttcttttatagttgtacttttgatgtcatgtctacaagctctttatctaacccttggccttaagaattgttcatgttttttgctaaaaattttatgattttacattttacatgtaaatttgtgatccattttgagttgattttttataaaaggagagacttaggttgtggttctttttctgttggcatcgttatcaatgtccaattgcacctgcaccatttgttgttggttgaaaaggctgccctttgttaacttgcttttgcacttttgtcaaaaacaattggacatatttgtgttggtctttctttaatttttgatatttatatttaatgaaaatataaaaccttgcaatttctcattctctatgaatagatgatagatatcaatttagttaagctctttatttcaaggagagcatcagccatggtacgagctcttttttcaaaaaggcaatgggaagagttactttcccgtgagcgccttctcactaggtagagctggataaaggtggtaacaatttattcaccctcaaaagacttgggttgtgggaggcagagcttgcagtgagccgagatcgcgccactgcactccagtctaggcaacagagcaagactccatttcaaaagaaaagaaaaaaaaagaagacgttgggttggccatgggatattctgatcactctgagctgcattcagagttaaccctccttcacctggttgtagcttgtcttgatcgctgaccttaactttcttctacacacacctgtcccgcgtatcatgtgttatagtnnnnnnnnnnnnnnnnnnnnnnnnnnnnnnnnnnnnnnnnnnnnnnnnnnnnnnnnnnnnnnnnnnnnnnnnnnnnnnntaccatatcgcctttgtatgcttgatttggaagaagtacctatgtgggaaatcagagggaacctggagctgttatatcaaggcaggatgaagttatcaagatacttttgttagcactattctaataattggggccaggtgtttt

SEQ ID NO: 17406 - DNA, 32868 bp, Human
  misc_feature (1)...(32868): n = A,T,C or G
gttttttggttacttatgtgtcactgagttaagttttcagtaatctttctagctacatattgacaaataagttttattataaaaccatacggaataaatttataagctctacctgaaaagttacaggtgtagcttacaattttgaaagtgaaggaactaaaatttagcaccatataggtgctataataattctcaaagtagcattgtaagaaggtgactctatctgagagctgaataaatagttttagatggtttaggtaggtcatttcaccaaagctgtacaattagaagtcttggaactgtaactgtacagctaatttcaacccgaatctgccccaaatctcctctgcagactacttagctgtttgaaagtacttgagttacttggtactacttgtgtacatgactaaattgttagttttaacatgcaagtttttactgtagttagataaaattattggaagatgattataacttcttaaggggttcaatctgattttttaaaagaaaaataattcttttttgcagagttccttgcagtggggtaaaatattcaaatatgggaggcaggcatataaggtaaataatcacagcagggagggtgtaataggatgagtgataggggtctgtggcaaactggagtgagtgaaaattatttggtgaccactctggctgactattcccatgcttggtattcatatttttcaaaagcagctggaaatctagatttttgaatgaaatctggcttttagttaggattttgtctttaacttgggcccaaaccaaatatagctgcagactggattaggaaggccaccaatttaaggtattttcccatgtccaaatgttcgaagagaatgcacacagaaaaggttatgttttaagtaatatgcacagtgcacattgttaggataacagctttagtgcttcctaggtgtcttagtccatttggactgctgtaacaaattgccataaactgggtggcttataagcagtagcaatttgtttcttaacagttctagaggctgagaagtccaagataaggagccggcagatttggtgtctggtgagggctgctattctggcttagagttggtgccttcttgccgtgagctcccttgggcctctcttataagggcactaaccccatttatgagggctccatcatcatctaatcatctcctaaaggctccccttaatactgtcccattggagattaggtttcaacataggaatttgtgcaggggacaccgacagaccacagtattaggggtattttgactgcagcaatgagtttactactattttgagagagaggttgtgctttatgcaccatgtgttccacgagttggacacagtgttcatacgtgatcctgtcttttaggcaagcccaaacaagtgtttctccttacaataccaagttaatacagagcttattaaatatttgagacaaagggctaagagaagtgtgaggcccaatttccctttgcaattattgctggcaaggtgcaagcttttagcacgtgaactattttcctggaaagcacacacacgaaaacttgaatattccttccggggaaatcgacctctatcggtagccatagcttccccttcgctaagaactgctgtaagcacgaaatcgacatcaatagaaacccttccgcgttcctcggtaactaacggcaaccctgcgctcccggatgtgacgtcaacgttcttctgttcttccgtctgtcgaccgaactctgggctcgtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggtaagagagagaggagcggggttcctggctcccggaggctgctgttctcttgatgcaggcaggttaagtggtgtagagaggggtccttccttgctgagagagttttcaggaagtaatttctccccggcccgttccctaatgctgcttcagcctccaagtcggtctttgctgttttcctgagggaaaacccagatccaggttcccccttgtctttctttggtcctgggtgcgaggcttgtggacttggatgacaggggacttggttggttggtcttgccctcaagctctccctcgacgcagcttccaagcacaaccttcccgaacctgaacctcgaattgcttcgcgtctcgggcactgttgggatccaaggtctgaagtacgtaaatcatcagggaagggaagaacaatcgctaacagtcagtgaacatttcgcgcttggtagcgcgtaatgtggttttatgttgttgttgagacggagtctcactccgtcgcccaggctggagtgcagtggcgcgatctcggctcactgcaacctccgcctcccaggttctagcgattctccttccccagcctccctagtagctgggattacaggcgcccaccaccacgcccggcaactttttgtatttttagtagggacggggtttcactatgttggccaggctggtggaactcctgacttaaggcgatccacccacctcggcctcctaaagtgctgggattacaggcacgagcctgtaatgtgcttttttatggccttctcatcttcagaacaactcccagagagagcttggtttatatccgtgttttacataagaggaaaatgaggcccagaatggccaagtaacttgctctaggtcacacggcggaggaggattagaatgtgccggaggtattagccggaaaatgtgtgacccaagatttctggatggtatcacattttatttctgaatagccaagtctctctttgcagtttcattgagctttatctttcagggatcttcattcagttgcttttgactcttaagtctaaggaacagttcagcatttgatgtgtggggtaaagatttgctggtgttgggggatgtgaacctttgtgtgaaaaaggataagagatgtacttgactactcctttctggtttctgttcttaattttacatcattgaaaagtcaggacctaaatttgaggtacctcagtttaagatattttggtccatgtgtgtatgtgatgatcctctttactttttacaagatgtcatataaccttgctggagtaactctgttttttcatatgtgccccagttaattagaattactaaactttagataagatagaatataggttttatatataaggatatttgttttcggaaaatgcccatagtcttcagaatggtataatttagatggataccaaataaccctgggattatataaagtattctccaagaggcaaaattaattcctgtcatcttttgaatgtatttaaattaatcagacataatcttggttgttcatttgcatatttaattttgattttctctggtttggatattgtgcaaatgaatgtgtagaactatgcctccaaactgaagttttctacatacttttcatcctaactgcctttgaagtcatacatatatttacatatatatatatttgtttttttgttttttttttttttgagacacagtctcactctgtcatccaggctggagtgcagtggtgccatctctgttcactgcagattctgtctcctgagctcaagtgattctcgtgcctcaacctcccgagtagctgggattgcaggtttgcgtcaccacacctgcctaatttttgtaattttagtagagacagggttttaccatgttggccaggctggtcttgaactcctgacctcaggtggtccgcccgcctcggcctcccaaagtgctgagattacaagcgtgagccactgcgcctggcctgaagtcatattaaaggatagattctactataaggcttgatagtttttagaagcttttagttacttgtgctctctccaccaacttctaattgtgaatattttgtgaatattttgttcagccacattttaatttgaaaaagaaaacatttttaaagaaatgctttaaatactttaacgaatataccatttttaagatcctgattatgccatttttaaaaatcaggattttagtagtagctatttgtatgactgatatgataattaactttttccccaagaaaacagtcattttctttgtagcgcttttttaaaaaccctagtgtcaaccacctctatgtcaaagagcaatagttcttaaaaaaacacacatttctgaaatttataatgaccttgtaatttctgacataatttagaatttgagaacaaaacttcctcttagagtgggcttggagagtgggatttagagaatcagcctgtgattaagtggatgaaaatgaatttgttctctagaacttaccattcccatcagtttaatatgatcttcgggaaagaacatttgtcaccattatcttggtttgaggcttttgttgttttgtttgttttcgagacaggttctcgatctgtcacccaggctgaagtgcagtggtttgatcatggctcactgcagcttccacctcctgggctcagatgatcttcccacctcagcctcctgagtagctgggaccacatatgtgggccaccaggcccagctaattaaaaaaatttttttgtagggacaggggtctcactatgttgcccaggcttgtcttgaactcctggactcaaatgactcttctagtgttgggattataggtgtgaacctccatacccactgagttcagtttttgagtgttgccctttgtctagctcataactatattactgatattacaagtaaaaattaatatgaaactgactgaataggtagggtcatttttctgtgactgcacatggcccaacctattcagttagttccatattagtttatttcatattgataagtaaagcgtgttattatgagatgaatcataggtatcttggacttactgtgggttataaaacatatactgttacttccttaatttgttgtggggaggaataacatactcgcatctggtagtccaggccaggcccagtcttttgtctgtgctcctccttcctctcaggtggacccacaccagttttcttccgtaagtccctgtattaacttggaaactacttaatgatgtagtaagcaaggagtttagcaggtgcaaattacaggtatttcatagggtattttttctaaatttatatttatactgatttataatgatgattgaaatattaatgtaacatatatgtgttcttttttaatatttacttttttgttaaaggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttctacaccaataaatgaaggacagactgtgttagacaaggtggctgagcagtgtgaacctgctgaaagtcagccagaagcactttctgagaaggaagatgtttgcaaggtaactctagtaagtggaagggatttttagatgtgctttttggagattaaatcatttgttttaaaaaatactttcattgatgcataataatttatacagatttaaaaacatacgcattttgccatttctgtgtagcattaagtaccttgaagttgaacaattattaatataatttggaatttctccaaggcaattatggtagaataagttgatacttcaatacagttaagcatgaaagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatgataatttaagattttaattattggtgcttttctgttattagtattttcattcatatataaggagtatatatccttatattgcttcagtttgttttctgcttatgttatttttgagatctcctattgatagctatatttcacatgaacgagaaagagaaatgtctaaggaacaaaagcattgcttaggagggacagattgcttctacctaatacatgtgaaaggaaagtgatataaattctttgacattaagtcctagttttggtttttactgtgacttttagatatacaaatttagttggatctggtatctttaatagacttctgagatgtaggatgtcttgaagaaatgtcctgtaagtgccatgtattgaattacttaattttttaaaaaagtgccagattctgttaatcaggttaaatattcacaaacaaaatgctgtgcaataatatttcaattagtaatagctatatactgtaagatatataataggagtttgaattcttagaaaccagcactaattactatcagatatttttgaatttcagtgtatttaagaaggtaagtgatttctaagttcatctaaaccaaactcaggtaagactttatttttttgagtccaaaaaggaacccttcctactccttttatactcaagtttatcaccatttgagtaggacctaaggaattagacattccaagcattactttttgtttagctttatactgatacattatggagatttaaaaattcttatgggttttctaaaattacttttagtgtggatggatgtatgtatgaatgagacagggtctctctctattgtccaggctagcgtgcagtggtgcgatcgcggctcacagggtctctctttgttgctcaggctggtgtgcagtggtgcgatcatggctcacggcagccttgacctcctgggctcaagcagtcctcccacctaatccgctctagtagctgggaccataggctcgcaccacgcctggctatttttttgatttttagtagagatgaggtctcactatgctgccaggctggtcttgaactcctgggctcaagcggtcttcccatcttggcctcccacagtgctgggattataagcatgaacccgtgtccagccctacttttattttattttatttatttattttttgaggcggagtcttgccctgttgcccaggctagtctgcctcccaggttcaagtgattcttctgcctcagcctcccaagtagctgggactacagacgtatgctaccatgcctggctaatttttgtattttttgtagagatggggtttcaccgtgttggtcaggctggtcttgaactcctgacctcaagtgatctgccctcctcagcctaccaaagtgctgggattacaggcatgagccaccatgcccggcctctacttttatttatttatttatttttactttttgagatggagtttcactcttgtcacccaggctggagtgcaagatcattgcagaatcttggctcactgcaacctccacctcctgggttcaagcgattctccagcctcagcctcctgagtagctgggattacaggtgcctgccaccatgcccagctaatttttgtattttcagtagagactggttttcaccgtgttggccaggctgctctcaaattcctgacctcaggtgatccccccacctcagcctcccaaagtgctgggattacaggcatgagccactgcgcctggcctacttttattttttaaatgcaatatgtcatattttaaaaagggtatgtgtttcgggtaaagaataatacagaaaatagacacttgtgtatccaccacctagctaaaatatagaggctttaaatttcctctttgacctcttttgattgcatccatctcccttcttcttttggtgtgtatgcagattattccagatttttgctattaccaggaagctacataaagtattcttatacatgtcgcctagtgcatttatgcaagaattttctcctctaaggtatacctaaaagtgaaattttctatatcaaagagtatgtagatccccaactagatattgcctaattgttttctcaaggggtttctcaacttacactcccactagctatttggttgtatttacttttactctcctctcagctgcctaagagttcttcttgttctggatcttctgtgttcctaatactgttcttgattgtttttatgagataaagctgttttctttgttacagtgatacacctgcatgtaaaaatggtcttttttaaagctaagcgttctgacttttatgtattcgccttatccagacagttgaatttctgaatgaaaagctggaaaaaagggaggctcagttattatctcttagtaaggaaaaagcacttctagaagaagcttttgataacctgaaagagtaagtattctgcaaatgtgaataatgttacacattttctggaagcctgtatactttgtacatatttaagaatgtttttgaaattaaaatgttttgtaattttatcattattgaaagttgtatagctttcaattataaccctaaagattacttttctcttttgattgtctttaccctttgccattgaagagagtcattttgcaaaactggaaaactctttcctttcgtttttagtcttttagtattagagatttaaaacgtatttgaagaaaactgtgttaatcaataacacagttgtgctataaggagctgattgggaaaatgtgatacaagaagattcagaattgaaacattgtatttactcttctcttatttttacatgtcagatattggtgacattttctctttctaacagattttctttgaggtgttttaaaataaatttaacaagggaaatttcctttttttttcttaaaagttaataggcctaaaactgttctattttaataaggtatatgtcagagaaaagttatcttccttttgagaattgaactcatgtatacctttgggatatatagacaccatcctcattctcaaatattattttaaatttagtgaaatgttcagagtgaaagaagaaagcagtagcatttcttccttgaaagatgagtttactcaaagaattgcagaagcagaaaagaaagttcaactagcctgcaaagagagagatgctgctaaaaaggtaattgaaatttaaagtaatattaattaaactctatagagatatagatttttgaggagtgcattcatcgtattttgatattggaaaaaagagaagtaaggtgaaaaggatatcatctattaacatttaaattgtagatttttggccacgtgtggtggctcatgtctataatcccagcacactgggaggctgaagtgggcggatcacttgagcccaggagttagagagcagcctgggtaacatggtgagaccctgcctctactaaaaaatacataaagttagctggtcatgctggtgtgcgcctgtggtcacagctactcaggaggccgaagagggtggatcgcttgagcccaggagttcaagaccagcctgggcaacatggcgagacctcatctctacaaaaaatacaaagattagctggccatggtggtacatgcgtgtggtcccaactactcgggaagctgaggtgggaggatcacctgagcctgggaggttgaggctgtggtgagtcgtcattgtaccactactccagcctgggtgacagagtaagaccctgtctcaaaaaataaaaataaaaatgaaaaggaaagttaatttattctcatttatattttcatattaacacttgcttgtatatctgaatttaggttttgaatatcattttcaaagttgttttcttagtcttagttaaccaaggtagtagattaactgaacaaaacttacagattcttattgcaaatgtgattatggacagcttctttggatgggggagaaatgagaactgtacttagagtgaaagtcattctttacggtattcacagatttcttttttattaggaaatcaaaaacataaaagaagaacttgccactagattaaatagtagtgaaactgcagaccttttgaaagagaaagatgagcagatccgagggttaatggaagaaggtgcgtatagtatttggttgactatgaaaaatactgtaagaacaggaaaagtacttgccacataactagctgatgcttcctaattaaaaatactgaaagcaaggagggtttggacgtaaaccatagaaataggtgacagtttatggaagaatgaggaataagatatattgagacagagatacgtgtttctagcttttgttttttggaagtaaaaagaaaagtaagtccctgtaaaatagacagaaatttgtgctgccctaagaaaactttaaacaggtcttaagagcctgtcatttaaaccaagacattcaaagtgtataactctgggatttatgtaatatctgaatacctagcttaagtactgtatgatattgtctttttctgacatttgatagtgaatttttcattgtattaatttttaaattattaagcacttttgtctctgaaaagatttaaaataaacagggttggctgagtgtggtggcttatgactgtaatctcagcacttggggaggcagaggtgggtggatcatttaaggtcaggagttcgagacaagcctggccaacatggtgaaaccccgtctctactaaaaatacaaaaattagccgggtggtggtggtgcgtgcctctaatcccagctactcaggaggctgaggcaggaggattgcttgagcctgggaggtggaggttgcagtgagccaagatcacgccactgtactgcagcctgggcgacagagtgagactttgtatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgaacttaagtaaatttcccagagaaagggtagcgtttgagaacagttggaagcagtcatttcatttgaaagttagctttatccaactttttcatttattcaactaatatttattgaacggttagtatgtcagatactatgtttgatacaataataagtatgacactctgtcctttaggggcttagttcagtgagagggaaatataggaacacagataatgataaaacacaattctaagcactaaaatagaaaaatgaaggaactgttgttataattattttctcaagatgtcttgaagtcattaactgccttgccttacaatatcagagactgaggggaaggctaactgcatggttttcttattttaaaagagttatttgaaatattaatatcgaatgttattattttgtaatttaataattttgtcagagaatgaactgatgtcttcttttgcttaatgaacctttttacagagaaaatagagcaatttcacatgggagtattttatattcacagagtatttacatttcacaaaagggtattatatattgtttccgcgtgccccagaaaaattttttttttttttttgaaacagagtctcactgtgttgtccaggctggagtacagtggcatgatcccggctcactgcaacctccgcctcccaggttcaagcaattctcctgcctcagcctcccgaatagctgagactatagctacctgccaccacgcctagctagtttttgtatttttagtagagatggggtttcaccatgttggccaggctggtcttgaactcctgacctctggtgatccgcctgcttcccaaaagtgctgggattacaggcgtgagccactgcacccggccagtatttttaaaacttaaagctaaagagctgtaaaactcaaagctgaaagcacactacaatgaatacctgattacttcatcacctagattcatcaggtgttaacatcttgccacaactcttccatatctttctgcacatacatacactacccttttgtcaactcatttgaaaggaggttacaaataccgtaacattctgctcctaaattcttcagtctacatctcccaagggcaagtacgttttccttgacaggtacatcatagtcaaacctaagaaatcagcattaattcagaagtgtaatccagcatatattttaatattaatcctagttgtctctaaaagtgtctgttataattgatcatttgttctgccccaggatccaaagtttgcccattgcatttgattgttatgtccttttagtcttccatcagtctaggacagttctctcttctttatgtctttgaggactctgtagagtctagggcagttgtcccacaggatgtcccacccatgttcgggaatttgttactttcttcatgatgagatttaaattagatttagttcatatttctagtaggaaatatctgggtgatattgaacaactatatcacatcagcagacacatattgtcaggctgtactacaattggtgatgccaaaactgaatgcttagttaaggagttgactgccagatttttctctttaaaattagtaggtgatatatgagagtgattctttaagaccgtgtcaatatccagttcccaacaaccttttacccaataattttaacattcattgatgattgctgtccaaattagttgtaacattgtgggttacaaaattgtaatttaaaaaaattctgttcttttatgttactattagataaaacattctattgagatttttagggaatagttatcatttgagtttatacttctttaccatcaccaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtgaatagcaatcataattctctacatatatattgttattacttcctgtatgaacagttggccatggttatggagcatttgaaaagatttaatggggtatatcatgtaagaaggatttttcaaacaatagataaatgataagattttttagccgagtggggtggctcacgcctgtaatcccaacactttcggaggctgcgacaggcagatcacttgaggccaggagtttgagatcagcccggtcaacaaggcgaaaccctgtctctgctaaaaatactgcaccaacctaatacaaaaattagccgggcgtggtggtgcacatctgtagtcccagctacttgggaggctaaggcacgaaaattgcctgaagctgggaggcagaggttgcagtgagccagaacattccaccctgggcaatagagcgagactttgtctcaaaaaaatatatatttttctccattattatagattcctggaatacagttatttaccatggtattatttcttgaaaaatacttttgtctgtttttataacatataggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaagtaagaaaatgaacaaatatgcaacccatttagaatgaattatcagagtaggatgttgaagaaatactttttctattatctgatcactggcaacatttataaactcaatctaattttttaagagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtaagcaatggatgatgaattagagtagttttaaaaatatttgtttatgcttctacaaattaaacaattagctggtttgaatcaaacaatgtagtgatacatgtgttagatttcagagtactggattctgctaaatttaaccagttgtgttttttaaaactgttaaagtaatgcttacgtgataccagtattgtttaatttttttgagttttagacccatttgagagtattataaaagctaggaaccctcttagaagagaagagcaaaaatgcacatacatattgcatataattttgagagactccatttaactcctgagctcattcataacatctgtgggagtccaaggacctcagatgaagtaggaaaaacaaaatttgtgaggctttgtcttatcaaatcatcagttgatgggcatatgggttatttatactttgtggttattatcaataatgctgctttaaatatccatgcacaaatttttgtgtgaacatatattttaaattctcctagatatatatccttaggtcatatggtaactctatatatttaactttttgaggaactggcaaacttttccacagtggctgcattactttacattcccaccagcaataggtgagggtttcagtttctccacatccttgccaagatttattattgtctgtttttaaaagtatagcctttttagtgtgtgtgaagtggtaactgagtatggtgttgatttgcatttttttttttcaatttatatatattttttgagacagagtctcactcttgccagactggagcacagtggcacgatctcagctcactgcaacctctgcctcccggattcaagcaattcttctgcctcagcctcctgagtagctgggactacaggcaggtgctaccatgcctggctaattttctttttttgtgagacagagtttcgctcttgttgcccaggctggagtgcaatagcgcaatctcggctcattgcaacctccacctcccaggtgcaagtgattctcctgcttcagcctcccgagtagctgggattacaggtgcccaccaccatgcccggctaatttttgtttttttttagtagagacgaggcttcaccatgttggccaggctggtgttgaactcctgacctctggtgatccacccgcctccgcctcccaaagtgcttggattacaggcatgagccaccatgcccggccaccctgctaatttttttttgtatttttagtagacacggggtttcagcgtgttagccaggatggtctcaatctcctgacctcgtgatccgcctgccttggcctcccaaagtgcggggattacaggcgtgagccactacgcccggctgatttgcattctcttaatgactaatgatgttggatgtcttttcatttgcttattggccatttatgtatcttcttgggagaaattaattaaaatattcaaatcctttgcacatttttaaattgggcggtttgtctttttattgttattatgagttctttgtataatctgcatactagacctttatcagatataggatttgtcaatattttgtgcctctctgtgggttgtctttctttttcttgatagtgtcctttgatgccaaaaggttttaattttaacaaagtctagcttatctatgttttcttttgttatttgtgcttttggcatcatatttaagaaaccattgcttaatccaagtttatgcagatcttcatcagttttcttctaagagttttgtagtcttagctctcacatttaggtcttttgcatgtggatatccagttgttgcaggaccagttgttgagaaaactatttttattgactcctatgcccttttgatttaattttaagttttgtatgtgtaaaacatttacatgattccaaagtgagagcaaaatctattcagacatttacttccaatttagctgctccccatttcctctctttgcctgtaggtaaccattttattagagtttggcttatcttttcagtgtttctattggcaaaatgcaagaaaatatatgtatctatatacttacatgttctgcgtacatacacattcgcttatacacctatttctgtctcctacatcctttttacataaatgacagtttattattcacactgttttataacttgttttattttcttagtaaaatatcctgatgatcactctagtaaaacatagaggtttttaaaaaatatctttttacagttttataatacttcattaggtgaaggattttcagctctttcttattgatagattatacacctatttctatctcctacatcctttttacgtaaatgatagtttattgtttatactgttttataacttgttttatttacttagtaaaatatcctgatgatcactctagtaaaacatagaggtttttaaaaaatatctctttacagttttataatactttattaggtgaagtattttcagctatttcttattgatggatatttgggttattttcagtattttgctattataagtcatgccatggtccatatatcctttgtgtttctgctgggatagataaaatatcagtaatttaaatttaaaatacgttagaataataataatacagaaaaattgggggaatgggagatagagcatatatgagttaccatgcataaatccatcactttttccaagtactgtcagttttgtgtgttagtgtttcattctattcccatatatgtgtttttcataattgatgtcttacgtgttattttatagtttttccatttaatagtatattagaaattttttttacatgttttatacatttattgtaatttttaatggttatattcatgttgtatcgacatttgcaactatagattactagtgatggagatttagaatatttccagttttgtttttgctagcctatttaatactgtagggaatatccctgtgtatttacgtatctgctttcttagagtgaattcccaagactaggatggcccggtgaaaggatgtgagaagtttgatgattctttaaacatattataatgttttccaaaaaggctatggtagtttataatgtatgctcctgcatatgagtggagcccccagcttttataatccgtatagcacctatcactttctgtgtgatgtggcaaatatttatagacgcactgtcttttctccaatattgtatggtaatggctatgccttatacatatttgtttgcgtttctttgccttaacagaatgcttttctaagtaaacattgaatatacatacagttttggaattgcttgatgaatgagagatgtgataatcatatgtaaaagttcattggagagtatgaaatagtatacatgaacaatgttgacacaacacaaaatatgtagttagtgggaagttatagataatactgtaccattgtttgtgaatgtattgtttctcctcctacaggtgggggaccttaggcttgcattgcagcgtacagaacaagcggctgccagaaaggaggattatttacgccatgagatcggtgaacttcagcaggtactgtcacaggtttccaaaacacaaatccaagaagtatgtgtttttctagaaataaaagaattcctcagtgggatagtgttcatggaattgagaggattactgtcacacctagcatttgctgaatttttgtggcttgtgtgaataaatcagagtgggcaccttaaaaattatacaaggaaattccttattttgttttatagaaaataatgttatgatagatttgttatatgtattcagtattgcttttccatttgtaatcgcttattaatgattgtcagtctttgattactgtgggacaggtaatagttcccggtttctatgcctctgttaattttcagtcatttataacatgcagaggaaaagggagagaaaatacaatttaggttgatttttcagtttttataaatacttagaaatatttggatgaggaggtaactactaagaggtttggatgaactcttttttaaccttcaggtaattgaagactatcttagaaacgctttttaaagaagcacttatttatttatttatttaatttctttattttgagacagagtcttgctctgttgcccaggcaggagtgcagtggcacaatcttggctcactgcaccctctgcctcctgggttcaagcgattctcctgcctcagcctcccaagtagctgggattacaggcgtgcaccaccatgcccagctaatttttgtatttttagtagagatgaggtttcaccatgttggccaggctggtcttgaactcctgacttcaggtgatccacccacctcagcctcccaaagtgctgggattacacacatgagccaccgtgcctggccaaagaagtacttatttagatactgtattacacaatctaactctcttggaaggattgaacagttagaaaaataattaagggctgggcatggtggttcatgcctataatcccaatgctttgggaggctgaggcagtcagattgcctgctcaggagttcgaggccagcccgagcaacatgatgaaacctcgtctctacaaaaaaatacaaaaattagccaggtgtggtggcgtgtacctgtagtcccagctgggaggatcgcttgagcctaggaggttgaggctacagtgagccacgattgtgccactgcactccagcctgggtgacagagcgggaccccgtttctaaaattaataataataattaaaaagcaaattattttctcttggaaaaataattttccaggaacctctcaaagttcaggtttgctagtgtttttaatgtttttattgctgtcattggtaatgacttcagaatttcatgattcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtaactgctttagtttttatgctcgatgcagaagctcttccatcttgtttatagaattagaataatggtatgaaattgaaattcatttgatctgatagttacattttgtgtctaatatgtagatttttacattttctctttttctacatgtatttttaatacctttattatgtctctttcaaaccattttttcccattacacaatggtatcagatactggctaaagtacttccatgtcattctttcattcagttcttttttttttttttttttgagatggagtctcactctttcactgaggctggagtgcagtggcgcgatctcggctcactgcaagctccgcctcccaggttcacacaattctcctgcctcagcctcctgagtagctgggattacaggcgtctgccaccatgcctggctaattttttgtatttttagtagactgctgcactcgatttttttttcttgtccattgctaaatctgacccctttgtagcttgtctgcagtagtgtaggaggtagagatcatatatgattctcatcactggtagaattccaagagcgaaaataggtctaaggagagtcaagatcgaccttagaagagacatactagggagtcttaagattccatattctggcagggcgcggtggctcacacctgtaatcctagcactttgggaggcctaggcgggtggatcacttgacgccaggagttcaagaccagcctggccaacatgatgagacccccgtctctaccaaaaatacaaaaatcagctgggtgtcatggcgcatgcctgtaatcccagctatttgggaggctgaggcaaagaatcccttgaacctgggaagcagaggctgcagtgagctgagattgcgctacagcactccagcctgggtgacagagcgagactgcatctcaaaaaaaaaaaaaaaagattccatattctgcttctttacagtcatgccccaggttgcccttctgtgatgttaataaaaagaaaagtattattctaaaatgtttcccttcaagcacagacagctagtgtatgtatattataggtatcccagaagctagcaaattcatgaaaaattcatgtatgccttctacgcctgacactaaatgtaatttgagaaatcacagtgtagtgataaaatcagacctaaatatgagtcaggagacatggactcagggtattctgttttgaatcatccagcaaaacagtgtggaacaagtcacttatattgttccaactatctctgtgctattccttgtgaatcgggggggtgaactagattagtgactttcaaatagtattcagtggactcttagatacctttggggctgctgtcatggtgagagggaagcttgataaataagaggctgggcttctctagctgctttaatgaaaatagggcctcctttgtctatctttttttaattggagttccatgaaagatttggtctagaaaaagattcatttacttaaaaaaatgaactgaattagataaaccttcatatatatttaaatttataggtataaatgttaggtctgtcgtttatctctgacagcttttgagagcaatgtgctgtgaaatatgagacatctgaaaatgatatcttttgaaataaatatttagcaataaatgaatgctagaaactggtacttttgtggtttttagactgaagtctacataccctcagcaatatgtggtattgtgctagcatataggcaaagccacaggacaaacataccaaggaatgctattaaaaagaccatagctatgctgtggagcagagtgtaaaatgtgaaatagaggtattactagctctactttggtggagaaaaaatacaagaattcttacctaggttaaatctcagaatcttacccattgctctttttttcaattgaaaatttttattgatataatgtagattcatgtgcagttataagaaataatatagaaaggtcctttgtacacattgcctaatatctccaagtattaaaatcttacaaaattaatgtataatatcacaaccatggtattgacattgatacaatctactgattttattcagatttccaaagttttattggtactcatttgtgtatgtgtgtgtgtgtgtgtgtattaagttctaaacaactataccacatatccattaccatagtcaagatattgaacagttccaacactattgagtccttcctgttagctttttttctttttttcttagctgaaaataatcactcttaatgttacccttttggaaacacacctaccactctctcaacccttcctcccttgtcccaaatctctggcaatcactaatctgtcctctgtttctaaaattctgtcatttcaaaaatgttacataaataaaattatacagtgtatgacattttgggtttggcttttttcactcagtgtaattcccaggaagaggttcacacagttgtttttgtatcggtagtttagtctttttattgctgagtgttattccatagtatgtaccatgtatatttaaccattcactgcacaagggacgtccaggctgattccaagctctggctattacagataaagctactgtgaatattcatgtacaggttttagtgtgaacctaagttttcatttctctagataaatgcccaagtgtgcaattgccaggtcatgtttagtgtttttaagaaaatgccaaactgtttacaaagtggctgtgtaagagtaatgtggtttcttcacacccttgccaacattttgtgtcgtccctgttttttcttttagttactcagacagcatgtagtgatatctcattatgattttaatttgtattttttccctaatggctaatgttattgaacatcattttatgtccttattttccatttgtacattctctatggtgaaatttctgtctatgtcgtttacccattttctaactagattgttatatattcctgatactaatcctagatatatggtttgcatttatttgctctcactctgtagtttgccttttcatcctcttcacatagatttaaaagttgaaaattttgaagcagtttgtcagtttttctttctatggctcttgctttttgtgtcaaatctgccttgttctagatcctgaagactttctcctctgttttttcctaaaagttttatagtttcatgttttacatataagtctatgatccattttgagttaattttcgtgaatgatgtgatgtgtaggctttttggtttttttgcatatagctgtccagttgctccaggaccatttggtgttggtgatccactactcttttaatgcatgactccattttgaaattaaaatacttttggaaaagagtgataaagcaggtataagttaagattggttcatttgtctcagtagacagtcctgccttaggcaataaatagttatcagttttaagtgtggctacttgcatcattaaatgtttgaaatcagaattgacttggtattttggtctctgggctgtatgtgtatgtgatttttttttctgtcctgtaatcaggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtgagcatggtttctgagtgatatttttggtagttccgtgacatcctaaagcactttttaaaagtatgttgttgggccgggcgccgtggctcacgcctgtaatcccagcacattgggaggccaaggcgggcggatcacttgaggtcaggaggtggagaccagcctggccaacatggcgaaacctactctctcctaaaaataaaattagccaggtgtgatggtgtgcgcctgtaatcccagcagctcggaggctgaggcatgagaatcgcttacacccgggaggcggaagttgcagtgagccaagatcccaccactgcactccagcctgggtgacagagtgagactcggtctcaaaaaaaaaaaataaattaaataagtaaataaacaaagtatgtcgttggcttttagcttcagggtaccaagaactaaatgtaatcacttttagcatttaaagttagggttattagtaataggatattatggccgggtgctgtggctcatgcctgttatccagcactttgggaggctgaggcaggtggatcacctgaggttaggagttcaagaccagcctggccaacatggtgaaaccctgtgtctactaaaaatacaaaaattagccaggcatggtggcagacgcctgtaattccagctactcgggaggctgaggcaggagaattgcttgaacctgggaggcagaggttgcagtgagattgcaccattgcaccccagcccgggcagcagagcgagactccgtctccaaaaaaaaaaaaataaataaagtaataggatattataacaagaagatagtactgggattcattgtcatgtagattgttgagattgtgtggcatgttttgtatttatttttttttccagggaaaggatttgtacctttaatcagattttttaaaggggcctataacaccacaaaatagttttgagactactctttggagttacttttatattacaaggattttagtagtataatttaagtcttttctaaataaatttctgggttcttggaaaccatggggtgtaaaatccatctatctgagattatattaaggcaatggttagtattttttaccctctgttcttccttggaaattttactttttaaaaaaatgtcaagtaaaaatgatttctaaagtaaaatatctgaacttttagaaacattttcatagaactccctaataagctttgtggaatctgagcatattataggatgatggtactcaaaattatttttataaagtctctttttaaatgaaatcttaacccagagcaccaataaataaaatgcacagaagtggagctttttcacttttggtttggtttctgagtgaaactcagatgggatctggaacacactgttggaaaatcactgatgtcaagctggtaataaaaatgatttctcaatatgtagctggagttaataaagtactgagtttttaatagtctatactagcatctttttcattttctgtttttttaaattctgccttgtttaataggtaccaggttgaattggaaaacctaaaagatgaatatgtaagaacacttgaagagacgaggaaagaaaaggtatttctcttcgtgaccactcagctcttagggcatacattagagaatggttggggatggcagcaaattaatgagataacaagatgaaatgggtgatgccactgcttttggaacttggtctttagtaggaaaacaaatatgagtttatactttatgcttctaactttgagattgacttatcatggcatgaattactatcacagaaattgtctaactttatttctctctattagacattgttgaatagtcagttagaaatggaaagaatgaaagttgaacaagaaaggaagaaagccatttttactcaagaaacaataaaagaaaaggtattgaattttgtttttgtttgtttgtggtgtaaccatttagtagatgctgtgattaatcattgctttttaattttagctatgctttataacaagcttgtccaacctgtggccctggttggcatgtggcccaggatgattttgaatgaagcccaacacaaatttgcaaactttcttaaatcatcatgagatttttttcatgatttttttttttttttttagttcatcagctattgttagtatattttatgtgtggcccaagacaattcttgttcttcaaatgaggcccagggaaccaaaagattggacatccctgctttataagtatcatttttttaatgtctaaaatcaacatagtgatgaattctagtattataatcagtgtcctgctcagagtggacccaaagtaattttgagtttatccaaagagatctatgatttctaggacttgaaatataaaacctcttgccctttttaaaaatgaatttaattgtctgtcactgaaaccagtgcacatcatttggtctataggcacttaaggagtaagtctggcttgttttctttctggttaatgagggtaatttttctgaaatgagttttctgaggctgagcatggggactcacatctgtaatcccagcactttgagaggctgaggtaggtggatcacttgaggctaagagttcaagaccagcctggccaacatggcaaaaccccatctctactaaaaatacaaaaattagccgggcatggtggcatgtgcctgtaatcccagctactcgggaggcagaggtgggagaattgcttgaacccgggaggcggaggctgcagtgagccgagatcgcatcactgcattccagcctgggcaacagatcgagactctttctcaaaaaaataaaaaaaaataaataaataaaaatgagttttctgtattgaaagaattaccgtgtacttggagttagcataatatatttaaactaccgataggtaaatttaaattacctattgaatttatttggaattttaagaatacattaaaaataaaatggataagccagaaattttatgatttgtaacactcattagtaattttatgttacagaaataggtttaattgatagtatattgtataatatgaagcttaacagaaacattcttattctattataaaaacccaacaaattacattgttgtaataaatgggttctgtgatgatctaaccaagtctagctacagttttaattagtaaatattgtactttttttttgtttgtttgtttttgagactgagttttactcttattgcccaggctggagtgtagtggtgctatctcagctcaccgccacctccaccgctatctcggctcaccgcaacctcacctcccaggttcaagcgattctgcctcagcctcccgagtagctgggattacaggcatgcgccaccacgcccagctaattttgtatttttagtagagacgaggtttttccatgttagtcaagttggtcttgatctcccaacctcaggtgatccaccctccttggcctcccaaagtgctgggattacaggcataagccaccatgcctggccaaatattgtatttttgacttaagaagccattttatggggaaattagaatgaatcttaaaaaagttttttttcttcttttgattgtattgaattcctttgtagtgtggcttttttaaaagactgaatctttgttctcattaaccctaggaaatgttcttgctttctctgcttatctctttgctctttaatatgaacagaattttttttactccctaaggaacgcaagccattttctgtttctagcactcccaccatgtcacgctcaagttcaataagtggtgttgatatggcaggactacagacatcttttctgtctcaggtgatgttttattttttatatgtgcttagttcttagaataataataaaggaaatatgcaaatggcaatattgtctgtcatcatgaccttgccattctatgggtaattcatctgaatacttgtggaggagtgctaattttagtgagaggaaacacgtgaatgattttctgcctttgagaagacatttaaagcaaaaattgacagaaccatttttgttcgaacctggtaatggaagacaagctatgataactgagtaactgtgtgaactttcttaattaacataggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacaggtattggaaaaattaaatttgctatagaagtaaatgaagttttgaggcctaataaatagcacccttcatttccatctgaattctgagcaaattgagaaacaagatgacatagtggcatgtgaagcccaaaatgtatcacatatatcaatgataaaggctaaaaagagaaattagctaaggataacagccaactgaacctgctaattgccagaattaggcatattcggctgatctgtcacaggaaatgctgggctggagcaggcctcccatgttttacaacctgcctacataagacataagcatctaggagcagagaatccctcctcctttcaagcagctctttcccaacagaataaagggaagtcactgagctgtgaatgcctgttctattcagatttacctcttagataagttgttccagctaccccgggaaggaggggtaaaggggatgagatgtttgaactgtaacaccctgtacatgggaggaaacaacatgagttgttgatggagcatccttccatcttacctttttggcttttaaaaaactttatgcagtcagaaatattgaaatgttttacaggtttgagcatcccagctctgaaatctgaaatgcccccaaatccaaaactttgagtgctgacatgctgctcaaaggaaaagctcaattgagcattttggatttccagatttgggatgctcaaccagtaagtacataatgcaattattccataatctgaaaaaaaaaaaaaaaaaaaagaaatttgaaacattcctggtctcaagcattttgaatcaggatacctcttttcagtgttaaacacaatacactcagaagtaggtaaaaattcaactcccattatatacttttagttatatgaaaatattaaagaacttgaattggcaaaaagtagatcagactaatctgaatcccagatgtttgtatagctggtatgctatacagggacctaattaatttctttggtagtgatgaaagcctctgtcgatacaacctacacaggtggggctacgttaaagtatatttttatttctctgggttcttgtagtaatttagaataactgaaatatatgtcatttccttagattagaaaaatatatggttgaatgttttcaaacaaataattggatttatctctgttgcacagtaaaccttataaacggtatacctctcaggaaagttgggaccgtttttctgccactgtttcctttacttaagaaagagctagctcaaggttatatgttgacatgtctatttcaaaaaaaaaaaaaaaaccacacacacattaaatatttttatattactgggagtattaaaaaagatatgttttgatttaaactattttgtggtaatgcttctcagctagaaattggcaatctagaaaaaactcgatcaataatggctgaagaactagttaaattaacaaatcaaaatgatgaacttgaagagaaggtgaaggagatacccaaacttagaactcagctaagagtaagtattcttcacctaaggatgagtctaagatattttagttcatttactttaaatctcatgtttttaatttatagtatgtgttagtgatttatttgaaaattaaagagtactaatatttgagcaaagaagtttaaaaatgaatcttttatcttgcttgtatctttacatattcaaagtaattttcacaatcatgtttagtcccagtataggaaaagaactagatttcatttggctacacttcatttataacattgaactttgtatgatcttagtaatattttgttgattgttgttatatgtatcatcacaattgtctcatctggatgttagaagacactgttaagccataagtgagaatatgttttcttttgatctttcctgtggtgtgggctaaatgccgggtaatacttataccaccatggaacaaagagactaaattttgtatcaagtgtgcttacattaatgggagagaagtcatatatggggagaattgtagatttagtggagagatagggtaaaattgatagccatctagcttggtttttttctttaattcctttttttgctatttagttcaacatagactgaagtgtgagtttaatttttaaaagagatgagtatatacttttatttaaattgtagtgttttcattgttgactcctatggcaatataaatattaaagatgttctgtgtagttattttaaaaattgtaaacaaatacatttttcaggatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataact

SEQ ID NO: 17407 - DNA, 26486 bp, Human
gcgggcgtcggggccaggctgtactgccccagctcctgcaggggccctccggggtgcttgacgtaaaggtcttgaggaaggacccttgtgcactcctcttcctccatcccaaattgtcagagcagtgaccctgtgaaaaggcaatctaccttaaacacacaggaaaaggacacaagaccgttttgtggccttttgcaaacactgagacagtagtactaattgcaaacttttaatgataactctacatgtcaggtattgtactaagcactccagtcattttggcagaataattggctcttaaaagatctggaaagaggttgttgacctcaaacagcctatttatcccttttactacacaccctatttcttatcagatgcttaattctgtgctggtgagacagatttaatcgaagtgttttctaacctggccagcgccacataatttactcccctccctgcctgggcagggaaaaaatactcttgcattggttatggtgagtttgtaaatttccgtgccgattcccagtagcagtgctttgatctttatgtgtgtccctcagttgaatttcagctgcaagaggaccgggatgacaaacttaatttcacattctttcctgccttttatttccctcccacttttacatgaaatcacaattaaacattgcttaccatatcccacgtactgtactgagtcttctgtgtgattatctatatcctcatggctgaaagaagtagctatgaacggcctgcagatgaggtttatgtctattaagtaatctgctcaaggtcacagtgctgttaattgtggaacccaacacaactctgacatcaaaacgtatggtttttattgctaggcaatacttcttggtcccttttgtaaaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatgtctatctgtggcgtaattgtaatctgaaactttgtgtttagtggcaagaaaagccgtcccacagcattaagagattctttaaaaaattaagacctctgccaggttcggtggctcatgcctgtaatcccagcactttgggaggccgaggtggacggattacttgagctcaggagtttcagaccagcctgtgcaacatggcgaaacccgtctctactaaaaatacaaaaattggctgggtatggtggcatgtacctgtaggcacagctacttgggaggctgaggcaggagaatcacttgagcccaggagggcaaggctgcagtgagctgcagtcacaccactgcactccagcctgggcaacacagtgagactctgtcacaaaaaaagaaaaagaaaaagaaaaaataaccttatttctgagaaaagtgtgtgaaaattcctctcatcaaagtgatttttagattacacctttggaaaggacacataaatattaaatttgcatcagacatataagcatcagaattctgaaagtgtgactttttttctctgttgtatctcatatttcctaatgcaagtgtgatgaaacaacagattgaggaagcttgcagtgttttttttgtaaataccaaatgtagagaagtcaatttctcacataatagaccaatatcctaagttgaaccttggattgctttaggaaaccaaaaacatgtagactgatttatttcatccattgggtgaaataaaaatagaaacgtgcagttcttaactttaaatgaattgtataataggcaagaaaaaatttcaaagcataaacataatcacattgaatattttcctttttatttgagcaggtctggtgtggttaccttttcatttggggataccataatagttgtaggtgtggtttttttcatactgatctttgcagctgaatttactgtgttctgtgcagaatggctgttgatggtgggtgtggggacactggagactgggaaggtcgctggaaccatgtaaagaagttcctcgagcgatctggacccttcacacaccctgatttcgaaccgagcactgaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgtagtgctactgtgagaaattaattttgataggagtataggtgtgcttacttaaattttgaaatttagttggaatgaacatcttagctttgagtataattaattgcatgttaagaattatgtaagtactaaataatagaggcgtagaattttggactgatagtgtctgtcttaaggcaagtgttcacttatatgtcacttttttttattacagggtagggaaaagtatagcacatctttatgtgcttttgtatttataaaaagatagtattttgaaatagaaatattgtgttactcccataaattaacgtgcaaactcttggtttggcccagtgtctcatgtgaataactttctcctttaatgctgggcagaactgaaagcattaaaaataaaaaaaaaaaaaagaaaaagaattgaaagtattaattctgtctttctttagataacacaccatattttcttgtgcttctaaatttttttttttgcctgataatttaagattgttacttctgttaaatgattgtatttctgctgataaggaattttctaagagttttatatgttttcgtgttatctcatgttttgtgagtttcgctcactttattcaaaaggagatgttggccaggtaaggtggctcacgcctgtaatcccagcactttgggaggtcaaggcgggaggatcacttgagcccaagagttccagaccaccctgggcaacatagagagaacccatctctaaaaaaaaaaagaaagaaaaaaagaaaagaaaaaaaaattagctgtgcatgatgatacatgtctttggtttcagctactcaggaggttgaggtgggaggattgcttgactgcacctggaggtggaggctgcagggagctctgatcatgccactgcactccagcctgggtgacacagtgagaccctgtctcaaaaaggaaaaaaaaaagcagctgttactctttccccttccatctgccgcagatggagttttgcttttgttgcccaggctggaatgcaatggtgtgatcttggctcatggtaacctctgcctcccaggatcaagtgattctcctgcctcagcctcccaagtagctgggatgacaggcgcccaccaccacacctggctaattttttatatttttagtagagacagggtttcaccatgttggtcaggctggtctttcctgacctcaggtgatccacccacctcagcctcccaaagtgctgggattacaggtgtgagccacagtgcccagccctgttactctttttaccttattgttttactcctttaaacactttgggcagtgcttgatcctctgttttttaaatttttaaacttttatatttttaggaagtcagttaactgaatttgatgttctctatccctttgcaaaaattaaaaaacaaattagagatagttttccttgttaaaaataccctttaactttcatacaataaaaggcaatttaaaaacattaatggccggacgcggcacctcatgcctgtaatccaagaaactttgggaggctgaggcgggcggatcacttgaggtcaggagttcaaggccagtctggcccacatggtgaaaccctgtatctactaaaaataaaaaattagccaggtgtggtagtgcacacctataatcccagctactcgagaagctgaggcaggagaatcacctgaatctgggaggcggaggttgcagtgagccgagatcccatcagtcactccagcctgtgtgacaagagcgagactccgtctcaaaaaaaagaaaaaaaaaaagaaaaattaacattgaaacttcctgaaatcattagagttttagaattcctggttcaatagaattcacaaatttcaaataattgagcaaatacaaagtctcctctttatcctagtggcattttttcctggaaacatcagaaactattttaaagtttgttgctttatttatagtctttgcggttatcacccagcttttaatatgcctttccattctttacagtctctccagttcttgttagatacatgtaaagttctagtcattggagctggcggcttaggatgtgagctcctgaaaaatctggtaatatatatacatatatatataaatatttttttcttctttgtgataagtaaaccttacttatctgtcatactagggaatttctcgtgattcttaaccttttctcttgagcctttgttagataagtttagcatgccaaattccaaacagtaattaaaatggtagaactttggaactttttaaattctaaagctctcagctataaagttattgataaaatttcatacttcagttttcttctctgatctttaacaaacaacttttggtgcttcctctggcaaaacgctcctaacttcaatgaagtaaataacaaaactggcaattcatattttaatgtatagtttcaaataatttattatttcttttgcttccccaaataacccagctaggtgggtaaggcattaccccattttatatagagggagacattgaggtttagagatgttgactgagttgctgaagtttttgtggattatagcgatttgcctggaattgaatccaggtcatcagttcttagttaagtgttctttttcagtgaaccattaggtcattttatgacctaataagacgattgtggacacctaaggtttgggaaagctaaacctttactgaacttatttgcatatatttagaaataaattaagtatataatttgatttaattaattggtttccttgactttttctaatcacaaagtcgctttctataaattttaatgagtttatgtaacaaatgagtagaggcagaattggtttagagttgtatgctaggcttctcactgctgtgtagaaaagtggaaatgctggaatagactctttagaaaataaagcaggtcacagccagatggaggacccaaataattggccaagggggttaaagtttaaatataaacatagccacattaattttgttaagaaacactaatgtcgcttgagtgaagttgtaaaaacttaaatatacttcactgtatttaatgtcttgctgggttctgtggggattatatgtcatcgtggtctctgtcttcaatcaatctgaagtttcattggggagataaatctcacatgaaataaatagcagtatgcatgatatactctgtggtggaatgccaaaatgacagtaccgtatcaaacataaatactctagcagtgtgagaaccaaagacttagagaaggaaagggtttatggaggatgggcattggtttttgttaggtattataaatgtacaagtttcctaaagcttattaaattttgaagccattatttgcaaatgtgacatttactaattttaagtgtaaaataattgaagattagatctgaagattagtcaccaagcaactttaaggagtgacctcttctttattgcattatagtaatcttttacacaaaagaagaaaactaagggttttcaattttactccttgttttgcttatttaattcattgtaagccccctaaaggctcattctaacaaaaaagaatatgatactagactgggcatggtggctcacacctgtaatcccagcactttgggaggccgaggcaggcggatcacaaggtcaggagatcgagactatcctgactaacacagtgaaaccccgtctctactaaaaaatacagaaaacaaaaaattagccgggcgtggtggcaggtgcctgtagtcccagctactcgggaggctgaggcgagagagtggcgtgaacccgggaggcagagcttgcagtgagccgagatcacaccactgcactccagcctgggcaacagagcgagactccgtctcaaaaaaaaaaaaaaaaagatactaatattactgattgagcaaatatttattgagcctccatcccatatgccaagcaccattttagatgctgaagatacagcattgaacaaatacagaaaggtgtttgcattggtgggactcacattttagttgaatgaaaaagtaagtatatagtatgtcaaatggtgtgaagggaaaaggtttacaaaaaggtgctattgagtacaaaggtgagcaaatgagccatacagttatctgtaggaagaatattctagttagagagaataacaggtacaaagctgtgaagtggagcactcctgtttgttcaaggactgcaaggaggctatcatcgctagagcagaagtgggttgggggagcatttttggagaccatatcagacagataatgggagatggaggggcttggagtggatatcacaaaagactttggaggttactgtaagtgctgtcgcttttactctgagtcatgaagtcattggagagatttatgcaatgagagacttgattggcttttcacctaggttactgaggctgatgcattgagaatagactaagggaagagcagagagggggaagaaacagagagactaattagattattatagtcctctagacaagagacaacgtgacttgaaacaggatggtagcattggatgtggtgacaggtggtcagattatggatatattttgaagatggaatcaacaggattagctgatggattggtggtgtgctgtgagagaaaggaatcgaggatgatacaacaaggtttttgctctaggggcgggcacctggaaagatggagttactgcaatgaggaagttactgcaatgaggaagatctggaaaagaacagatttggttgttgtgagcaagggtgatcaagtttggttttggaaactgttaagtctgagatgtctgctagatggtctatatcttacaagatggtctgagatcaccagaacaaagcacaaggctactccgaattctggccagtaaagtaggaagaaaactgaatgaactggaaaccaatttttaaaaagtgtttaaattctcatgagtgtggtgaccaactgaagaacatgttttagggtggaggaagtgacccacccagcctaatacctcagaaaggtaaggtcagatagattgagaattggtcattggagttagcaacacggaggttattggtgaacttgacaagtacagtttctgtggagtttgagaacagtcaggactttgaaagcacaaatatggataagtcttgaagatctcttggtatatagggggacagaaaaatgaggaaattattgtcaagttatttgatcatcgaagtaaactgaccaagaccagaaaagttagttattgagacttatttttttcagttttttgcatctgctgctaaatttgaatgtggttgtactgttcagaatgcatggcattattatggaaacctaacaggttttttgttttttgcctttccctgctttttaaattgcatgctcttgattcaatatcttttaagatactccttttacaaatacagcctacccatgtgtgtgtttttataatatatgtcttataatagttaccatttctgaattgtggcatgcttaatattaagtaaactaaaataaagcttgtagaattgcttttaacaatattttgaaaaaataatagcaagcatagtaaaattaaagtatccatcaatagcagcaaagcaacaaattttacaaatgtgtttatggaattatatatatatgtaaaatagtttcaatccgtagaaattttgagttgttctcttttggttatagattatttgaaactgagtgattgtacacttttgacctgttcaagaactctgaattttatataccttgcaagagtctttcagccattgaatacaaattacacagaatttattactgagaatttgtagacttaagactacattgaaaacaaatgttacgtttttaaatgtgaggaaacttctgcttaattggattgtttttattcccacaggccttgtctggttttagacagattcatgttatagatatggacactatagatgtttccaatctaaataggcagtttttatttaggtaagttttaatatcttagcggttttctttttttaagctctgataatcatttgaacttgtacattgcagtttaataatttttaaaaatgacttgagaggataatactaattttattttaaaaaacaaaaactaccattcccattgtaggtaaagttttgtaagaaaattttgggcatcttggtgatagtagttatgtaaacaaatacatgtttttgttttttcgaagaagtctccttccaaaggtttatgtgatttttgggaatatcctcaggttaactgtgctctgaagaaaggaaagaacggtagctcttcctccagttgatgtcagaagagaatactcgctggagtattaggccctagtgagagattggcagggatttgtgagccaaggtttgaatggtgactggagcaataaagttgggaaagagtttgagcttttcctacaaggggaaagaaaatggaaagtcgaggagagaaaaaccagaaccaattggaatggaacaaagagggatggttaccttaggcatatatggaatatagagaacatcaaggagtgatttgttaaagatgagtttaagaagagaagtagaggccaggcatggtggcttacacctgtaatcccaacactgggaggctgaggtgagaagattgcttgagcccaggagatccagaccagcctgggcaacaaagggagatttcgtctctacaaaaaaattaaaaaattagccgggtgtgcacctgtggtccctgctgcatgggaagctgaggtaggaggatcgtttgagctcaggatctggaggctgcagtgaactgtgttcatgccactgtactccagcctgggcaacagagcgagaccctgtctcaaaaacaaaaacaaaacaacccaaaaaacaaaaactgaagtagaccatgtatccagacatgaagaaatgttcattcatgaatttagtatgtaatattgaggggtttgagtagtttaggtaaaagtgtatatttgttagtcaaagatacacagagataaggactttttttttctctctctatttaggaagtttgcatctgttactgacagtgctcaaattgttctgggtatataggataaagttgagctagcaaaaaaggtaacattaagtttttggataggcataaaacctctacattatctttgtggaagatcttaatgggactgaagtatggattaaaataagttaatgaagtgttgtaattgcagtgtgacccttaatgtttaacttttaagctttattttttgtttattttttaacctttgaaatttcccttctctatagcaaagtttgtgggctctgtccagcttgtcaaattttgagttgtgaattctctgaaaaagataccactgaattgatttgttattgatacaggccataccctttaatttgtggctaaaatggttgaagatggtaataacgatatgtagcaagtacttctaaactatccatattattccatttaatctcagcaacctcagggtaggttcttgtgttcaaggttaaataatttgggcagagtgtcctgcaaggatgatgtgtgtgaaaggccattttattgaggtggagcaatctgattgtttcatcctggaatggtaaattaacaaacagttcccagaaaccatctaggagttcttttgtttgggccgtgccataaaagcacatagaatatattacttaaaataatcttagaagtctactttatcccttttacaaaccaaaagagctttctgtgtgtggagccattgaatgcaatactgaaattaagttctttgatttataacagggccttttttatgtaagttagtacaaagtgaagataaaacatttaccaaaagttttgaatcaaaaaagaacagtgctttattggagagaaaaaaaattggcctggcatggtggctcatgcctgtaatcacagcacattgggaggctaaggtgggcggatcacttgaggtcagaagttcgagaccagcccggccaacacggtgaaaccctgtgtctactaaaaatacaaaaattagccaggcgtagtgactcatgcccgtagtcccagcactctggaggctgagacaggagaattgtttgaatctgggaggcagaggttatagtgagccgagattgtgccactgcactccagcgtgggtgacagagcgagactctgtctcaaacaaacaaaaaaaaagaaaagaaaaattgacatgctaaagtgtttttctttgaaatttcagatttttttctaataagcacacgatttattattttcatttattttaaaagtatttactgtgtgctaggtaggaaggaatatgaagagagtaagaacatggtcactttcatccaaataatagtctagtgggtatgatagacgtgtatgtagcaaatatgttacgaaaaaagtaataatgttcttattatatacatggagtgatttctctgaggagaatatggaaatattaggaaagaaaataccatttgtatagaacttagaggaggaaattcatatcctttcctatctatatgtgtggttattgttttaagagtgaccttttgaggccttatatattcagcttctgtgatgtaatagtaacatttgcaattttagctgacacttttggtattattctttctttaaaaacttggtgccgggcatggtggctcatgcctgtaatcccagcattttgggaggctgaggcgggcagatcacctgaggtcaggagttcgagaccagcctgaccaacatggcaaaactaaaaatacaaaaactagctggttgtggtggcaggcacctgtaatctcacctccctagagactgaggcatgagaattgcttgaacctgggaggcggaggttgcagtgagccgagatcgcaccactgcactccagcctgggtgacagagtgagtgagactccgtctcaaaaagaaaaaagaaaaaaacgtggttacagcctcttttttttttttttttccattttatatacggtccagtgaaattttttttttctttttttttctttttcatgcagcttcttaggggacacaaaatttgctgcttaatcagcacacacaggaagaaggggttaaatgaaggttcttgcatcccaaggatgaatcttattgtgtatatttcagccaagacctgtggagtaacaccataaggttctgagctctaagagtgggataattttttacagtggaaagtggccaggaatcatagcattattatgctttatctgggaggaagaacactgttcagattttctcttaattaaagcaatacttaattagacttatgttaatttggaccattagcaagggttgacatttaaggttaaatgaccgtttaccaaaagttattactgaaatcaaaatacttaggcaaaaatattccttctaaatttcctataagtaaacttactgtgaatttacttttatgtttgaaaataagttatgtagatcatatagatttataatatgaattataatttaaatatttttcctgtaggcctaaagatattggaagacctaaggctgaagttgctgcagaatttctaaatgacagagttcctaattgcaatgtagttccgtatccttttgacaaaaagaaaattacttaatttttaaaagcttttttcctttattataagagatatttaacagagaatacagataagcaagagggaaaaaaagtcagcagtagtaactttattactgagataactgctggtaacattttgctatctattcttccagtcttttctgtatggttatataaatattttttgggccctgatttttaacttaagtttataaagcctgtttcatcatctactttattttgcattattgcccttaatttcagtatcaattacatatctcctttactagagtgtaaattcctaggctggatccaattaatctttgtttctttatagtagcagacagagtagacagtcaatatagtattagccaaatggaaggtacatcacagtaaatttatttttacaagaaatatgtttttaaaaaggagtatttacactgtagtttgaatttagatctggagaacttttggcattttatagaaagtcagaagatgtgatttctatgtagaaagtcccacagaatacaaaatcaacataccggtgaacttgtgaaagttaatgtaaaatacaatgccatttacaactgcttagaaagaaaaataaatacttagatgtaaactacaagataagtaagagatttatatagtgaaaaactacaaaatgctgatgaaagaaaccaaagaaaatctaaataaatggagagatagtccatcttcaaagattggaagattaaatatagtaaagatgtcatttctccctaaatttgtatacatatataccatagtttctattaaaatcccagcaaaattgtcgatatagacgatcttctaaaattttatatagaaaagcaaaggaatacctactacaaatctgaaaaagaaagtgggaggaatcactatccaaattctagacttatatagctatagtaatccagactcagtggcgttaccagagggatatatagatgactagaacagaatagggaagccagaaatagccccatataagtatggccaatttgtttttgataaaggtgcaaaacagttccaatggaagaagcatagtcttcaacaaatcgtactggagcaatttcatatccatagttaaaagatgaattttgacctaaacatacaaaattaactcaaaatggattataggtgtaaatataaaatataaaatgagccaggcgtggtggctcatgcctgtaatcccagcactttgggaggccgaggtgggtggatcacttgaggtcaggagttcgagaccagcctggccaacatggtgaaaccccgtctctactaagaatacaaaaattagccgggcacagtggctcccagctactcaggaggctgaggtgggagaatcgcttgaccctaggaggctgaggttgcagtgagctgaaattgcgctactgcaccccagcctgggcgacagagcaaggctccatctcaaaaaaacaaaaaaaaaacacaaaaaaccataaaacgatagaactttagggtttggtggagagtgcttaggccacgtcaaaagcaagacctgtaaaaggtggggtatggtggtgcagatcactgaggaagcagtgagcttttatcataccactacagagtcctggctgcttgggaggctaaggtgggaggattgcttgagactaggagtttgaagctatagtaggctgtggtcatactgtgaatagccactgcattccagcctgggcaatgtagtgagacatcatctctaaaaaattaaaataattttttgtaaaagcatgagccataaaaggaaaaaattgatacactgaacttcatcaaaattaaaaacttgctgtgtgaaagaccctcttaaacggatgaagaaaagccacagactggagaaaatacttgtaaagcatctgatggaggactcatatctagagtatataatgaactctaaaaactcaacagtaaaacaaaaaaaaattcaattagaaaatagacaaaagataggaagagatattttactaaaaaggatgacgaaaagcacatgaaaagatgtttcacatcaaactaagaccaccatgagcgatactgttacacaactattagactaaaaaaaaaaagccagtctcaaaaggtcatatactgcatgattctgtttatataatactcttgaaattacagaattatagagatggctgggtgtggtggttcaggcctgtaattccagcactttgggaggctgaggcgggaagatcacttgagcctggttgtttgagaacagcctaggcaacaaatgagaccctatttctgtaaaaactagaaaaattacccgggcatggtggcacatgcctgtagtcccagctatgtgggaggctgaggcaggaagatcagttaagcccaggatgtggaggctgcagagagatctttattgtggtcgaatagttatgtgtgttgcctggggtggtggttacacaaatctatgtgtgtttaaatgacagaattataaacacacattgtaccaatgttctgttcatggttttggtactgtactatagtaagatgtaactgggaaaggtgcatggtacctacctatactatctgtgcaacttactgcgaatctatattatttcaaaataaagagcttaaaaatgcaaatacaggcccctgtagggaaaaaggaagagttggtgggggtgggttggttagtggggggcactcagtttgtctatccccattatgtgggtctgggaaactttgggtattttctagaaatccagattagatttcttagtctggctcttggttccctgattgccattcctccactgtttgctttgtttcttttttgacctctttctagctgtagcttcgttctcctgcttgcctagcattcaaagggaatagaggtctgaatgactgagggctagaattgaaattattgttcatagctttatttgtaggcaagaattaaaaatctagaggaagcatgtattgtcccttttttctatgtattgtcccttttttctctgtattgcttttaaaaaatttatagtggactatttatcttaactttagagaagctgcataatttataaattattaaacaattgctccattcattagaaaaattaaaacaagtttttgcacacatgtgctattaaaacattaagtgctatattgactcacccacaatcagttttgaatggagtttcctttttagcctccagggatgggaagactggtaataggatttggtagggtaacttgaaaactgagttaaatgagaaaggtagaaaaaattcgtactttttctcctccccacaaaaaataaaaacagtaaaatctttaccaactgaaaaagctgttgaaattttctgtatgttaaaaaaatgagctttgcagtaactcttaaaatcacctagcaaaataggaactataatgtgcatctttccttcactaaaacatttattgcatctcttcttgatgctgatgattgaggacacacattctgctttcctggggcttatggttttatataaaaaccaaagcaaagtagaaagtatacctcctaccaagggcataaatataatgatataggggttcaggaatgagaaaaagtaagtagttaggggaggaatggcagaaaagttttgtcagaaaggagagttgtgttcatttagtcagattccttgaattccactgatgtgaacattgattacttatttcttgttgtaaatatatgcagagtgtgttccttatggcattgtcaaattcattttagaaattaaaacttagctgcttaagttcctttacttgtattcagacatttcaacaagattcaagattttaacgacactttctatcgacgtaagttttttacttgaaattaatgctcactagattcttagaattttttagttggtagctattcaaatattgctagctatttcaaggctatttcttcacttgctttcctctctcactgttggcttttcagtaatgttgctgatagactgaaaagagaatgctagttttagctgacatgaccagctacaagtttctatgcttacctgaatgagagttcactcaaggaattggagctctgagaacgtatgtgggattacagtaaaaagtgcttgtggtttttttgttggtttcttagaacgtgcaaattgttttctgcaagtgctttttttttttaattagtaaactttattttttagggcagttttatgttcacaacaaaattgaacagaaaatttttgaaaacttgggttctcatagagcttcctgttcccacaaacacactaccttcctaatcaacatcttgcaccagagtggtacatttgttgcagttgatgaatctacattgaaagatcatcatgcaactacatatttaaaaactaaagttgcttttttttttttttgtagaatttcatattattgtatgtggactggactctatcatcgccagaagatggataaatggcatgctggtaaagactttagtattgttatagttctctgaagttcttgctgctgtgcttcacatccccaaaattagaattgatatatttttgaaaaatcagagtttaatttttaattaagtatatttacttcattgtttattgccagtcattggttttcaggtgaagacacaaattgttattataatcccttgatttgatacattggtattcaatagcacaaccgactcataggattacttgaaagcatacttcttcttttgaattcttatccccttctcctttaaagcccttcaaattgttttcctagatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggtaatcaaaaaagcacctgcatttcttttatagtatcttggcatggaattagggattaattattaagtctagttaatatttaggattgttaattagaagtggccgtattttaaaaattacactaagaagaaagataaaatatgaaattctgctctatttgaggaaagatatgaaccgagtacattgttttgatactattctgctttcataatttatttgtattttttatttggggagtaggtatcaagtagaattacaaagttgtatattgatgtcaagctgtaatctatgtggttttcacctgtatttatttcagggaaataaagataccagggataagaatgatctttccaaggatggggctttttggtttacatatccactttaaagaacacttgaaattttgaataataaatgtaaacaattttatgagtattcacttgggattcacttaactctgaacttgcttttgttttggtttgctttatacttaaatattaggtaaaaataacaaggtgttcatatttgagaaaatctgttcagtatttttcttctcatagtctaacaaagcttaaattttataccttgtaaatgtagggcaaacctgtctttacaggcaggtcagcctaagtgaagtgactcagttaatctgtattatagtttgagaggcatttttaatggtatacaatattttgagttgaaacaaattgtatgaaattgttaagaactagatcataactggaagttgcattttaaaataattcgtttaaaattcactgaaaaggacaaactgtggttttaggttaattttcccatgtgcaccattgcatctatgcccaggctaccagaacactgtattgagtatgtaaggatgttgcagtggcctaaggagcagccttttggaggtaataaacctaatttaataatctagaattacataaaatacatattttttctatattattcctttggataatttcattaaaaacattgttttgtgattacgtattcctgtcttctctctctctctctctccctttttttttttaaacagaaggggttccattagatggagatgatcctgaacatatacaatggattttccaaaaatccctagagagagcatcacaatataatattaggggtgttacgtataggctcactcaaggtaagtcagcaaattgtcatgaattatgatgttgggatgacttagggctgggatgctttcaggagaataatcgataagtgagtttagacagtaccatccacttgaagttcagtaaaggtaccatgtaattcatactacttattagctagggggaatttaataaaattattgaatcttacttacttaggctataagtcatccaagtcaaactgtccattttatcttccactgaattcatcatctcttagagacagtctatttcacatttggacaggactgttagacaaatattctatatattgaacagaaattgtcttcaggtcagctgcggtggcttatacctgcaatcctagcacttcgggaggccgaggcaggcggatcacctgaggtcaggagttcgagagcagtctgaccaacatggcaacaccctgtctctactaaaaatacaaaattagctgggtgtggtggcacatgcctgtaatcccagctactcaggaagctgaggcaggagaatcacttgaacccaggaggctgaggttgcagtgagcctgagattgcgccactgctttccagcctgggcaacaagagcaaaacttcgtctcaaaatagaaatcgtcttcagtttggtctgactgttgtcccagtactgtatacagtctaattcccttttaagtaatagcttttaacatattgaggacagtgatcacatcctttgcaaatttttatcagtgccataaacctccctagttagttcctttaaccctgtattagttcattttgctttgctataaaggaatatctgaaactgggtaatttattcaggaaagaggtttatttggctcatggttctgcaggctgtgtgagcatggcaaaagcatctgcttggcttctggtgagacctcaggaagcttttactcgtgaaagctaagggggatggcaaggcatgtcatatgacgagagggagcaagagagagaggagggaataccaggcttcttttaataaccagctcttgcgtgaacttaatatcacagggagggcaccaagccatgcatgtgggatctgccctaacggtccaaacacctcccactaggcctcacctccaacactggggatcacatttcagtatgagatttggaggggacagatatccaaactatatccaaccctttgatatgttgtacagcttcaggttctcatgttgtttttctgtaaccatattccagctatccatattggttaactggaatatagttagagaaaacaacttttcctaattgttcaggccaacatgcagcattatgggactggtcttaactttagataatagacttctgataactgatgcagtcttaaaggagagcaggtatttatgttgttgtttttttgtttacattgatgctatactttggattctttgatgttactagccactgaaagctggatgttttgtccacatatgcaattgctaagccacatctgcctattataaacttggcagtttggggagtgtctttttttttttgtttttcttaatatccaagtataggtccttacaaatgtattcttaaaattcaacctgtttttctctctttatatgtattctgccaacttacctggtgtttctagcttcatttcacctgttttgataattatatcctttatttctttttcaaataattgatgaaaatttttaataagactgaactctctgagaacagacatctgaatcatacttctggccaggcccttttaggtttatctcattctgttcatcagaccttcttggtactttgtatttctttatcttgttcacaaggatgtcatgaaaaacctttccagatcctctactgaagcctaggtatgctatcttttgcattttcctgagttgctaagttagtcatagtagccaaatgaggctactccaacatgatttgtctagtaaccagtcatgctcaatcatagtgatcaatgtttccaatctagttatagtttccttttttagaattttgcccaagatcattaccaggttcaccagaatgagctttgtcttctttttgaaaatctgccatttctctcctgtgattatttccttacatttactgatctagtaatgtcattttaaaattccatttatacttactccttgttgccctctgcattctccctacacggacctgctttgtgttccttgaacacaccaagttcttctgtaccttagagctttaatactcccgagttcctacgccggggatggtgtttccttggatcccctcaggctggctcctcatctcttaggtgtctgcttaaccagttttcctaatcattcaacctaaaatgacttctgagccattcaccattctattttttttggtaattgctcagaactgattaatggtagcctcattctcctatgcaaagaatatttcacacttaaactatcttacatccttgccccaggaccaggaccattgccattgctgtttacaaacagctttttcttcaggtaattgcatggctggatctctctcatggcttaggtttcagctcaagttatcacctctccaaggaggccttccctgaccattctctctaatggactgcatccatcattctcagtctaacacatacctcattttcttcatagaacacttcaatatctgaggtgttccaagtatttacttttgtgttatctcccctatcaaaatgaaatcactatacgagcagatactttttttcattgttactatgcacaacacctagaacagtgtctggagcatgtgttacacatatttgctaattgttagaattaacaaacgaattcagtgtgttctaaccagaaactgtaaactccccattttaatatgtagtctcatccatccttctttaccttttaccagggcttggtgtgtactttctaggctggtgaatgagggcctcaacaaggagtacagaaggagaattggaagtgaagttgcacaagccagtggttctatctattctatgatttttccccttgttctcagtataacagaaagttgcctttctgcccactctagctttttttggtcgaagggcaggggtatgggtggcaggggttggagaaagaggggagtcctcatcattttggcaatgttcttactgggcagtgtctcttacacgcttcactgtttgtgtctaccacttcctcctttcagtacatcctgctacatgtggttcagtggagagcttccagtttaaccatcatgcagtttatctctttttaaatttcctcttctccaaaactatagagaatcatatggtcacagtcaactttttaaaaaagctttccagccttcgtaactgtctttctttcatgtcttcttagctacttgctgtttttccttaagtttttgaaacctgactatacttggagtcttgggaacacatcttacagtgtttcctcacactgtgagataaaatggctactttttcttgaagtttttgtcttctaaaatgaacaattcaaatatagttataaaatggagtatttattttgtacttttaaaaaatggtttaaggtgaggctttgtttattcctaatatgtgaataatactgatgtgaaaaatgtgagtcccagcactttgggaggccagggcgggcggatcacgaggtcaggagatcgagaccatcctggctaacacggtgaaaccccatctctactaaaaatacaaaaaattagccaggcgtggtggcgggcccctgtagtcccagctacttgggaggctgaggcaggagaatggcgtgaacccagaaggcggagcttgcagtgagccgagatcagatcacgacactgcactccagcctgggcgacagagcgagactctgtctcaaaaaaaaaaaaaaaaaaaaagaaaaatgtggggttgaagtagagaactgtatttaatattttgtgtagcctcggttgtagagtaaaagataataaagggcagcttttcttttttttgaatgtttgtgaatcaagtgactgaagctgttacaggaataattagataacacttattcttcatggtgtatcagttaatatctgtgttcatatgccaaccccacctcttgctaagtatatagctgtggataaattactaaatttctctcagtctcacttttcttatgtttaaaatcagagtaattaacatgaagatgttgtgaaaattaaataatatttagtctttacattgtgcctggaacataatactctaaattgttaactattatgatgttattgtttcacctttctatagcacttacttgagagagttttctttgctactgtagcttaagattctgaatttactacaaagtgatggggatgtgaaagattgtttcatggttaaatttattttctggcttgaaagtctgaaaaatcaagttttagaaaatggtatttaataatcatgccttctaatttaagagaactcttttattttaaagaaatgaccatattttaattgatatgttttttcaggggtagtaaaaagaatcattcctgcagtagcttccacaaatgcagtcattgcaggtgaggaagaaaaggccatcacttagtttattttgctttctttagtttttgacgttgctgcagcttttttgtgttgtaggaatttgatatcttcttggatgggttgtgtaactaagctgtcgaaaaagaaccagttattagactttgcatattttttgtcttacattatgtcttaagttacctgcagtaaagagatgttttagttccatatgaagcaggccatttattaatctgataaacaagaaaaacatgtagtgttactctattacatgaatcacacaaaacaatgtaaaatttgttactgtctcagtttttaaaaattggaatatgtattttttaatgaagagccaatgtaaatttatctgttctgatttataactgacttttaacatgcctaatttccattgagttaaagcacctgtattttctcctcccttcagctgtgtgtgccactgaggtttttaaaatagccacaaggtaataggtttcatttttaatatgcatgtaaatttatgttttgacttggtttaattatataaagatgaacattttttcattacagtgcatacattcccttgaataattacttggtgtttaatgatgtagatgggctgtatacatacacatttgaagcagaaagaaaggttagtagtattaagaacacatttttgatcatgcatattttgatttttaaatattattggttagaaatttgaacaaagtcacccatacattttctaacttccagaactctacttattatatatcttttgctttatagcctgaaataactctatagcgaagtaatttacaagaaatggtctattatgaaaagcaggctttaaagcataaaaatttttttataggaaatatgcatgattataaaacaacctgatttttattttattgttcataaaagagactaatattggtgcatgtgctgctgtaatttgttgtgtattatgtgtgtaggaaaactgcccagcttgtagccagcttcctcaaaatattcagttttctccatcagctaaactacaggaggttttggattatctaaccaatagtgcttctctgtaagtattgtagatttttgttatgttgtaaaaatcatttttgtgatttttgaaaccttaaaaaaattatcttttgataaaaattatgtttgatacttctctctcatcataatctttaggcaaatgaaatctccagccatcacagccaccctagagggaaaaaatagaacactttacttacaggttatcaatgtgtattttaaatttttttcagaaaattatatcaagttttattttactttaatgtgtcttacattaaagtaattttgttttctagtcggtaacctctattgaagaacgaacaaggccaaatctctccaaaacattgaaaggtattttacataagggtatttactaatcattttctttcttttctctctttttggtgaaagtaatcagtgcttgttctagatttcctcttaatgccttgtatatggtcaggtaataattacttacaactttagacatattaatagaattaattgctcttttagtagaatattttaaaatctctaagaaatcaaatattactttgattaaagaggattggattttgatgtttttctagaccgtaatactctatagtttgtttacatgtgtattatcctttctgttgagttttttttgcttgtattaattatattttttctgttttagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgtacttctttcactgaagtttttaaaagtacattaagggtaatcagtagttccatggtaatataggaataatttttaaatgtgtagcagagttatatcaaatttttattgcacttaatacttttgctacagcaatttctatagtaaaaatttactggtttaatttaactttctgtatcaatataattttttttttttttttttttgcgacagagtttcgctcttgttgcccaggctggagtgcgatgatgcaacctcagctcactgcaacctctgcctccccggttcaggcaattctcctgcctcagcctccggagtaactgggattacaggcgcctgccaccatgcacggctaattttttgtatttttagtagggacggggtttcaccacgttggccaggctggtctcaaactcctgacctcaggtgatccacccccccccgcccccctcggcttcccaaagtgctgggattacaggcatgagccaccatgcctgaccatgtttttgtttcttttaagtgaataaaacttcaaacaaaattaagtacaaatactaaaaaagtaggtgctagtattttaatatgagaacatgtatgtgttctcattctttgtttttgacttagatatggcagttttctgttcaaatgttttttggttacttatgtgtcactgagttaagttttcagtaatctttctagctacatattgacaaataagttttattataaaaccatacggaataaatttataagctctacctgaaaagttacaggtgtagcttacaattttgaaagtgaaggaactaaaatttagcaccatataggtgctataataattctcaaagtagcattgtaagaaggtgactctatctgagagctgaataaatagttttagatggtttaggtaggtcatttcaccaaagctgtacaattagaagtcttggaactgtaactgtacagctaatttcaacccgaatctgccccaaatctcctctgcagactacttagctgtttgaaagtacttgagttacttggtactacttgtgtacatgactaaattgttagttttaacatgcaagtttttactgtagttagataaaattattggaagatgattataacttcttaaggggttcaatctgattttttaaaagaaaaataattcttttttgcagagttccttgcagtggggtaaaatattcaaatatgggaggcaggcatataaggtaaataatcacagcagggagggtgtaataggatgagtgataggggtctgtggcaaactggagtgagtgaaa

SEQ ID NO: 17408 - DNA, 8759 bp, Human
ggagggggaaggtgtaggcagggcagagatttgtagtccagccctcttgccacaaattatgaattagagaggaatgactttgcttttttaatgatctccagagaattttccatcatttccctctcttcacccagctcctttgcaaccactgccagagaagtcttcctttagcttcttaaacatcgatcctaaaacacttccagacacctgtgctgctcctttcagttcccatggagattaggctgtgtaacaatctcgcaaagacgttcccctccgtctcctcatcctcttttcaaacccttttacgatttcccatctcactcagcatgacagtcaaagtccctgtgatggccaacttctgcatcacctagccagtctgccaccgccaaaactctccagcctcatctttctactcttcccctggttccttgcccacgcctttacacttgttctctgcttggaatcttccctcccctccttgaggaactttctcaaatgtcaccttccctcaatactccccctcctccatttaaaactataaacttccaactctctaagcccctaaagtactctatatttaacttattgtataaactactgtccctacttgtaagttccaagattgcagggattcacccgctttgttcactgctgtctgccaaggtctagaacagtgcaagttacccaacaggagttcaataaacagccattcatttaacaaatatttgctgagcacttcgtcccgtccaagtttgttaaatcaagacaaataagacaccgtccctgcctttaacgcaccagatggagaaatgcaccacagacataaatgtgcaatacaggcctgacactacggccacaagcaagtcaaagaacgtgccaaaagttcagaggaagaagcctcggcttcgcctttcgggagaccagtccagctttccaccatcacgctgctcatcagggaccatctccgggggtctcctctagaccccaagggaggagcgggtcccgcccgccattcccaggtctcagagtttacttgtccagagatgcaacttccggcctcttcaggccgggcaagatttaaggaaagaaaagaaacataaggacctccgttcttcggtctccgtcccctccccttcccccgcgtgccgtccccacaacgggccaggactgaacccaactctcgaccaactcccggcagcaaaactaagcaccctacttccgttgtccccacctgttcccggcgtccccttcggctactcccggcgtttgcgcaagcggtcccacgtgggctcgggcggggctagcccgcggcgggggctgggcacgcccctagcgcatagctggcttctgattggctttccggtgctcgcccgagcagggttggggcgagtggaccgcgcctctaaaggcgcttgccagtgcaatctgggcgatcgcttcctggtcctcgcctcctccgctgtctccctggagttcttgcaagtcggccaggatgtctcaggtacagcgcgtgcacagccaggctgcgaaggtgcagcgggcgggaggcccgttgggggctcagccggctgccagcaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgggagcttggaggtcaggggaagtacggggccggctgctcagagtgcgggacgaggagaatcgcggcccggggagaggtgacccaggggcccctcccttctctccagtgtagacccttgtctgagaccgagctatgtggggcgacctctggctcctcccgcctgcctctgccaatccgggcactgggacagaggtcggtgttgaacgcgcgggccccagggggagggaggggaccaacgggctccggcgctgacaccgcggcactcatgccctgtcccctttcagctgtttccagcatactgtgccccgtctgtcctcaggccagggcttcgctgcagccccggccactccctagtgcctggcccggtggtggccaggcagttggccgcgctgcttctcccgcagaggggacccccactgggggcgaaggcttggcctgccctcttcactgctgtatttccagacctgatgcctgcgtttgtgagagctctggatatatggttttcgattgaatgagtgaactggaggggcttccccttcttgtgttgctgaatctttctagctgccctgttggggcagggaggggcagacacacttcaggggctgcattgcccgaagggtgccacctttcccacctctccatccccgtaactgggctgtcatcaggccacagtaggattcttaccctctcccacccagaggaggccctcaatcctctcctctcccttccatttaggctgagtttgagaaagctgcagaggaggttaggcaccttaagaccaagccatcggatgaggagatgctgttcatctatggccactacaaacaagcaactgtgggcgacataaatacaggtatgcagagcgggggttggaagggcatctgctcatcaaagcaggctcagcagcccagactggaagtccctgggaacttcactctcaaactccctgaggccctactcttcaggtggggtatggtgatggttcctgaggtggaaaagaccatgttccggattctcagtgtctccagtagtaacagaattcaaatcctggttttagaaggtctttactggttatcaccagcagctactctctactagggaagaagcaaaggctgcagcttggaaaagacttgctgaaggctctcagctcagtagtatcattgttgagccgttcagcttctgccctagatgggcaggatcaaagttggagcactttttggagcacttgacagcctggccaagcctgatgtcaggagcagagaagcacctggtttcttgggctaggtcagagcatttcgctaacaagtctgtgccttcctgatgataactttttccctgcccagaaatcttggtgcagattttgaggctgtgctttggactgtcatgttctgtaataacatctttcctgccttgggcaggtttcattctgtccctaagtccctgaaacatgggtggatactgaggcaacagcgcagtgcattctgtgcaaggactcagggttatcatggcagcacagaagggaggtctcccctgcccctgctgaggaagaaggcgagcatggtccctatttccgcagtagctggggtggaagatggagcaggtgggctggctgccaaccagctggaagcaggaaatagtacccagaatgacagatcacaggcagtaccatatcaaaccctggggttcacatggagcacttagttgaagaaggtcttatggcgaaggtgagttttacagtgagttcgtaaactctgtccttccagggaggggaaggaaaggtgaagtgggggaggccagaggtgccaagatgcttttctgacaaacagtattttcacagagactggcctgtgcccgtactagagttaccgattttcacatgagtctagatagactggcataggaatctatcacttactgatcaaagaggtgtcatcggctctctctagggctgtactatacagccctattacacgattataaaacatgatagtccaaacacgatagtttagtataatagccagtagccacatatgactatataaattttaactgaggctgggcgctatggctcatgcctgtaatcccagcactttgggaggccgaagcaagcgaatcatgaggtcaggagtttgagaccaacctggctaacgtagtgaaaccccatctctactaaaaatacaaaaattagctgggcatggtggcatatgcctgtagtcccagctacttgggaggctgaggcaggagaatcgcttgaacctgggaggtagaggttgtggtgagccgaggtcgcaccactgcactccagcctgggcaacagaacgagactctgtctctaaaaaaaaaaattttaactgaaaatagttaaataaaatcaagtttagtcttcattcacaggaaccacatttcagatgcccagtagtcatttcaggtacttggtgtggcaagtggctcctgaattggacattgcaaatatacatgtacatttccatttccaccgcttggagagagctgtcgaggagtgctattctaggatcctgatgatgaccacaagggcagtttgtttcagctgtccctgggaacacttccctgaaagcgctcagggacattttctcaggcacagtgctccaggctacggactctgattgttccctgtggctttggggctgggcatcgtagtgaaataggacaacagggagatggtgagtgtgtttcccaactgcagatgacaacaggtctataagcataaagtcatcatataacttaaagaaaccttaccctcggtgaaatctcccacagatcagcaagaaatagactaacaattcggtagaaaaatggggctaggatataaacagttcataggaaaggacacctgatatcattaatgattagggagagaaattgggtagctaacagcaggggtgagagagaaactttatagtattttcctctgtagcttttgaattttaagacatatgaatggatttttttttaattgtaattaaagtataatttttttaaaagagaaattttggagtcatttaacttgtaagacaaaggctatcttgtaataagaatactgttcttcctatttgctctagattttaagtttggattggcatacattggttttcttagggcagaacccactctactagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaaggtaattgttctaatcaatttctctcatttgtgaaacccagtagtgaaagagtcttcattatgaagtgtaagggaagaggagagaaaacaaagtcaatggggcacgtgtgggaaaccagcctgacctgtgccagaatgggaaaaaaccgggccacctactttttctcctaacaccatttatgccttttctaaaagcaccatctctgagcaggagcatcatctagagaggaggggctgggaaccaggccactgaaaaatagtttgggaaatgatgtagttggcgtaggctttggatgtgttcagaataaggggtggtttcctgtctgcaactccctctcccctacaaggccaggcggtgaccccctaaccccagtggccctccccagttccttcctagccagaaggatacataaaagaagggaatgagctaatgcatggcctgccgctggcatcgtaggctcagtgaatggagccattatatgctaagcaccagcagccaagaagtatccaagctcgtacttaatcacgtgccacctgcagcagcaagacccaagagttggcaccaaagctcctggcagcattagtgttcctgctggctagtttctgaataagccctctgtccttctgcgaatgagaaacccttgaattcagaaagggccacaatacaataaacacactcctaggatctgcaagtaactgggaagggaatgcccatctgcctgcccattttcatgggacatttccataccatcctcaggccccatgtactctccagtgcttcagaacaagctctgagttccaaagggtctctatccttcaccatagaatccaggaaactgggtgtcactgtctctgagggatacattcagtgtcctttctactgcagcaagaagacaaagatttgtctcattcccctccaagaagcagccacttttggtcagagttcctgaaacttttctcatagcctctctctggggagaagagggtgcctggctttgctttttcactgccagcttaacagctctgggagataggagcccaaaacagagacactgaaaaggccaaagccaatatcagccacgagagttagcaggaccagtaaagtcaccacgatgacagtttcctacctgtctggagggtggcacctctctcccaaggctcacaatggccattcccccaggacaggtgggggacgcaggtgtccagcagatgggcgacagatcttggccagccccaccaggctttctgagcacagttgcttatggagcattcacttcgggccaggttctgtggatactgtctcctgtaattagtagaatctcaactttattaagtgagaaactgagcctaggagagttacagcagagctgcctggggctctggaggctgcttgtttcctaccatgctacctccctgacacataatcctgtcgattccttacagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataactttagtgatctgagttcttgagatcatttactctgtctgacctcagccttgcttcctttttctaaagacctctggtagtgcttcagctgcatacctggtagagtataaggtgggcagtcctgccctgcaccctggcctaaggtgtgctggccctttgtggggaggaggaggatggtagaagtgacctttctctcttccttcccagttcagccacgccgaggaagatgaggcaggctggctgagaccacagtctgcaagtacttctgacggggacgttcctgccccaggacctgtgtgaggcagggtttacagtgcttgaggtttgtctgaggcccagctggtccctgattccagagtgcatgaaccagagtggaagcccccatcaagaatggagtgtgaacctgacaggaggcgttccccaagtcccaggggaagccacagacagctgtgtgggcaacagtcagtgggcaaggggtgtgtcctctgcagggagcagaaccctgggagcttgcagagaagaaaggctggagcttgactctggaggacgtaggaggtagattgttgaaaagtaataatgaagaaaaggagatagctctctagacccttcttgccagatgttcccttccagctcttgggtttacaatcccgctgccctttgcagtggggatcatacctcaatattgtgtaacggggattactgtgcccattatgtgagtgaggaaattaaggctcagaggtgatttaactggatccaagcccagggctcactggccaggagggccctgtttgtccccctccaccatgttccctctcatggcccctggctgccacttagtctgcacctctgctgtgttgcagtgagtgacatctgtctctctgggctagcataaggtgctggtgtgaaatctgtcccttgggctgtgcagctcactccggaagagtggcttagacaaggaggtcccacttccaaagctggagtgaggcacagatgagagagacttttaggcacctcaggtgactaggtcatagccggtttgggagatgccctccccgctcactagaaagtacttgtactggtttctcagaaagcagtgtttgtgcagttctgagagcaccagcagcctggggctgcacctgctcctgtggctcccacaggagtccttgtaccacccagggctggctcacagggtgtcacttggggacaaattatcagggaaacccacccccaatatttcaacataggctgtttctattttccataagtttcagccggctgagaaataaagagaaagagtacaaagagaggaattttacagctgggccgccaggggtgacgtgacatatcagtaggaccgtgatgcccacctgagcctcaaaccagcaagtttttattaagggtttcaaaaggggagggggtgtaaaacagggagtaggtacaaagatcacatgcttcaaaaggtaaaaagcagaactactaataagggtctaacaaagatgacatgcttctgagggaacaggacaaagggaaaaagcagaactactgataagggtccaacaaagatcacaaggcaaagggcaaaagcagaactaatgataagggtctatgttcactggtgcacatattgtcttgataaacatcttaaacaacagaaaacagggttcaagagcagacaaccagtctgaccacaaatttaccagggcagagtttttccccaccctagtaagcctgagggtactgcaggagaccagggtgtatctcagtccttatctc

SEQ ID NO: 17409 - DNA, 26684 bp, Human; identical to SEQ ID NO: 15109
  misc_feature (1)...(26684): n = A,T,C or G

SEQ ID NO: 17410 - DNA, 26684 bp, Human; identical to SEQ ID NO: 15109
  misc_feature (1)...(26684): n = A,T,C or G

SEQ ID NO: 17411 - DNA, 99580 bp, Human
aaactacaatacccacaatgctttttggagctatttggctctgaaattggaactgggcttatttctaacggggccgaggaaggagaaaagagcaggagtcgtcactcgtgtccagatacggaggcggtgtaccagcaccgcaggtagcaaagcacctagaaacacgttttgttctgctttggaaattagatttttgcctatataacagcagccagaggaatgtaattcatatttgattttatgtcctgaaaaaaaagtcttttgcctttcaaataaaagcagaaagtttacaatagaagtttacgcttgtgaaagagtagctgtcatttcaatgggaattgtttatatatttaaattttacacaaatttattcatctttagtattatcattggcttgttcacaaaagagcaggcaaatgttcttaacttggggcccctgtaaaggctttggaaacgagctggggaacctgaatttgtatacaaaatttggggtgtacacttttctagggggaaactacagctttcatgagtttctccaaggggtcaaggatcctaaaattttttgaagatctgctcattagagctcttgctgcaaaatattgtttaggaaattcgcttggactatcatggctgtgtctctgtgtgtgaaaacagaaaccttaccaagtgattgttctttcttgaagatttttataccatgatcttgaatgctaaaacactcagattcaaggggtattatttgttttcttataaagaaatcagcaggaagctgctaccagacaaacaaacaaaaaaaaaagcaagtcttttcctattttctctaagttgtggtttcaaattgcctgatatggttgctaacccttcttttttgaaaaattttgaatacacagaaaactcagataaaaagagtgtaatgaccaatacctttcatctagatccagtaattaccattttgcacagttgctgtacttcctttttactttatttatacttttaaatggagaacatttgaagttgcttgtgttatgacattttactgccacatactctacatgtgtctcataagaataaggacattcatcctagaacaagttccctaaaaaaaaagaataagggcattctcctaataactgtgatgccattatcacatctgagaaaattaacaatagttatgtaatcaaataagtattccatatccaaactgcttcatagagtcactaacaagaaattgtgtcttcgagagagtcacatgagagctatactggactctgactggaggggaacttgaagtgagcattggagggaggtgatgatgtgggcaagaactctgttaagaactttctgggctatgtaggaaaaccgggctcatctcttcatggtgttctctgttggtttcagtatgctcagtcagtgggtctatttggtcaagcatagagaatctgagtgtttaacctcttctggaaaggacaagcaggtgcaggaagactagaatgacacctatctttcactgcttttctggcctctttgggtttagttgtttcctatagagggctgtatattgaggctgagcattgctggtagttgaatggccatctctgcataatgtagtgtacactggggattaagcagaggtgctcttatcaatggagcaccaaagagggtgctcttatcaatggagcaccaaagaatgcgttgtggtggggtatgaacaggagcagaagcctactcctcaaacatttccagaggaggaaagatagaacacttaaaagtcccttcatgtttttagtgggaaccttccaaggaattccaatctgccaaacagagaaacttcctgctttaggcaccagcagagactgtggcatggcagtcactttctgtattgtgggcccttcttcgtcagtcatgtgagagatactagacaggcccaccgtgatttgctgacctctaggagtgaagtgttgttttattgactatagtattatccttctaccttgttttgtagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcaggtaaagtaaattcaaggtatggaggctttgcctacaagctggattaataaaacataaaaaagtataatacataacttattaacagtagtatttgtttccctttctatagtcataaaataactgcctgaatttatttattaaggatagtaagattgcctgccttggattcaattagtatgatactctagttggacatcttatacggaagtgcctctgtctggcctctttttattgactgagctaggtgatatgggagaagtagtctgctgtttgaatttaagcatttggtagttactggtcatgtttattctttcttcctttaccaaacagaaagagcaattgtactgaaattgaggatgtgttttgattgaattagtctttttctttttaaacactttttaatacttttgggaatttttacaactacttagcatgaaacaagatgcctgccttcctgatgctttttcttgtcagaggaaacagatgacaaatatctaaataattaaacaagataatttaaaaaggtaaaagtgttatgaagaaaataaaacaaagtagagataataaaacagatgggatagacaaaaatggtgtgctactgcacatctctttacatctctgcattcagtgacttcatgcttgggatcggccatggtaggagtatttacaccacagaaacaagccagtgctacaaaccagtgctataaactgggctttcttccctctggacagctagttattaaatgttaaccagcacactactgagtgaaggtcattgactaaaggcgagattctgacatttagtatagagggggtaggaagaaaacaaatggtgactgagcattgctttgtgatagtcattgtgccacatgctcaatttatcttctttatctaatatttataaaaatggtgttagaggcagtattatcctcattttattggtgaaaagaccaaggctcagagaagttgacttgtaaaaggttacataataaactagggtatttgatttgaacccatttctctgactctaaagcccttttttttcctctcataccaagcttctaacatttaattgaatgaatttatagcattcagttaaaatgaggttgactataatactctgcattgtaacactcagaaccaatttcatttcattgatcgtggaaattcagaccctctttcctgcatacttgtcatcaccaggtataggtccttaaaatataaacttctgggtccatagcccatcagaactactaatttgttacctgctggacgggaaaggaaataatctttacattgtttttggtagtggtaggtgttttttttgttgttgttgttttgtttttttcttttttttgtcttaacaggtaagagatggtaaggctaaacttcctaaatcataatgcaggaaatttgtcatgattgtttttaaaatcacatgttcaagtgtctagtgtctattatagttgagtgtttgaagatagtggaaaaatagatgttattcctctaatttcaaacgcttaagatatgttttcagaatctgtttgaagttaactataaagcttgagttcccaaactatttttagtaacaaagacatgagtttgaatatccttttctaggcaaaaagctcatttccaatatactgttacatctcttcttcatatcggaatagtgtagtttatgttacagatttttttcatctgctgagtaaacttgggcatgcttttgactaaaggcatttgaactggctgttaaattcatctctacagttgtcctgccatatccacagggaattggtcccaaaatgtccacggacaccaaaattcatggatgctcctcaagttcggcagtctgccctgaagataggaaaacgtcctatacacacatacaaaaggtcagccgtctgtatctgtgggttccacatcctacaaatgctattatcttccatcccagttggttgaatctgcaggtgcaaaacccgtggatacagaagcccgactgtatttcctttttttctgagacagagtcttgctctgttgcccaggtgggagtgcagtggtgcgacctcagctcaccaccacctccacctcccagattcaagcggttctcctgcctcagtctcccaagtagctgggactacaggtgcacaccaccaatgcctggctaactgtctcactttgttgccgaggctggtctcaaacccttggctcaagtgatcctcctgccttggcttcccaaagtgctgggattacaggtgtgatgcatcacacctgctgtcttttattatataattttcctacctccctgaggtttatctaatattaatacactgtcagagattcctaaaagataattagtgcacccaaataagaaggtatgtaggcctacacaaataaaatggaaatatctaaaatgattagaagagttttgcttcactgtctcttcaatttagatttggaatccattctgagtaccatacatggtcttctgactcaagttggagaagagcattcaagtgtggtgtagattacatagaagtttaatatgcatacatatttttgtatttcttatgtatctcattttagttttctgtttaacatattagcacagataacaaatttgcttgtcttctctcctgtattggaggttgggtgtaatgggtgttgagattttatgaagcttgtcatcctggagggcagtaatgatcttcactgacaattaatgccattcaataataagtcatttgctgactaaaagtcccttaaaaatcttataattattaagcatatagctaaaaaatacttttatttggctaataaatgatctagctcatagtattttttattagttcatgttaaataagaaaatacgcactaatactgggcacagtaacagatgcagaagttccttagacaaataaatcattgtagcacagcgattaagagttacggtcagatggacctgaattctagtgactctaccattttattggtgtgactttggacaggttttttaacctctaagtggtttagttttttcatctgttagatagaaatattccattgttccagctcaggccagaaactctgggccatcattaattcctttctttttctcatatttctcatctagtcagtcagcaaatttgtgtatgtgtatgtctatatttgtgtgtatgtatacacacacacacacacacacacagttagatcacttctcactaccattaataccttgtctgcgttgctataatagcatcttaacagatcttctctatctgccattgctccttctgcatcctatgacagaccaccctcaatatattagagggatcattttaaaatgcaacagaccaagtcactcttctgctctcttgagtgaaaacacttttgtgtagtatttcatggtagagatgtaatgtaatttatgtaaccattcttctattgatagatattttgtttgtttcctaaagttttgctgttataactagtgattcagtgaacatccttatgtatatatctttgtctacatggttaaccatttctgtaggatggagttttagaagtgcaattactgtttgataagttagagtttcctggagaaatagaaccaatagaatatatatagatagacaagaggggatttactatgggaattggctaatgtaattatgggagctgagaagtcccatcatatgctctctgtaagatggagaaccaggaaagctggtggtgtaactcaccctaagtctgaaggcctgagaaccaggggaagtgatagtgtaactctcagtctgaggccaaaggactgagaactggggtgtgggaggccactggtatgagtcctggagtttgaaggcctgaggatcaggatctccagtatccaagggcaggagaagatgcatgtcctagttcaagagagaatgaattctccttctgccttttttttttcatttgcaggattaatagagtgaaaacagagcccccatacaacgggaggggacccaaagggggttgctgctccctgctcgaatgcctgagtttatatcctgatcattgtccctccctctgtgctctcaggcgatatatgatttgactatttctttacctcatgctgtagcctaatttgtattttagtgagccctctttactacctgattggtcaggtgtgagctgagttacaagcccggtgtttaaaggtaggtgcggtcacctttcccagctaggcttaggaattcttagtctgcctaggaaatccagctagtcctgtctctcagtcccccctctcaacagtaaaacccaagtgctgttggggaggttggccgacgactgctcttaagtgcttcctgctgtattggggcatagtaggggtcgtgcagtttagatttcatcaggaggagtgccttcaatgtcattaacatcggagcatgggctagcaggctgttccaggggtccacggtagatcttagtcatggactgcatctggggttctatttgaagaacaatttgtaattttacagctttgattctggaagagacaaacttaacaaggaggttaaagatacagggattgaaatgtaggcctgaagtgccagggattatttcttcggcacacttcacagatcctgactatctgcttgatagttttgaaaaggcctggtctagtaaataatgatttggccatctgatgggtgctatcaatgcctaagtgaaaggtctagtgaagggttttaagtaatttccattggttagctgcaggcaaaagtatttttccttcttcagtggctagccatcctgaggggaagaagctatgtactcttgaggttccccattctatttcttctgctgagtactgggccttggtttcctggaggggattaccccatactaggggtccttctgtaagcatttctaatggagggtcctaccttgcaactcttttggcttcaatatctgcttggcggttcccttctacttcttttcttttctttctggtgaccctggcagtgtaaaactgccacctctttaggtttctgtagagccaaaaataatctcctaatgtcttcctgatgtttgataggtattccctcggaagttaggaattccctttctctccatattgttgcatgggcatggagagttaggtaagcatacttagagtctttatatatatttaccctttttccttctcctaattctagtgtataacggcccctgcttttcctaggatgtctctccctaacaaaggagtggggctttcaggcataattagaaagacatgtgaaaagagtaaagttcgccagtcacaacttagtggctgggagaagtatatagtgactgcctgtcctaggatcccctcagatagtgacagatctggaggacagttgtccaggacaggagagtaagactgagacagctgcgccagtgtccaggagacagttaacctcctggccctcaatgatcaagcatacccggggctctgtgagggtgatggcgtgggctggtgcttgccccggacaccctcagtcctgctgctgtatcatctggttagtggcttctgactcagaggaccttcgtcccctggggcagtgggccttccaatgattcccttgacataaggggcatggacgagggggaggcttatttctattcggacaatcttttttaaagtgtccttgtaaaccatactggaagcaatccctgttaggcattcgatttgcccagcctttccctgttccagagccttcaaagtccatttgcctgaagaccatgactaaagtggtggcctttttcttatcccgtttatcccgttctgcctgctcctcctgatctttattataaaaaactgaggttgccaagttcagtagggtttctaagttttgctccgggcctaaggcggacttttgaagttttgttctaatgtctgcagctgactgagtgataaacttatcctttaagattagttggccctcaatagagtcatgcgacagagaggtatgctttctcaaagcctcccttagtgtctccagaaaggcggtaggatttttcttccttttcctgtgttatagtggacatcattgaataattcatagtcttcctcctagttttccttagccttcttgcacgcaagttagcaaatgtctgcggcaccaatctccatgttctgattttgcgtcccagtgagggtctacactgggaactgcctcctggcctgtggagaattgttctctttcttctgttgtcatcctatcattgacctgactgagataccagagattgccaaactctctggctgcagttatggtggcacttctctcttttgtggttagcgtctgatctagcagcaacattatatctgtctatgtccgataaaagcattgttctaacccttgtaaaacatcaatatagccatcagggttatctgataatttacctaggtctattttaatttgcttcaagtctgacagggaaaaaggtacatacactctgggccgaattctccagaatatatcttaggggcgtttttgccttgtggggaacatgtcccatctgaaaaaagaacatagggatgccagcacctctagtcattttccaatgagcattatcccagaggactagagcgtcctctgtggtcctagtgcttattcctttccagggtgtacaactacccatggacctctgcttatcggattagttacactcaccaatgtagcagtcctgcaccccttttcccacctttcttgaccacaaagaaaggggtccgggctgctggattctagtggtcctttaccagcatgcccaatattgcctttgcgctcaagggtgagttctagagctgggctgggttcctgagtattttataacaacccagctgccccatcaagatgcgttcccataaacaacagttcttatgcaaattcttttcagagagggtgtaggtaaccttttgagttaggattgaggtagagtttttgcccactagggcctttgtccttttcccttgtaggaatacgccctaattatcaatcttaaactttttgttgccccggattaagtccttgccggtatgaaatttgagagatggatcctgtttatcccatgtgcctttttccgtgggttactgggttaaggatttttgataggaaggctatgtgttgtcagtggtctcagtgttttcaggctacgcccttgtttacactgacaacaaggtagtattggagtgttatagggtcacagagaagaccttcagttatcaattataggttttaaatttaccctggcttttaaaggaatagggtgcactgttttttctttactacttctatctctctttttctctctctccctctcttttctctctctctctgtctcttctctccttgagttacttaattcgctttcatcctgatctattatgttgtcatagacccagttccagttgttaaagtactgggtcatgagtttcaaggccctggccaaggagccaaggcttggagattgtattgcagagggataagctgggtaaaaatcaggggaggagagcatcttacatgatgagagagcaatcctcctagccatttacaaacttggggccctggcaagggtggtggggaatgggtcccacataactgcccatgttgagagctgtatatctaaactgggacaccagggacaagattccctgggttcatagcctaggtacctaaggacacagcatagaacttccttagatccctttggagatacaacttgctctaatacttgggagaggaaatgaagtctgaaccattagtacctaggaggcagggatcggaggaagtagattcagaagtaaggagaattttgggctacactttcaagaaagtcatggtcgggacccaggaggtatgggtcagaaggaaaggtaggggtgcatgcacgggcgactgttgagtagagacttcggctgcgccatgatctcaaccagctaacgccgggagttcgggacgacagctttctgcctctagtcggccctcggcctccccaggaaaattgaaagcagaagctggttccaggcagaccaacgctcccaacccagaagggttggacgttgttagaaagccctttcccagatagcctcacacctgagtcttaagtctggcagccacactaattatttttaactggctgacaggtgcccggtattttcctccaattctaaggaaggataggacagaatagcaagtgaaagtggtccaatattactcaccgcttttgaggtccctttgtggtcaccaaaatgttactggggggtccttgttcttagagctcctaagatggtggtaggctgcttccaagatggtggcaagcctcttgttctctgacctcgggttcttgacctcacggattccaaggaatggaatcttgggtcatgcggtgagtgttacagctctgttcagctcgattaggatgaaccccaggcacttagcctgtgcaggaacaatggtgagcctctagcccgactgggagtggcaatgggcgccgcctcgctggatcagaagtgcagtggacaccctgccagatcggaggggtagaagtcaacagcgggtctgcgacgacggtgatcagcagtggtggacggtgagtgaaagctcagtttgaactggaacaaacacggaccagagagtgtgcagttgcaagatttaatagagtgaaaacagagctcccatacaatgggaggggacccaaagggggttccctgccttttttttcttttaggtccttgaaggattacatgatgcctgcccacattggtgagggcaagtcttgtttattcagtctgctgattcaaatggtaatgtcttcctgaaacatcttcatggatatacccagaaatgttttagcagctatctgggcatcccttaacccagtcaagttgacatgtaaaattaaccatcaccatgccaagttaaaatatttatagatactgctaaattgtatgctatgttaatcaggattctttcagtactgagtgaaagaaacctagttcaaactagcttaagcaaagaaagggaatatagtagctcaagtaaatgtaaatctgagtgatgggtctcttcagagactgctggattctactattagaatgatgtcgttagacaggcaggatttccctttggaagttctagacttaccttatttttatttttttaattaaaaaaatttttttaaagagatggggtcttactctgttgctcaagctggagtacagtggtgtgatcatggctcattgcagcctccaactcttgggctcaagtgatcctcccatctcagtctctggaataactgggaccgcagacatatgccatcacatcaggctaatttttttattttctatattttgtagaggtggggggggggtcttactattttgtccaggttggtctcaaaactcctggcctcaagtgatactccttccttggcctcccaaagtgctgggattacaggcatgagccactgcattaggccttgccttatctttaaagagctctttatgtattctggatattaatccttcggtgttatatgtgtttcgggtattttctcgtcacttttcttaacagtgtctactttctttgtaatgcctttcaacctcttcctcttcactgacttcttccatgcatcttgtgtgcattatgaagtctctgctgagggttgtctgagaagtttgcacataatacaattccttgcattgtggaaattattttatatataaccttttcttataatacctaaataaaacatagtaagatgatataaattgtgtaaatggtgtggcgatataatcttgacatttattacacttgtgattggcacatagtaaatttgtcatcaaattctggctcagctgttgagaaatattctggtcttaatacttaacctatctcctctactgaaaaccttgtggtttgactttccctgttagagtttgcagaaaacaaaaagaacggtctatcacccattactaccacttttataagaagtaatagacaagtttattattcataagtaaaaagacactttgtgtcagtaaacatagggtgtggttccattggcagtgtttgggccaactcttgtcattgctacacaggcgtcagtggctggcattggttcagctgaggtggctctaattctccaagtattcccaggaaataactcacaagttgtgaaagacctgaagtgctcattgtgtttgtccattaagaatgtctttaatacccacaccatttaaagtttcaataagttgagaaggagaagccactttgccttcctttgagggtaaggagagattaaagcattaaaaacagtgaataggatgagccatttctttttcaagaagcacccctgtagagaagggaagagagtgagaaggtggtggttgatggtccagtacaaggtagataagatccctttgctaaaactcatgtatcagtttaaggaaagcagtttatctttggaactttcaaaactaatttatagtgggtggtgaaaattttcttaaaatgatactttggagactttaccaaatgtgtaacaactttgacagtacttaaattgcatatctatctgcatttgtattttacaaaaattcagactatatacctaattctattgaaccctattgagagttggtccagctaatttatcctcgtttcactgttatggaacctgagcctcagagaggtttaagtaattggcccgaagtataacccatattatttctagcagagtcaaagttgcagcctcaatccaacttcaaatgttatcttcctggtccagtgattttaaagttagcttaatatatttttttctataggtaaaatatttcaagatctcaagttagtagtaaattgacttcagtatttctcacctgtgtgagaagtgccttttattttctttacttcatatataatcacacaggagattttatttccttttcccaagatgagtgtgtatgcaagtcactaagggtggcttgcactccagaagtgggaattaaactctacttccttgatggagtagtctttacataaattatttggaattcttctacatgggagatttatctcttctctcccgttaatttatatatttagtcatttatatctgcatgaactcattgttacttattttatacctgtactttaggttacaatccaatacaatgtaatttattttgttgctcatattgttttggtcataggatgccctttcagagtggctcctattgtctcttttgcatgcccccattgtttgttttttgagcacgttttactttttggacctacagtgtgctccgactctttgtatgtttcccacctcagccttagaatcagccattttcataagagtgctggtttcttttacgggagaatgatagtgaaaaccaagatgtaaggccaggcatggtggctcacgcctgtaatctcagcactttgggaggccaagtcgggcagatcacctgaggccaggagtttgagaccagcctggccaacatggcaaaaacatgtctctactaaaaaaaaaatacaaaaaattacccaggtgtggtggtgcgcctataatcccagctactcgggaggctgaagcaggagaatcgcttgaacctgggaggtggaggttgcagtgagctgagatcacgccactgcactccatcctgggcaacactgtctcaaaaaaaaaaaacagaaagaaagagagaaaaccaagatctgaggactgggtgtgcttgttgctactggactgtcattgattttaagccctttcagcagacagatctagaacatatatttatatattataacccatgtatatatacatctatagttgtttccgtgtctagccatctgtatctatattaagctaaacatgaattcatactgatgtctggactctactccagaacacatggttcattctagccttccctctttccttatatgtaaccttcctctccaacagtaagaaacctggcccccagatctgccatctgtttatttatttgtttgttcttagtattcatgtagagtggtttcagaattgttaatctctactcctagaaacaactttaccaactagactatagtgtttatgtgcagttctttttgtctttagtcttacagttttcagtcatagcatcatttatcaaagttatgtagaccagtgtcttttttctctatctctcagtgtggttatgacatatatttgtaattcaattagattcttttgtcacagtctgcatgctatcctaggatcacccttccttttacctcctggttgattttttttttttaaattgcgtacattaaggttcactctttctgctgtaaggcataatatttaaatggtcaggattaaactttatgtcttttttttctttttaagtggaggagaacatcttttctactttacaagagaaagttccttggcttctgtaatgtaacatcggtctaggtctctgaccttttagtgaccatctttcttagtctcttactgcttctgttgattcctttccctgatgggtaccttcctttctgcatttgtaccaggagcacattacttcactttttctaactttaagacatggtttaatatatagtaagtctaggcacgcttcaatgcttgtgttgttcatttttctaaattatttgttactcttacctgccctactgatagagagaggagacagccaaatgctgcccaggtcattgtgcacagggggcttgcctaaacatgcccatgggggcgaaaaattccgtgccttaacacgtgcacagaaagggaaataaatcaatgtggagtggctcagaataaggggctgcctgtgcactggaagaatggggtgaagccactgggaattctcaccttatgcagtggggaggagcctggcctcttcagctcatgtgtggtggtctggtattcaatctgtggggtgggaacctgttggcaggacccccttttttagctgggagctttcctttaataaattctgctctcctcacctttcaatgtgtccacatgcctaatttgtcctggtggtgacacaagaacccggattttagctgaactaaggagcaaaaaatcctgcatcactaccctagacttatcaacttgagttactttatcaagtataaaacaagcaaatagctctactggcatttttattagaagtgtattaagtttattaattattttgggaagaatcagcatctttataatattgaaattttccatttaggagccaatctactgatgtctattatctatatatgtctttgtgttcctaggttttcatgtcatttgtattcacaaaactgtcaggttaatacatgaaataagggtcatgtctgactaatctccgactaatctcaataaactactttgaataagagtcaacttctgactaatctctgaaaccctatttctgtgatatgtccttttaaaatatgactactctatcttgccctttagttgtgcatctgtgaagtttgagactgttttctttgaatatatgtacttagaagctgttactgggatatcatggcttaatctacttgtttcatcagtgagttacaatgacaagaattacttaaaatagataactagttaggagcatttgtttcaattctgacacttcaagaaaatgtttaagtttttttttttattttctgtttagtttattccagctctcagaaatgtcttcacccttcactttagagcccatctttctataatgggcatagaattttattgtgtaaatatcatttgtataatttgagtgttaccagaaccttgacgttttcatgacaaatacatttcggaaactttaactcataaattccttattatatgtcactggttgtgttagagtgcattttattcttttagaactgcagttttcattaacaattaaaccatagtcttaagttagaaaaggagtatttaaaactgcctcatggtattagttgactacaaggaagtaatggtaagagatcagaccatttcccttatagaaatttaaaaataaaaaaataaaattgatgaatatttcgataaattctgtttaagcaaatatttagtgctgcatcctcctcagactattgcttttgttacctttcaatttctgccactcctcttcccttattcaccaaaaattagagaagagaaaatgggagctagtggacaggatttgtgtattaagaataccaaagagctgttcacagtgggatctctgtagaactttttcttgattttctatagttttaaatggtgaaacctgtcatttatacattacttacattttaatagttcattaaattcctcttggaatctttgctttttaaaaccaggaaatagaagtaataccttctagttgatgggctttgattcttccacagattcatctgaaaactacattaagatgaagacctttgaaggtttctgtgctttgcatctcgctgcaagtcaaggacattggaaaatcgtacagattcttttagaagctggggcagatcctaatgcaactactttagaagaaacgacaccattgtttttaggtaagtatgctatttgtggtgcagatgcaatttttcatcattattatttttttgttaaactaagcttaatttttccttcagctgttgtgcttatagtatgttcttttggcaactatcataccactacttccttgatttttgaaactgaaaagatatttttaaaggttttgctcttgttttctattcttgggtggtagcttctgggactttgtttatttaaagttgcaaaatctgtttcgaattgtaggcaccatcattgttctcactgtagttctgaagaccaggtatcacttaaattgtagcagtagttgcaaggttacctgtgaatgctttatgtttgcttttgccttttcttaacattaaaaaattaagaagcttttatggaagaaatcaccagctaatactttaatgccagttaatgtgttgcctgtatggatctgttttttaattcagacctcttctgttacagactgttttttaattccttaaggacgacagccaaattctaaatggctttcttccaataactgtcttttttcttcttttcctccttttttctattcgattctatttgtcttcagggacattgtgtcccataaagtttagtggaacatgagaaaattgagtcaatgaagcgtttggaatagaatcagtgcatctggactatagttttggtcctgccacatgtaatttgtatatttatttatttactatatgtttcagtatcctcacttataaaatgagagtaatagtacctatctagtctttgttattggtctgagaatgaaatgagttgtctgtgaaagtactttttttccttgtggacttaaaaatattacttaaatttatgtactttagtaaaattcattctttttaatataacagttctgtgagttttgatgtattcataaaattctgtaatgacaacaatcaagatatagaaccattccatcactcctcaaaattccatcatgctgccaatttttaatcaatattttcttccctctccccagctccacccctgacagtgactgatctgttcatatatatgaattaatatacaccatatagcctttgagactggcttcctttagctgtcatgatacttttgagattcatccatattgttgcatgtatcaataatccatttctttttgttagctgaatcgtattctattaaatagatgtgattaaatagatgtgatacagtttatccatttatcagttggatatttgagttgttttcactgtttagtggttacgactaaatctcctataaacatttgcagacaggttttgtatcaatataagtttttatttctcttgggttaatacttaggattggtatgacatatggtaaatatatgtttaactttgggaaacaagttggaagtttttttctactggtttgcatttcgttcagtaatgtttgagacttttagttgccccatatccttgccaacatttgctattgccagctttttctttttctcccttacatcttagtaattctaatggaggtttagtagtatctcactgtggtttttatttgcattttcctaattgccaatgatgttgagcatctattcatatgattattttccatctttcctttttcctcattacttttgtatttagacgttttgttttgaaataatttcagacttatggaagtagtcaataacagtacaaagggttccttatatacttttcacccagattttcttcttttgccaggtttgtcatttaatttccttctttgtattttttttaatccttttgagattaagtggtagacatcacgctcctttacttctacttcagtgtgaactcctaaaagcaataaaattctgactaccatatgatgatcataatcttatcaggaagttaacatggatagaatagtattatttggtctacagccctcattcaattttttcgtgaatgtcttttatagcaacagaaaaaaagattttggtccgtgatgaatccaagatcacttgttatatttagttgttatgtctctttggcttcctttaatttggaacagttttttagtcttttatgattttaacttttttaagagttcaggtcattgattttgtataatatccttcgatttgggtttgtctgatgtttcttcctgataaggttcagggtttgtgtttctggcaggaataccacagaagtgccatggtatcttagtgcatcttaccaggaataatatgacacattactagtaatgttaatttatgaaagtactttgaatatgcgaaaagtattttacacgtttcatggaagctttggtttaatgtagcttgggtttcctagaggagtgattgcttttttatattaagtttcttttttcccctgcacctgcatttaacctactttggatattctgtacaactacagaggaagcatttattgaggctcagctatacgcaatctccattctagccgctttcctcaagaaatcgtctacgtggaggagtaaaaaaggtgattttacaagtttgagattttaaaagggagaataattagtcacccttgaatgacagaagacttcatgtgcagagtgctgtattaacagtaacaataacatttattaagcagagtgtatactaagccttgtgtgggtgttttacatgaagcagataattggatcttcactgtgattctgagacatgtactattattattcccacttttacaggtgaggaaactttaaaaagactggatttaggaagagaagagctatctttgaatcttgatcttgctgttgtctgtgttttgggtagaaaactgattcagtgaactattaaaaacatgtttattgacaaaaggtttcctaatcacatacatttgcgaaacactatgtgctatatcccccagtgtagaaaaacatgaagacattacatatgtgacttattgtgcccaccctgtctgaagtatccactgatctctttatgcattctcttttagtgtcttcatcactgactccagttaattattactcccttgtttatttactgcccccttaactagaaagagtgttccattaaggcagggattttattcatcttgttcactgttgtaactcccaaactcagtttagtgcctggtatatggtaggtattcagtaaattatttgttaaataaaagaatgaaggattctgagaagacctctcttaaacaacatttgtttatcgcagagctttgaaacgtatttgactgtactgttctttcagtctcgttgtccagcctggagtgcaatggcacaatctcggctcactgcaacctctgcctcccgggttcaagtgtttctcctgcctcagcctcccgagtagctgggattacaagcccccgccaccacgcctggctaatttttatatttttagtagagatggggtttcaccatgttggccaggctaatctggaactcctgacctcaggcgatctgcctgcctcagcctctctaagtgctgggattacaggcatgagccactgtgcccagctgtattctttttctttatggaacatttaggaatacctccagaaacattgatattccatgggactatttgagaaatgctattctggccacatagtttacagtttcaaattattattattattattagagtcccatttatgaaattcagtattgtgcctacttttattagtatttggagaaaattagagatgcatagtttttaggggtttatatttcaacatgtagttaacttgtacttttttatgttaatgaagcaagggatgggagataattcaaaccagtaaataactttaaatcacttatttttagtagtaggatttattttgtttctgtggcagtgaatttaccattttgtaaatggtaaatttgtattgactaagaaataaatcttttgtattgactaatacaaaataccgtgcctggccaatatagtatttaaaaaaaggaaagtagagccttagtgtttgtaaaaacataatgtggaagggccaggtgtggtagctcacatttgtaatctcagcactttgggaggccgaggcgggcggatcacctgaggtcaggggttcgagaccagcctggctaacatggtgaaacctcgtttctactaaaaatacaaaaaattagctgggtgtggtggcacatgcctgtaatctgagctacttgggaggctgaggctggagaatcacttgaatccgggagggcggacattgcagtaagccaagattgcgccattgcactccagcttggacaacaataactctgtctcaaaaaaaaaaaaaagaaaaaaccccccaaaaaacagtgtgtggaagaatgggcatgtatacatcagtgttgtgtatggaaaaaataggaatggacatataactctttagttagataatatgggtgtcagtgtcttctctgcatcatgaataataggacaaactttagcactctgccttgctcacctttacctttttttattttttgatgtagggtcttgctcttttgccgaggctggagtgcagtggcaaaatcatagctcactacagcctcaaactattgggctcaagttatcctcctgcctcagcctcttgagtagctgggaccacaagcaccgccaccacacccagctaatttttttttaatgtttaatttttgtagagttggggtcttgctatgttgcccaggcttgtcttcaagcgatcctcctcccttagtttcccaaagtgctaggattacaggcatgagccactgcacttggacaatctttttatcttttaaataaccatatagtgattcctgcttcagtctataatggaagagttttaaaattaaaacaaaatccaaaataattcaaggtttgtatcaaactacaaataatttctagatgaggaagagtagctggactagttggacttaaagtgagaaaggaaggttaacctgtctagaatagcttcctttcccatctgtagagttagcttccaaaactgaaaatttggaatatgttgtttgaggtattttgtttctctccctcaagggaagctatactctattacatgttataggacctgtcctgatggcccagttagcactagcctattgctagaggctatagaatataaacccagaggatctaggggtagaaagtgaatatggaactatggaaatctcccaggtgaccggaaaagttgttgacatgagaggtgtgttggatctgattatgactgaacataaagctaaatggagggactctggaaagtcgactgctccactgtttgtaatgggactatcttctttacacagagctcaccaacattttaataaagatgagctttaaaagggaactcttcaacttaatggcagtaggaatcaaaatgagaaaacctcacgagaaaggggaaattcagggaacatctcatctttctacatgaatattgtccttccagaacatctttttgctagcacacaggttagagtttattttttaacaaggagtcttgctgccttatttcttttctctacccttgtcttgtccttcccctgctctctttcccttccccttgctccatatacacataataaatattctaagggtaggtaaaactgctttggaaataaagatattcttgttgatagctataataaattctaagtgaaaaatccagctaatatttaggaaatagatttcctttttattttgttatatttagaaaacattgctaaattggaggctcaaatccaaactagtgtgatttcataggacactccatgggaactgcatggcatgcgcttttggcttttgatggatggtttttcattttttgtttttctgagtttgcttattctgtgtaatatttaataagaacagaatgttttataaatagtgttgggtgaggctgcctatttcaatatttaactgtaaaatgtgtcatacttcagctcacatagcatatgctttaactttgactctgctgacatattctaaaattgaacaaaccaccatgtgattcacttttcattagtgtcttcatggataagtgatcattcataaggctattttttgatgtgctatgaattttgtggtttcacattcatatctctttatatattatgttaataaaactttgctttggaggtttttttttagatttttcaactggaagattaatcttcagtgattgtcatgtaagcatttttacttgaggacatgttctttaaaatacgggtttgagttttcttagattgaaagtatggagtttactaaaagttacatttaaaaagtgttaatttcatgttctggttttacttttgtttgtttttttagttttatggttcttgatacaactttatattacacctatgttttattttttttaatttttttatttatttttttgagacagagtctcgctctgtctgcccaggctggagtgcagtggcactatctcggctcactgcaagctctgcgtcccgggttcatgccattctcctgcctcagcctctcaagtagctgggattacaggcgcctgtgaccacgcctggctaattttttttttttttgtatttttagtagagatgaggtttcaccgtgttagccaggatggtctagatctcctgacctcgcagtccacctgcctcggcttcccaaagtgctgggattacaggcgtgagccactgcgcccagccacctttctatgttttaacacaatgtcttttaattacttttttttttttttttgagacagagtctcactctgtcacccaggctggagtgcagtggtgcgatctctgcctactgcaacttccacctccagggttcaagggattcttgtgccttagcctcccgagtagctgagcttacaggtgcctgccaccatgccaggctaatttttgtacatttagtggcgatgaggtttcaccatgttggccaggctggtctcaaaatcctgacctgaagtgatccgcctgcctcggcctcccgaagaactgggattacaggagtgaggcactgcacctggcttttaattctttaatgtaagcaattatgaaactaggatacttattatctttctggttttaccttcatataattaaatgtatttatataatgtgttattttattagtcacatttgattaatagatttaaacctccagcttttaaagatgaggaaatcagtatccttatattgttcttacataactctctttctccccccgcttttccaacttttgtcagttatatttgcattgttagtgggaataacattttgcattttgttctggcatcttaaatgcatcatttaactttattcttagttccacggttaaatagcttagaagtttatcaccagttattttggcatgttttttccagccttgtttggttagctaaataattcctttaacacagtcctttaacaggacctatggcagtactattccctgagtttttacatgttcaaaattgaataatttggctgggcgctgttgctcacgcgtgtattcccagcactttgggaagctgaggtgagaggatcacttgaggccaggagttcgagaccagcctgggcaacagagtgagaccaccccatctctgcaaaaaaaaaaaaaaaaaaggtaaaaaaattgaatcacttaaattgaataatgattcaaacttgaacagcagtttgatcaggtacaaaatccttgaattacatccctttccttgagaactttaaaaatgatgatccattctgttctagagttgaagtctgaagctagcctaattttcttctctttttgtgacaatacttttgcttgtccattccttatcagttttctctgacacagtgtgtgtcctttcaatatgtagacttggatattttaaattttagttaatctttctggaattatatctttaaatatttgtctgttctgttattatggtggtgttcttgggccagcgtgtttacatgttggtatcttatctgttttcaatgtctattgttttttctctatttttctttctctgtgtttttgttttacttttcctgttttttttttaagcctctatgttcctcttcagaaatgtctattctgtctagtgtttctttcaatttcaattggattttttatgattgtttttgcttttcccaggtattttctgaattcagtttaaattatatcatttcctgtcagccatttttttactgagcacttgtatttcagtgttggtgctgttttcacagagacaattgcttccttaacttcttttttaaaatttacagttgtagatttagctacaattttcctttggtttgtggtaatatttttcagatgagaggtttttgctttcttttgttgttggtctattgtttttctataacttttcttcctttattcttgtatctttgtatggatttgtgctggtacctttgtgataattcatcttgggaatatgtgagtttttgctcaattagctgctttcaggaggtttataataggaaggaggtagaggcacattccatattatggagttttcctttagactcaggatttttggacatgaattcatttagctagtatctttcactagccattgggggttggcagctgtgggatttttgcaatacagtttcccatttgtggtagcagagatagaccactttgtgtgattctttttttggatccagtccctctgattttcggatttcaactggtccagagaagttcctgctgctagcctgtgcattttttcctggtacttagttttgttcctcagagggagcccctgacctttgagaagtgttctttgctagctttttcttagatgtgcagctgacacatctgtcctctttctcccacaagtacccaggattgatcgtcattcttttggagccccttttacaaattttgatctggagttcaaaaatctaaaactagaattatagttttactaaaaatggagagtgtgtttttattttatttttcttgctgatgttggattaattgcttttggatgatttctaagaaaagtaaagggaaatgcctatattgtgctacaatattaaaattggaagtccatattcatttttaaagtaaaacagaaattctcgatttcagtatttttgtaataatttgaattctagtatatggtagcagtgaatagacctagataaaatctccctcaaccccagtccatacaatacaatctctgttctagttaggtaccgtagagcagtgccactcaaaatgtcagtcgatttatataagaagcttgaaccattatataaatcaatatattggtttcttcatcaaggaagtcctgtctcaaggaaaatgtcagctaaaataaagtgtgcttagagacatagttgtttatattctgttcaaaacttcttaccttgttgaggactgataacaatttgcacattgacagccagtttgtgacaatgttgagtagccctgctgtacagcatgccatgcctttgtggctatcaaactggattgttacatggttaatgcaattgtctcttcattcttcatgattactaatgccattggccaactaatgatatgtgattatcattggttagtatggctaaaatggaaatgttgctcctacataaataggactctttgggattaaggatagtctgtccatacactttttctttgatagggaactcccagaatattttgtttctctaagccttagtatgggtcattcttacaaggtggatctagtaaggagaatactgctgtatgaatgcttcaaaaagttgaataatttctgaaagtagtagaattacagtgttatagccctagaagaaggtgtaagtttagggatgtgttatctaaatcaaatgtttcttgactctgctgctggggagacatatggaaaaataaacaatatataataggatagtggaattttagctttttgtcttttaatactttcatttgattgaaggatgtatttttctggatatggtctctgatgtctaattggccattagacttctccctgtctgttagaaaccatgagaaatgtcagtgataacgtggatgattggattgggatattcgccacaacgtttttgttatatccctaacataatgagttttgcccagaagatcatggtttttcccatcagtatgcatctttaagattgttagccactgggcagacatgaagaaatttataaaacagaaatataactttttagtataatttttaaaaaattctgtatatcaataaaatactacatttcagactaaagattttaataattgttctgctgccttgggtataagtaaagtgctggaaaaacataaacttgaggatacatagaataaatggacaacactggaaaaaaaaattcctttgtcatagcaataatggagtttcttttctagtgccaccagatgtcagtatgaacacaggaccagagaaatactgcaggagataaatgttcttacaaatgttccttttttggttcatgaaagaggtgggggaaaaaagttttacataaactagctatacaatgaaaaaataattttactgttcaattgtatagaaaaatgaaatgcataatggagaacagagtacatgtagaactcaaaaaagtagagataccattaaaaattcatatataattcaaatgtaaaattgaatatatagatgatttctgcatagccagccagcctgctgctataactggaggagatggacagcctgtggttaaacttttcgttacagacttactgaccatgtcattttttagaattattgtcaaaatctgagcctcaaaatgaaagactaggctgggtgtggtggcttatgcctataatctcaacattttgggaggctgaagtgggaggatcacttgagcccatgagttcaagaccagcctaggcaacatagcaagaccttgtctctacaaaaaatggaaaatgagctgtgtgggtggtgcatgcctgtaatcccagctactcatgaggttgaggtgggagcatcgcttgagcccaggaagttgaggctgcagtgagccgtgaatgtgccactgtcctccatcgtgggtaaaagagccagaccctatcttaagaacaaaacaaaacaaacaaaaaaatgaaacagtatattttctagctaatagagataaaactcactgtaattttcatttggtacaaaattgtgtttataattgtaatttgtacagaattgttatggtaattccctagaactcatagtcacattaagcatttttctaaaagagcattcactaagataattacatttaaaaaatgtcccttaaaaaagctttttctttaatgaatgctatattaaacaatgatcattatttactatttctagttagatttagtacttacatgtatgtataggtctaccatatttctcccagatgagagtcccgttttgagttcttgctttcatgaaatcttcacatggggctttgcttgtaactgtactcaatatgttgcatgccacaactgagttgattttggtcaaaagttttgtgtgggtcaaaggctgcttctagtttctcaatttcctgttttcaaaaatattttgttacctaagatatgtttttccagattgcttcatttttcctctaatttaggaaatggaaaaaggtgttttttcaaaaccagaaaatgtctccctagaaattattgcaggatatgttctcatgccatttttgctttcttaagcatttacaattagagatttcttccatactatgttatatgatccattgtgggaaaagcagtgttcctaccctcagaggttctggcttttctcttctacctgtttggagtcttacctgtttggattgaagaggggaaagtctttctcccatatctctgtgtactccagacacttggagctctgccttctgaaatgcggtcttttatttcatccttaatctttttccttggtctctggtccctattggataccattttttaataccagatactatgattctgctttctttttctttctaggaacccacagtacttttctagcttctagaattacaccttatctttctgtctttgacacttactccaagacctgcagctgatcgcctggctctctgtttccaatgctaaatgggtatcttgaagacaggtatacctagtattctaggttaaatttcaattcaattcaattctaatctctagaccagtcctacccaatagaacttggaattgtcctatatctacattgtcccttatgatggtcactagccacatggggctcttgaacacttgaagtttgtctggtttgattgaagaactcaaattttaattttattccattttaattaattaaaattaaaatttaaacagccaaatgaagcttctgtcttctatattggagaacagttctagagagcaacagaatgagtgcagttcttcatacatccttaactgaacagtagtcctgttttatttttgaaatatttatctcctttgccctaacatgtggtcctagatgggtctcacataaaaaggcgaaggagcaaagaaacaccagcttagccaactagttttgcttatcaataggatggtaaaagtcacaactgaatttttctcattatcctccattgattaggtgattatcaggcctctacactatcaggcttagttcctgatatcatgggcttacaatttaattgaggatattataataaccagaattcaagataggctgtaataaataccataagaggtacacagtatatgaagcttagttctgtcctaattactgtgttgttattctgctgtggatttatctatttcttgtctcttctctctccctgtttctttaggttttaaatcatttttcaattaatatacactttagtattattgagtaaataggacagtgttcagtttgatttttattctgatgtgttttaaaaaattcagggtatactatatgcacattaggaatattttagatattcaaagtgttctcgaaattttcgttttgaaattcccttcagaatttgtggcagtcttttttttttttttttttttccttttttaaaacgtcctggacaatttcacatacacaaaagcttggagacatccttccccttcctctcacaagtacccaggattgatctccattcttttggaatagtatggtctcatcactctgacttagccagaagtcttaggagttccatggcccctcagtagtgtttgacttctaattatttctgttccattcttgacccttaagcagtttttatttgctttaccttgtacatgtgcaacctacgcttgaaccaaggacccttgggcaacttccacacagaggcctcctgtctgcacaattcactcttctctagggccttacctgcagatttcaaccacttaaattctaatctctgtctcctcagtttactactgcacttgagcctctttcctctggttggagtacacctttcccaaccttactgttgctctacttggacttcagctcactgtaccgtaacggggaaatgtccccaggtacagagctggggtgatcatgggctcatctcttgtgtttcacttctctcgggaatcacagttgtctgcctgttgattaatacccgagtaagttaccttatatattttgtccactcttatgattgttttggatggatggctagtttagtaccagttatactgtcatatcccaaagtataattctgaagcttattcaatttggcgagggaatcttaaaaagagaaatcaatatcttcttttagacatatttttttcttttttgagacagagtcttgctctgttgcctaggctggagtgctgttgcatgatctcggctcactgcaacctccgcttcctgggttgaagtgattcttgtgcctcagtgtacttgggactacaggcatgcaccaccacacctggctaattttgtattttaatagagactgggtttaaacatgttggtcaggaattcctgacctcaggtgatctgctcaccttggtctcccaaagtgctggggttacaggtatgagccactgtgccctactcaattttttttttttttttctgagatggaatctcactctgtcgcccaggctggagtgtagtggcgcgatttcggctcactgcaagctccgcctcctgggttcacaccattctcctgcctcggcctcccaagtagttgggactacaggcgcccgccaacatgcctggctaatatttttgtatttttagtagagacagggtttcaccgtgttagccaggatggtctcgatttcctgacctcgcgatccgcctgcctcggcctcccaaagtgctgggattacaggcgtgagccaccgcacctggcctccaattttaaggttattaatttatgtcaccaccacctggatatgatagttccacttttaccacatccctgccggatacttactctgtgtttcattttaaatattctggtgggtggtgttgtgggtgctcactgaggttttcatttgcatttccctaatggaatgacaagaaggtgagtacttttccatgtattttattagctatttgcatatcctcctttgtgaagttcctgcacaaattttctcatgttttaaaaataatttatctttttattgatttaaggagttcttaattttaacgtggtccaatttatcactatttacctttatgtttattgcttttaatatgaagattaaaaattatttttctattccaagatcagtttgtagatttttcctttcttttttttttttttttagaaggtttgttgtttctaaatccaatctggaatttaattcgcaatccatctgaaattgggtattgtgtgggacaggggtgaagatttttttccccatatggatattcagtggacccaaaaccattgtcacctttgtcataaaagtgaccatttgttgaaggtatctgtttctgcagtttcagttgttttattagtctctttctctatcctgtgccaataccatgctaccttaattattccagctttattagttttgatagctgcttgtatgagtcctctggctttattctacatgatttttttggctttatttggccctttacattcccatctgtatgaatcagtttttgtttttttttttccaactattaagacaatacctgtagcacctttgggtattttgattgggctcacattgaatcgttagattgttttggggagaattgatatttttaaaatagtgaatctttatatctatgaacatggtgtattctacttttttttttttttttagatctttgcttttctcagtagtattttgtagtttacagtttagaggttttgcatgttttattaaatttatgcctccaggtctgtgttaggcatgttgattttaaggggctgatagaatgtctggatggaaatacttggcaggtatttggaaatttggttctggaccatgagggaaagttcagttaggagcaatcattcgcctagagatgaatttgctcagtaacgtttcagaattgaacaaattcactaatagagaacatgtataggccgggcgtggtggctcatgtgtgtaatcccagcactttgggaggccgaggcaggctagtcactggaggtcaggagtttaagaccagcctaactaacatggtgaaacaccatctctactaaaagtacaaaaattatctgggcatggaggtgtacgtctataatcctagctactagggaggctgaggcaggagattcgcttcaacctgggaggtggaggttgtagtgagccaagatcgcaccactgcactccagcctgggcaacagagcaagactccatctcaaaaaaaaaaaaaaaaaaacttgtataaagtaaaggaataaaaaaataaatagagattgaagacagaatcctggtgagtcatcacatttctgaaatagtaggatagaacaactaaactaagaagaatgagttgttagagaaagttgtaacaccacaacagtgctgttgacatggagaaaaaagtttatgttagagaaatatggggaatttaatgccagaggcagtaggaactgaataggaggttcaaggctgagaaaaggccattgaatttgatgatgattttcaagggaatagctttacatgaattatggcagtagaatttgcatgatagttattgattaagtgattaaaaggtccatggaggcaggtatttttgtctcttgttcacttctgtatctctagtacctggaatattacctggtacataataggcactaagtagacatttgttgaatgaatgaatgagtgatttgtgggaaaatgggatcactgaatgtagactcaagaagagtagtctttgggggtagttcagtggtaaaaaaagaaagtgagagaaaacagtagattggaagatattttgtttgtttgttttatttttagggaaaggaaaacctaaactagtctgcaggttgaacagtggagcccagtagagaaggaatgatgagaaaaaactggagaagagacaatatgaggaacaaactgcgaagtggagtgttgggaacaggccccccaaaatgtggccataaactggcccgaaaactggccataaacaaaatctctgcagcactgtgacatgtttgtgatggccataacgcccacgctggaaggatgtgggtttaccggaatgagggcaagggacacctggcccacccagggcggaaaactgcttaaaggtgttcttaaaccacaaacaatagcgtgaccgatctgtgccttaaggacatgctcctgctgcagataactagccaaacccatccctttatttccgcccatccctttgtttcccataaggaatacttttagttaatctataatctgtagaaacaatgcttatcactggcttgatcttaataaatacgtgggtaaatctctgttcaaggctttcagctccaaaggctgtgagacccctgatttcccactccacacctctgtatttctctgtgtgtgtctttaattcctctagcaccactgggttagggtctccccaaccgagctggtctcggcattggaggaggtgggaggccaaggtgggcggattatatgaggtcaggagttcaagaccagcctggccaaaatggagaaaccctgtctctactaaaaatacaaaaattaggtgggtgtggtgtcacatgctggtagtcccagctactcgggaggctgacgcaggagaaccgcttgaacccaggagacagaggttgctgtgagccgaaatagtgctactgcagtcgagcttgggcgacagagtgagaatccatcttaaaaaaaaaaaaaaggaagtggagaaggtatggaattgagggaaaggacacagatgaaattctaaaaaggaggaagcctgcttcttctcatgagatacggaaaaaataataagtaaatcaagtttctacacagaatataatataaaatgtcattgtgtagttcattcctgttagcaacattgtttcaattggatagagttaatttgctgttgctgacatgtatcattctctctacatctagatagctctcaaggcagaagcactcttttttatactttgatatccttctctatccttcccatttcatctgtattcccactatctccatggaattcacaggtactcaatgtttatagatacgtgagtggttgactctgttcttagaaaagactgtgaagtctgttttatttgctaggtagtttctaaacatgctcttatacttggttttctcagtaggcttgagaaagtatgtctgtataaagtaatgactgcctttttggaagcaaaccattcagcacagttatgggtctcctcttcagcccatccaatttgatatttccattttaatagataaagtgaatgctcctcttccaaagcggaggctttggtagtaaatctgagctctaaatacacttttctaaaccacgatttctcaattagtaactattaaatttgctttattttgaaataattaacaagggctgtgaaaataatatttttctgctcatgtgtaagttttacttttgtcattgggaaatgtttttaatagttgcagatagcagatttcttaatatatttatgatattaaaagtgaaaacataacttgcatcataaggttaaaaaaatgaaaatttttctgtcatctatattgtatttaataatcaaaacacattttttgactttaatttttataaggtcagcctaacttgtggaaaacaaacttaccttcactctccttcatatatcactgttgacaacctgataatcttcaagtcatggactggctatagaatgatttttgctaacagtcactgataatgatgtatgaatttgatatgaaacagatttttttccttttatgacctccacccaaaattattactattattttcaggcttttttttaatatggtaatttcatttgtaatttctttattttgctttttttaattttcagttatttttttaaagctgttgtggggccaggtgcagtggctcatgcctataatcccagcactttgggaggctgaggcggaggtggatcacctgaggccaggagttggagaccagcttggccaacatggtgaaaccttgtctctactaaaaatacaaaaattagccagacatggtggtgcacacctgtaatcccagctactcgggaggttgaggcagaagaatcgcatgaaacccaggacagggaggttgcagtaagccgagtttgcgccactgcactccagcctgggtgacagagtgagactccatctcaaaataaaacaaactgttgtgggggccaagtgtgatggctcacgcctgtaatcccagcactttgggaggccgaggctggtggatcacctgaggtcaggagttcaggaccaccctggccaacatggtgagacgctatctctacaaaaataccaaaaagtagccgagcatgattgcgggtgcctgtaatcccagcgacttgggaggctgaggcaggagaattgcttgaacctgggaggcagaggttgtagtgagctgagatcacgccattgcattccagcctgggcgacagagcgaggcttgtctcaaaaaaaggaaaaaagaaactgtcgtggatactgtcagtgtatatatttatgtggtacctgagagccaccccaaattagattgactttagatcgtttatacaaaaatagcttgaagaactgttttttccatggtaaatgcttttgaatattaacttagttatgttagattcctacctcagtggtactgtcacagccattggttacatttctgaaacccttcagagtaagagttttggttttttgttttgttttgttttgttttttgagatggagtcttgctctgtcgcccaggctggagtgcagtgcagcaacccaggtggagtgcagtgcaacctccacctcccaggtttaagcgattctcctgcctcagcctctcaagtagctaggattacaggtgcgtgccaccatgcccagctaatttttttgtatttttagtagagacggggtttcaccatgttagccaggatggtctcgatctcctgaactcgtggtccacccgccttagcctcccaaagtgctgggattacaggcgggagccaccacactcggtggagaattttttattaaagaacttctgagtgtcttataggggaaataagctttggtataaattcaatatataaaactagtacaatatcaatggcatgttacttgtcttcagtaataagcacgcttatcatttcttgttttacacttttaaggatttttatattcccattgtttcatgtgtattagtgttttctaatgtgactcattatccaaatgtgcctttctaattttgtgactgagaagtgttgattcccacttcctgcctcctactatagtgggagatacagaataactgtatgattgaaatgaaaaaaaaatcttattcttcaaatcttttttcttactaatcaaaaccacgatgagataccatctcacagcagtaagaatggctggtattaaaaagtaaaaaaataacaggtgctggcgaggttgaggagaaaaaggaacatgtatacacagttgatgggagtgtacattaattcaaccattgtggaaagcggtatggtgattcctcagagagctaaacacaactgccatttgacccagcaatcccgttactgggtatatacccagaggaatagaaatcattctactgtaaagatggatgcacacgtatgttccttgcagcaccattcacaatcaccaagacatgaaatcaacttaaatcttctttcttacatccaagcacgttagccagaccttcttatacatgtcttaccttcctttcttataaatactactatttctccattttaagtttctgaacttaaaatttaaagaagtcactcagtagcctcacacctaacaacattcacagtatacctaatttgctaatggtgtgtgtgtgtgtttgtacttattttataaagcactttgtaattctattctggcattctgtttttcattaacttcgtgcttaaattcctccataattagtgccaccttcatagcaaagttttgtgcaaaataatctgcatctctttaacaacattttttattttttctggaatccgcttttagttcacataagtaagaacgtttacattttcattgatggatataagaacattttgacaatgcttatgatttatagtggtaaaaaaaatctaagatgaagaagttgctttttcattttgtcagttactctttttatttgtgatcaaatgtagtaatagcaaacctttcagtccttttgagattgcttttccagactggtactgttgattctgaattgtccaccttatatcctcccagtttcattttaacaaactagagctaggctgtttccattttcagagagaataaatgtttgcttcttggttccagttcctctgtgtcttttaacatgctattgaaaatcattttgcatgtgttcagaaacaattagatatatgttaatggatttgggctaagacaattgtgataactgtttaggaataatcagagcattgtggttctgaggtgagtaagtgatgagaacatcaccaaagtgtccagtcctacaaacatgcctttttgctgacattaatttttctaactgctgtattacagctgttgaaaatggacagatagatgtgttaaggctgttgcttcaacacggagcaaatgttaatggatcccattctatgtgtggatggaactccttgcaccaggcttcttttcaggtaacctctgaatttattatttcatttccatgtaaattgtgtgttttaccctcttaaaatgacagtcctatgcagtttttgctttctgcttgcctgtgatttatgatggttagtgcagtacagaaaaggcagtctaaatgctaatgatgattctgaatcagccaacttctgtagtagctgtggaagctttgggctatagggattatctacattttaaaaatgtagatggcatatttaagaaaccatcagttatttgagatataaattgataaagagcaatgggttattttatttacaataatgtgcttagaaattgtgatggctccttagtgctttggttagcaagctaatttttcaggattctataaggtttataattcctagagatcagtgtttcatgtttacatttattgggttaactagaaatataggataatctgatcgtttggccaatttctttccaactaatacagcagtatactgttttgttttttccttcaagttatcctttagtgagaggataaaaaagaaaaaaaaaacacagtaagaagaaagataccttctattttctttgtttttttcttatttaaaatgtgaatctgtgctttaggaaaatgctgagatcataaaattgcttcttagaaaaggagcaaacaaggaatgccaggatgactttggaatcacacctttatttgtggctgctcagtatggcaagctagaaagcttgagcatacttatttcatcgggtaagattatccattagcctttgtactgttaagatcatgagctttaaactatatttcctagaggaataattcttgtctcaaatataaatcaggttgtgaaatttatggttttatgtaagtggtaaataagagtaaatacaaattgatttataaacctggttattaagtatctattactaacaatgcagtgcacagctactaatttatctgagtaggaacataatgatctatcactaaagcaggtttattggcaagttgaatgatggggctgtcctttcctgtagggacttgagcagtttcaactttctagggtgtaagactagtttaggcttaattaccttattagatggctattttgtttattaaggctctgaggggtatgttaattttgtgattatgtaaataggtttatttcaaagcaggtttacactttgttatgttaatagtaacataacctgctaaaggtttctctgtgacaacccttccacattcagcattgccagggaagttggtgtgttcaggtggcattcttactctaagtgacaattttgtgaccagaaatgtttattttacaggggcttttaaatctctcccaaacaccagatatgctcttcacagtgctaacttgatgaagcgtgaatcacagtaggctaggcaattaaaaaaaaaatacctaggctttttttggccaggcacggttgctcatgcctgtaatcccagcactttgggaggccaaggtgggcagatcacttgagatcaggagtttgagaccagcctggccaacatggcgaaaccccatctctactgaaaatacaaaaattagctgggcatggtggcatgtgcctgtaatcccaactactagggaagctgagacatgagaattgcttgaacctgggaggcagaggttgcagtgagctgagatcgtaccactgcactccagcctgggcaacagagggagactctgtctccaaaaaaagaaagaaagaaagaaagaaaacccaggctttttataaacttcctttaaatagaaaatagatcatacaaagtttgtttgtttgcttgtttattgattgattgaggccaggccttgctccatcacccaggctagagtatagtggtatgatcacagctcattgtaaccttaaactcctgacctccagcgattttgcccctttagcctaccaaatagctgcgattacaggtgcatttcaccatgcccagctaattaaaaaaccttttttttttaagacatgtggtctcaatctcccaacctcaagtgatcctcctgcctcagcctcccaaagtgctgggattacactgtaagtcgctgtgcctgcccaataatccagtttatttaaacagcagggcacatcttttcttatttttgctttcttttagaaaccttcaaacacttaagtcagagtaggaagtaaaagaaacaaacattcattaagtgccaattgaaggcatctgttataaataatgagtctgtaaatcttacagttaagaggaatccccaaaattatctgttcaaacataatcgtttttagattaagagtccagactgtgaatgtttaagtgccttgtcaaagatctagactcgtttcctggcagaatcagggcttggacccaggccttctgacttctgatcttccttctactacatcataccttccggaggactatcctaattcagttaatgacttgcagtcccataagtttcaattattagtgtttagcctgggtcagtggctcatgtctaatcccagcgctttgggaggcctgaggtcaggagcttgagaccagcccagccaacatggtgaaaccctgtctctactgaaaatacaaaaattagcccggtgtggtggcacgcacctgtccgagctactggggaggctgaggcaggagaatctcttgaacccatgaggcagaggttgtagtgagctaagatcgcaccaccgcactccagtctgggcaacaagagtgagactctgtctcaaaaacaaaacaaaacaaaactatatatatatatgtgtatatatatatgtgtgtgtatatatatgtgtgtatatatatgtgtatatatatatgtgtgtatatatatgtgtgtgtgtatatatatatatgtttaattaatatttagattaaataggccaggtgcagtgcctcatgcctgtaatcccaacactttgggaggccaaggtgggcagattgcctgagctcaggagtttgcaaccagcctggacaacatggtgaaaccccgtctctattaaaatacaaaaaattagccaggcatagtggtgtgcgcctgtagtcccagctactcaggaggctgaggcaggagaattgcttaaacccaggaggtagaggttgcagtgagcctagatcgcgcctctgcactccagcctgggtgacagagtgggactccgtctcccaaaaaaaaaaaaaaaaaaatttagattaaatagattaaactgcaccttaatgtctctcctcatgtcaggtgtgttttcttgtcgcctggagctctgagctcctgttttggtttgctttgttctttttatttcttctctctgaattgttttgaataatcagttgaaaaggtatgtaggtatgtttatcatgtaactatacatgtttccaacccctattactttcgtttcagtgagttgtctgtaatttttccaactttttcaccagtagtctttaaagaaattggttccttattctttgtgatactttgaaattgtcactcaaaataacgcattaaaaaaaaagttaaggtttctttcttgacttagtctcttttcagttatagtgtttacttctttctgaaactgacagtgggtgaaacatctaccctatagaaatcatgaagtttctagtttctatcatgagaaatttctgaaggatctatagactctttaatttaccatttgtgttctgtgtagtttttgcgtacataaaactttggtttattcaaggtgcatttatggaatattcttttaaatagaagacagccttttccgtcttgatgatgatctttccaccgaaatgtattctagaaatttaaaaaactctcatggtcatgtaacaacatcatatgtagcatatttaatacattatttgccaacaagaaaagtttggagatgactgctattttcaaaatcttcacaaaaagtgaggttagcttttaaaaatctttatacaatggcgtatatataatttaattagatttgtgattttattttattttttataatttcaacttttatttcagattcagagggtatgcatgcaggtttgttacataggtgtattgcatgatgctgaggtttgggatatgaatgacctcatcacttagacagtgggcatagtactcaacagttcgcttttcagcccttgccctgttccctgcctcccctctctattagtccccagtatctgttgttgctatctttatgtccttgagtacccagtgtttagcctccacttataagtaagaacatgcagtatttggtttttgttaatttgttaattcacttagaataatggcctccagctgcatccatgttgctgaaaggacatgattttattcttttctatggctgcgtagtattccatggtgtacatctactgtgttttctttatctgatccaccaggtatccattgatgggcacctaggttgattccatgtctttgctattgtgaatggtgccgtgatgaacatgcaagtgcatgtatatttttgttgaatgatttattttcttttggatatatacccagtgatggaattgctgggttgaatggtagttttaagttctttgagaaatttccaaactgctttccactgtggctgaactaatttacattcccaccaagaatgtataagcgttcccctttgtctgcaacctctctagcatctgttgttttttgactttttagtaatagcctttctgagtggtataagattatatctcattgtggttttgatttgcatttctgtggtgattggtgatgttgagcaattcttcatgtgtttgttggctgcttctatgtcttcttttgagaagtatcttttcatgtcttttgcccaatttttttttttttttgaaatggagtcttgctatgttgcccaggatggcgtacagtggcactatctctgctcactgcaacctctgcctcctgggttcaagtgattctcctgcctcagcctcccaagtagctgggactacaggcacgtgccaccatgcctggctaattttttgtatttttagtagagatggggttttcaccgtgttagccaggatggtcttgatctcctcacctcgtgatccacccgccttggcctccaaagtgctgagattacaggcgtgagccaatgtgcccagtccttttgcccagttcttaatggggttgttttttgcttgttgaattgtttaagttccttatagattctagatattggacaaagttaagataaagacctttgtgtaatatccagaatctataaagatacctagttagcaaatattttctcctattctgtgggttgtctgtggattcttctgttttacagaagctaaagagcttaattaatctaaagagattaattaggtcccacttaccaatttttgtttttgttgcaattgcttttgagaacttagtcataaattctttctcagggccgatgtccagaacagtgttttctcatttttttttctaactaggatttttatagtttgaggtcttacatttaaacttttaatccatcttgagttgatttttgtatatagtgaaagatagggttccagtttcattcttctacatgtagctagccagctatactagcaccgtttattgaataaggagtctctaactcattgcttatttttgtcaactttgtcaaagatcagatggctgtaggtgcatggctgtatttctggattctctattctattccattggtctttgtgtctgtttttgtaccaggaccatgctgttttggttactgtagccttaaagtagagtttgaaattgggtaatgtgatacctccagctttattctttttgcttggtattgctttggctatttgtgcccttttttggttccatatgaatttaagaaattttttttctaattctgtaaaaaatggtgtcggtagtttgataggaatagcattgaagcataaaaatgacacttcagggactcagggaaaggatgggaagggggtgagggataaaagatcacaaattgggtgcagtgtatactgcttgggtgatgagtgcaccagaatctcacaaatcaccactaaagaactttctcatgtaaccaaacactacctgttccccaataacttatgaaaatcaaaaacaaaaaactctgacatttaacaggggaaaaaataaaaaaaggaatagtgttgaatctatagattgctttgggcagtatgggtattttttaaaatgatattgatttttgcaatccgtgagcagcgttttccgtttgtttgtgtcatctatgattttttttcagtagtattttgtagttctccttgtagagatctttcacctccttggtaagatgtattcccaggtttaaaatttttttttggtggctgttataaatggagttgtgttcttgatttggctgtcagcttgaacattgttgatgtatagaaatgctgctgattttatacattgattttgtaacctgaaattttactgaagttgtttatcagcttcaggagcctttttgtggagtctgcagggttttcttggtatagaatcatattgtcagagaagagagattgtttgacttcttcttttcctatttggatgccttttatttctttctcttgcctgattgttctggcaaggactttcagtactatgttgaataggagtggtaagagtgggtatccttgtcttcttccatttctctaggagaatgcttccagcttttgcctgttcagtatgatgttggctgtgggttggtcatagatgattcttattaagatacattccttcaatgcctagtttgttgagggttttgttttgtttgttttgtttttatcatgaagggatgttgggttttatgaaggcttttctcacatctgttgagatgatcatatagttttggtttttaattttctttacgtggtgaatcccaattattcatttgcatatatggaaccaaccttgtttctcaacaatgaagcctacttgatcatgatgcattaactttttgatgtgttgctggatttaatttgctaatattttgttgagaatttttgtatctatgttcgtcagcactattggcctgtacttttctttcttcattgtgtctttgccagatttttgtattagggtgatgctggctttgtagaacaagttagggaggagtctctcctccttgatttttgggaatggtttcagtagaattggtactggtttttctttgtatgtctggtagaattcggctgtgaattcatgtggtccaggacttttggttggtaggttttttttttttttattatggattcagttttggaacttgatattggtctatttcaatttctttctgattcagtcttgagagattgtgtgatttatccatttcctctagattttctcatttgcgtgcattgaggtgttcgtaatagtctcagaggatcttgtgtatttttgtagaatctattgtaatgtcaactttgttgtttcagattgtgcttatttggaccttcgctcttttttttatctagctagcagtctgtcaattttgtttatcctttcaaagaaccaacttttggtttcattgatcctttgtatggatttttgggtctcaatttcattcagttccactctgattttaattattttttttcttctaatagctttggggttagtttgttctgttttttcttattcctcgaagtgtgatattggatcattaatttgagatctttctttctgagctagatgtttagcattataaacttcttaacactttttgctgcattttaatatgttctgtgtctgtttttatttatttcaaagaattttttgatttctgccataattttattgtttacttaaaagttatccaagagcaagtttgtttgtttgtttgtttgattttgagacagagtctcactctatcgccaggctggagtgcagtggcaccatctaggctcaccgcaacctccgcctcccaggttcaagcaattctcctgcctcagtctcctgagtagctgggactataggcacacaccactatgtctggctaatttttttttttttttttttttttgtagtttagtagagatggggtttcaccacatttccaggctggtctcaaactcttgagctcaggcaatctgcctgccttggcctcccaaaatgctaggattacaggcgtgaaccactgtgcccagccaagagcaagttaatttctatgtaattgtgtggttttggaagatcttcttggtattgatttctatttttattctactgtggtctgagagtatggttggtattaattcagtttatttatttatttatttatttatttatttatttatttatatttctggagacagggtcttgctctgtacccagactggagtgcagtggcatgatcttggctcactgcaacctccccctcctggttcaagcaattctcctgcctcagcctcctgagtacctgggattacaggcgcgcacccctgtggccagctaatttttttgtatttttagtagagatggggtttcatcgtgttggccaatttggtctcaaactcctgaccttcaagtgatctgcccatctcggcctcacaagtgaatcagttttttaaatttattgagatgtgctttttggccgagcatgtggtctgtcttggagtatgttatatgtgctgttgagaagaatatatattctgtggttgatgagtggagtgttctttagatgtgtattaggtccaattggtcaaatgttgaatttacacccagaatttgttttttaattttctgcctcagtgatctgtctaatgctgtcaatgggatttgacatctcccaacattattgctatctctatagatctctaagagcttgttttatgaaactggatgcttcaatgttgggtgtgtgtatatttaggatagttaagtcttctcattgaattgaaccctttatcattatgtaattaccttctttgtccttttgtactgttgttggtttttttatatataattttttcttgaatagaaatggggtctcactgtgttgctgtgaaccccaaatatctgagagagatctcagtcaatttaggaagtttattttgccaacattaagggcatgtgcctgtgacacagcctcaggaggtcctggcaacatatgcccaaagtggttggggcacaacttggttttatacgttttatacatgagacatcaatcaacatatataagatatacattggttctgtctggaaaagcgggacaactcaaagtggggagagtatgtccaggtcataggtaggtaggagacaaatggttgcctttttttttttttttgagtttctgattagcctttccaaaggaggcactcagatatgcacttatcccagtgagcagagggatgactttgagtttgagttctgtctgtccttcgtccacagggaaattccttgtgagggaggtacgtaactttttctaatcttagtagctattttttaggaatagaataggaggcagggttgcgctaagcagttcccagcttgacttttccctttggcttagtgattgtgggggtcccaagatttattttcctttcacattgccctggctggtcttgaactcctgagctcaagcgatcctccccccttgtaagagttaaagaaagaggaaagaaacacaaaagatgggttggcagttaaagacaggtttactttagataaaacctgagaagggtttctggctgatttcgatcaggagcactttctcttacaggctaagtacatgagtatatattggttttagggtgagggggcttatcacaagcttggagtgtttatgtgtgggggagaagtttatggtgaggttggaatgtctctgggtgaaggggggattatcttggggctgacgtctttctagaaggaagggagttatctcggggctggcatcttcccagccagagcagggcagctagcatgtctctggtcgcagaggagtttggcatgttcctggtcggagatgctttttttgtttatgatcatgctgatcttagccatttaggctgatgcgctttggatttaggaagtttttgattaaggtgaattggaaaataacagtgcttgtgcaagatggtgatactcctgctctgtcatacttcggcctctcaaagctctgggcttataggcgtgagccactgtgcctggctctgttgtctgatttaaagtctgttttatctgatataagaatattgacccctggttgggcgtggtggctcacgcctgtaatcccagcactttgggaggccgaggtgggtggatcacgaggtcaagagatcaagaccatcctggccaacatggtgaaaccccgtctctatctgctaaaaatacaaaaatcagctgggcgtggtagtgcatgcctgtagtcccagctactcgggaggctgaggcaggagaattgcttgaacccaggaggcagaggttgcagtaagccgagatcgcaccattgcactccagcctggcgacacggcgagactcagtctcaaaaataaaataaaataaaataaaaaactagtgacccctgaccttttttgttttccatttggttgataaatcttttttcaaccctttactttgagcctatgggtgttgttacatgtgagacgtgtctcttgaaggcagcagatggatgggtcttttttctttctttttttttttttaatccaaattgcagctgtgtgccttttaggcaggatgtttcgtaaaaggcgaaagatttgtatgatctgaagagaccctttacattcaaggttaatattgatatgtgaggttttgatcctattattaagttggtagatggttgctttgcagtttctattgtatgattgtattatggggtctttgggctatgtacttcagtgtgtttttgtggtatcagtgttgttctttcatttccatgtttaaaagtcccttaaggatctctgctaagactggtctagtggtaacaaattgtcttatcgcttgcttgtctgtaaaatattttatttctccttcgtttgtgaagcttagtttggtggaatatgaaattcttggttgtagtgtcctctctttaagaatgctgaaaatagacccccaatctctcttgccttgtaaggtttctgctgagaagtccactgttccttttgtatgtgatctgacgtttttctctagctgcctgtaagattttttctttagtgttaaccttcaacagtctggtgactgtatgccatggtgatattcacgttcacagagagttctctgtattgcttctatctggatgtcttcctctctggcaagattagggaaattttcttaaattatgtcctcaaatatgttttccaggtcatttactttttctccttctctctcaggaataccaataattcatagatttggttgctttacattatcaaatatttctcaaagcctttttcattaaaaattttttatttttatttttatctgactgggttagtttgaaagactgatcttcaagctccaaaattcttccttctgcttggcctagtctattaataaaacttgcagttatattttgaaattccttaagtgagtttttcaattccagaagctctgattgattcctttttaagatgtttatcttaagatgccttcatttcctgaattgctttagaagtttctttgtgtttattttcaaccttgtctggatcttgttgagcttccttgcaatccttgctttgaattctttatctgtcatttctgagtttccatttgggtcaggaaccattgcgggaacacgactgtgatccttcagtggtgtcactatatttagatttttcacaaatccaaaattcttggggtagttccttttcatctggagatgttcacacttctaatttttgtaattattttcatgcaggtgggatttttttctttttctttctttcactataatattattgtttttccctttcacatttatgattttaaatatcaactcagaaacctgttgaaagagaccctttttctctgattgtaggcattatttatcatgcagtggttatgaagaaagagatgtaatagagagtatagtcaatattagttttaaggcgtggctcccatatatgtcatatctactgataatttttcataaatcttagcctgaatcaattagtggcataatttggattttatctttttcagcagttatcagaaatattatccatgtttgatagtttgcatttttctttttaaatgtttacttattgggccccagaatgcttgttggaggagggattggaatgaaatgtatccttcattgaataggatttttgttttagcttaaaaatgaattctaagatatgaatcacttgttttcttgctgacgtagaggcaagacctttttatttttgatagagacagggtctcactatgttgcccaggctggtctcaaacacgtggcctcaagcaatcctctggccacagcttcctaaattgctgggattccaggcatgagctaccctgtcagtttagcgaagacaatttaaatgattaccaagaagttagcaaagtaaatatgtttatataacaacatccaacattcagtgaagagggaaaagcttaccgtgctacgaaacccttttatggtagttcctttgaaatttgtgttgatttttttaagtattagggttatctgttaaatgttttattttgtacccttaggtgcaaatgtcaattgtcaagccttggacaaagctacacccttgttcattgctgctcaagagggacacacaaaatgtgtggagcttttgctctccagtggggcagatcctgatctttactgtaatgaggacagttggcagttacctattcatgcagctgcacaaatgggccatacaaagtaagtgttaaaaacagaaaataaacatggtctcttaatcaaaagctaataaagaataaatctgggctagacccttcacctctaggcaaagtctttgatattctcttccctaccaatctgctgggtgaacagatctacccctaatctgtccttcatgctgtcttttgctcctactattcctgcactttcatattgtgaggcagaattgctacagactgggtaggctcagggactttctcggggtgttgactcttcccattgatttctctagttatggctgtatccgccgcctcctcctccctagttttatcccaggcatctttaagcatcaatctgatgaggccatccatgttacctctctgaccccagaaagcttttgagtttgtgatgcctgttggagtgtgtgctaagtagtcctccctgtcttaaaccctttgactgaacttttcttgatctaacctcaaattggagagagagtaaatgggggttccaggaatcttagaagctagtaacttggttatacctgtgagaatatggctacctatcataaattggcagtcaatgatttttagaaatatatgtgagaatatggctacctatcataaattggcagtcaataatttttagaaatacatgtttagaatctttagagccataattctataatagcactttttatagctgctattagtattatttaatttaaaaagtaatagtaaaatattcattacttaatttagtttgtttacatagtaggaaaacagattctgcaatttggtcattatgccactaggtgacacagtactttactatttcattaatgatatttgtaagcatgtttatgtcttgtgggagagtataatttttcccacctacttaaaaaaattaaacacatttattaaagttaagagacattagactattttaacaaaatacttagatttaaaaatttgatattttccccaattcttgatcatttatttaaacataagtgttagatattgtactctgaactttaaatggtaccaaaactctcctgggcatttgttctcaattttgagaattctcattgtcactgatgattttctttatagcctacttcaaaggtaaccccttttgtgagtgtaagttctacttaaatgttatcttagacatacattacatgaggaaaagtcacaaagagaaatgtaatactatgaaaatacttcagagtagccctgtctgtcttttcccagaaagaaggaatttcctggctttaactatacagttttatttttaattttagaagggtagaatagtccttttttctttccagttgactgctagaggtaagtttacaaataacctaagaacttttgttttaattattttcttagaactttctctacctaggagccagcttctttataaatctgcctccatatttaatgagctcacttttttttcagataatagaatattttagcacaaattataatttcttcctgatgaaaacattagtcttaatttcatgccagttatcatctttaaaaatttttactaattggaaaagaaaaactagttggtactttaagaaggaaaatagtgcattttcttgatgccagtttatacttagtagaatgatgttttaaataatttattaaaccctaaaatatctaacataaaatttgaattttgggggttaaggtggtgctagtaaggtaataaaattaaaagagcaccttttctgtttacatataggaacattaattttgtttcaaatgtatttaaagacctttttattaagcaataataagtgtaacattctggagtaaatatatagcatgtaatagtttaatgttgttggtagaaggtacaccctagacagaaatatttctttaaatgaatcagttggtaattctgaaaaaaattgtgctatagaaatgttgcctacatttatgcacatatacaaacactaaattctcctgaatttgtgtatttatagaatcttggacttgttaataccacttactaaccgggcctgtgacactgggctaaacaaagtaagccctgtttactcagcagtgtttgggggacatgaagattgcctagaaatattactccggaatggctacagcccagacgcccaggcgtgccttgtttttggattcagttctcctgtgtgcatggctttccaaaaggagtatgtatatttgctatgtttttattttttattcttttttgctgtatggagatgtgttttgaagtgactttctttcacgatgaaacttagtatctctgttagtgctaaattgctatcttggaacacaaataggaaaaaaactatgatgtttcagtcaagctgaagcagaaatgaggtgataatatcacattgttttccttccttctttggatctggattatatttttagtgtagcaatcttagggaatacgtacaatttaagtagacgcagaaatttgctgatatttttggtcttcaaaacaattcaagaattaaaaatggggctttatcaagtaaggcagtgactgcttcaggtcatttaccgtttcaaatttataagatataagcctaaaaattaaactttagttttatagatattattgtgtttttaatgtatttggtggatagcattaaaaaaaattttttttttttgagacagggtctcactctgtggcccgggctggagtgcagtggcaccatcttgactcattgcaacttctgcatcccaggctcaggtgatcctcccacctcagcctccagagtagctgggtctacaggtgtacaccaccactcccagctaatgtttttatttttagtagagatggggtttctccatgttgcccaggctggtcttgaactcctgggctcaagcagttcccttgcctcggcctcccaaaatgctgggatgtcaggcatgagccacgatgcctggctttatattatttttggatgtgagtctaaataattaagtttttaaacgcccccaaattaattatttttctaatctgtcataattctgtgaaatagactaagtgaagaattactgctgccttgttagtgtctggccagtaactttgtctataacactcttacagttttaaaacactaagaataaagctgtgtgtaagaacagccatattgagtaatatctggtcatccaataatggaataagttatgaagatagatgctattgtgtttaatgacacagaagaggttgcaggcatacctcaaattgtattggccttcttgaattcactattatgaatctctatttaatttgagtagttatcaagaaattatttactaagcttttcagcctttactatctcttaacatttgccatgtaaaattagtagttcactataatttgtttcaagtttaagcttacacgttttagtagagatagggtttcaccagcctggtctcgaactcctggcctcaagtgatctgtctgcctccagcctccaaaagtgatgggattataggtgtgagccaccccatccggcctcttaaacttatacattttagtttgaatatttgggttttggttaatctgagtatctggggcccactttatgtataactttcatgatttcataggattttcttgtgtaccccgttaagttttgtctttttaaacagaagagccctaattactttagttgaccttcagtgaggttgcactgataacttttagttgcctttctctatcccaaatcttaagtccgttacagaactgaacatttcttattagaccagaatataatgattttggattgcgcgcgcgcgcgcgcctgtgtgtgtgtgtgtgtgtgtgttcaatatgatgatggtcttttttggccttcatcttatcttttggatgaacaatgtttttggtccttctggtcacagcagctaagctcacgcctcatcaccttataagtgtagtttgaattaagccatataatgtagtacccctgttaactctgaaacaccttaaaattaatgatattccttgggagctgggcagtatgtttcatgccttctgtagattcggataaatgaaattaggtgggaaagatcttaaataggtttctggattttccaagattagttgaaattttagggggcagacccttttttctcctttgatttctacaaaatcagtcagtaacactaattgaccattttgttatgtagagagcactaaatagatcctgttaaacttactgaggaagctgaaacatacacacgatcctttaggaatttaaaacctaatgggaaaaacagtatttagtggcatttacttcactatcttctgctgtctttggcaaagaagcgtttttaatgtatttttttttttttgtatttttttatagagactcatggaagggaaggttcctatttttttctgctgtgtctgggataactgcaaataggagctattatctcattcttgaatagtgatataaatgattttttttcttttcctttcacaagtactccaaagttgtatttttaaggaactccacagtttggtttgctttttatgtctcagttactctgtagaatttttttctgtgtaaacttcagtgatgctaagaagttcttaacatgcagtggagtaattccactacagcctctctctttctctctaatgactacaaaaaactgtggtcaaaattcaaaaagaaactacctgaggactctcaaaggaacaaaagcagatagattatgaaagagagtggtaacttggtgaagtgacccacatgaaaacgaattttcccatttctttttcctttttttttttgagactgtctcgctgtgttgcccagactggagtacagtggcgcgatctgggcttactgcaacctccatctcccgagttcaagtgattctcttgtctcagccacccaagtagctgggattgtaggcatgtgccaccatgctcagctactttttgtattttaaaagagatgggatttcaccatgttggccagggtggtctcaaacttctgacctcaagtgatctgcctgcctcggactcccaaagtgctggcatgagtcaccgcgcctggccttctttttcttctgctgtgttgccctgagggccaaccctgatctggagctgagtagcaccagtggcaccagcagctaatatcagtcagtaacattaattgaccagttgtttaatatagagagcactaaatagatcctgttaaacttactgaggaagctgaaacatagacacaatagaaagcctgtttttctggtcagaggaatcaggtaaatggaaccctgtgggccagagaatggtagggaatcttggagaagagagagcttggagaagcggataccctaattgtgcatatgaatttgcatattcctgacttaccccaagctttaaatgcacaagatagacccaaattgttttttattttgttttgtttttgagacaggatctcattctgttgcccacacagagtgcagtgatatgatcatgactcactgcagcctcgacttccctgggctcaggcaattatcctgcctcagcctcttgagtagctgggactacggttgtgcgccaccatgcctggaattttttttttttgtattttttgtagagacagggtttgccgtgttgcctaggctggtcttgaactccgagctcaggtgatctccctgccttggcctctcaaagtgctgggattacaggcgtgagccacagcacccagccaacccaaaatgttgaaagtaagatttgaactatcatcagagtctcaggctagaccctgagtggcacattcatgggtccaagcttaaagcaggaaagtcaaggcttttgagaactgagctgacgttggaaccactgtataaggtaaaacagaaattgcagtttgaacctaactaggttatatgcttgctgaaataaacaaaccaaaaagctagtgttcttcaaaggattataacaagacccaggactcagaatttatacagcataacattcacaatgtccaggagacaacctaaaattatttgacatatgaagaactgataaaacattactaaatctcatgggaaaaagcaattaatagatgccagtcctgagatggtccagatattagaaatatcagataattgaaagcagctcttataatggtgcttcatgaggctaacacactggaaaaaatgaaaaggtagaaattctcagctgagtagtagaaactataaaaaagacggaaaaatacaataatctgcaatgaaaaatttactacatggactccatagccaaatgaaagatataggaaagagtaaattaacttgaaagtaaaccattagaaattattaacaaaggggaagacatgctgtctggcagctggagcgtgcagactggcgtggcacagccatgcagcttctggagtttctgttggttagagattcaggagtagcttggtgggcagttcaggcttggaggtttctcttatagttgcattaaatatcagatgaagctacagtcattagcaagcttgacaggagccaggggatcaacttccacagaggctcactgacatggatcactcatatggctgggtgttggcaggaaacctcggtttctctctataaaagcctccccacaggacggctgcagtatcctcatggcatggtagctgattccctcagaggaagaggtctaagagagaacaagacggaagtcacagtgacctggttcattgaaattatggctgtcacctccgcagatcacatacacaagccctgattcaatatggaaagactgtacaaaagcacaaataggaggaggaaaggatgattgggggccatcttggaggctagctgtctcacacattatctctgaaattgctgttttttaattttgaaattttcaaacatatgtaaatgtaaagaaattggtacagtgaactcccatagacccatcattcatattcagtaatgatcaaggaaatgccatcattttattttgtacaaatatccctgagaaacatgctctttccacctccagccttcatctaaacatcttatactaactttctttagatttcagtgttccaggctctctccttccctcctctttctggtatgtttatggggtagaggcaagaccaatgcaaagaaagaaggccctttatgctgggcatctaggctttttcagacatcctctgaaacctaggcagagtctcccaaacctcaactcttaaattctgtgcacccacagggttaacaccatgaccatgtggaagccaccattgtgacttgtaccctctgaaacagtggcctgagctgtacctgggcccctttgagccatagcaggagtggctaggatgcagggactagtgtcccaaggctgtggaggacagtggggcactgggcctggcccatgaaaccattcagtcctcctaggcctctgggcctgtgatgggtaaggctgctgggaaggtctctgaaatgcctttgaggccttccaccaccccctggtggttttggctattagcacttgcctcctttttacttaatgcaaatttctgaagtctgcttgaattccttccctgaaaataggcttttcttttctaccatttgccaggctgcaaattttccaaacttttatactctgcttctcctttaaatgtaagttccaacattaggtcctgtctttgctcatgcatatgagcataggctcttacaagcagacaggctgctttgctgcttagaagtttcttccaccaggtaccctaaatcatcactctcaagttcaaagttctacaggtccccagagcaggggcacagtgcattcaggttctttgctaaggcataacaaaagtgacctttgctcacttcccagtaagttctgcttttccatctgagaccttgtcagcccagcctttacttttattcactatcagcactttggtgacaaccatttaaccagtcttcagggagttccaaactttccctcatctttctgtcttcttcagagccctccaaactcttccactctctgccattaccaagttcccaagttgcttccacatttttaggtatctttatagcaatgccccactcttcagtgccaattttctgtattagttcgttcttgcattgctataaagaaatacctgagactgggtaatttataaagaaaaaggtttaattggcccatagttccacaggttgtacaggaaccatgatgttggtgtctgctcagcttttggagacacttcaggaaacataatcatggcagaaggcgaagtgagagcaggctgcttcttacatggcaggagcaggagcaagagagtgagtgtgggaggtgccacacacttttaaacaactagctctcacaagaactccctactgtgaggacactaccgagggggatggtgctaaaccatttatgagaaacccatccccatgatccagtcacctcccaccaagccccaccttcaacactggggattacaattcatcatgagatttgggtggggacacagatccaaaccacatcagtagatctagggtggggactgatattctgcatttctttctttttcttttcttttctttctttctttcttttttttttttttttgagacagagtctgactctatcacccaggctggagggcagtgacaccatctcggctcactgcaaccaccacctcccgagtttatgcaattctcgtgcgtcagcctcctgaatagctgggattacaggtatgtgacaccatacccggctaatttttgtatttttagtagagatggggtttcaccatgttggccaagctggtctataactcgtaagctcaagtgatctgccccccttcacctcccaaaagtgttgggattacaggcgtgagccactgtgcccggcatactctgcatttctttctttttttttttttttgagacggagtctcgctgtgtcgcccaggctggagtgcagtggtgcgatctcagctcactgcaagctctgcctcctgggttcatgccattctccacctcagcctcccgagtagctgggactacaggtgcccgccatcacgcgcagataattttgtttttgtatttttagtagagatggggtttcaccatgttagctaggatggtctccaactcctgagctccagtgatctgcccgcctcagcctcccaaaagtgctgggattacaggcgtgagccaccacacctggcccatactctgcatttctaacaagctaacaagatggtgccaatgctgctgatccacagaccacactaagtagcaagagtctagagctgtgctgcccaaattggtagccaccagccacatgtggctatttaaattaatgaaaattaagtagcgttataaattacttcttcagtttccctagccacccttcaaatgctcaagagtcatgtgtggctagctaccctaccgaatagcacatcatcacagaaaagtccgctgcatggcagtggtatagagaattgacccatagtaactctcctacagctgatttttagaccagaacaattatttattcacagcaaaagaagagctgggcagggtaaacagcaacaggttacttatagtatttatttcctctttctggaacggacaacccagtgttcctaaagacaatatggaaggttgttttgttagctcaacacttgagcaaaagaggttggatatgtttaccagattgtgagaatggatgaattgcttttcttcacactagaagtatatttctcttagtaactagtattgggcataagaatcagggctgagaatgctgggggaagacttcctattaagaaactgcgttttggctgggtgcagtggctcatgcctataatcccagcaccttgggagggcaaggtgggcggatcacgaggtcaggagattgagaccatcctggctaacatgctgaaaccccgtctctcctaaaaatacaaaaaattagtcaggcgtggcggcacgtgcctatagtcccaactactcaggaggctgaagcggtagaatggcgtgaaccggggaggcagagcttgcagtgagccaagatcacgccactgcactccactccatcctgggcaacatagcagattcaaaaaacaaaaaaaaaaagaagctgccttttgactcctttttaaagacataatattttgtctgtttacatacctgcttcttcattagaatgtaagctccttgagagcaaggatttgcccttgatctaactcctattaggcattaaaaatatatttgtgaattaatgaatcaataattatatcagattagcatatttattatatgttagtcttcctcaatgccttgtggagggataaggatggagcatgattcttgggcttggatgagtcacagatgtataatggctgtgtgactttgggtatttcacttcattctgctaaatctcattccattatctttaaaatagggatagtaataacacctaagcttgctttagaaaattattttgaggatcaaatgagctaacagttgtgaaaatgctttgtaatttgtaattattgtcttaaaaaaaccctagttttttgggtgagagagtctttggtctcaatgtcaatatatgtacagatcaccttgcccggatgtgtgccttgtacttgcattctaggatattgcctgtttggaacatctactcatattttcatactgtccctctctgggcaactagcttttgtaatttacaaatatttacaaatgtttaacaaatttaaaggttaaaaacaaatttaaagaaattatccacacagaagtacaaaagagaaaaaagatggaagaaaaaaacaagagcgtcagggaacgaagggacagtatcaacaggtctaacattcatgtcattaaaatccagaaggagaggagattgggcacagaaaaaatatgtaaattaataattgccaaaaacttcctattattggataaagatataaatttacagatttaagaggcctgttaaacccaaacaggataaactcacagaaaggcatggtcagaaaaatcaaaatgctataaaacaaatgtaagggagacctagtctctccccggatcaaagaagaaaaagaaaagtaaaggtgaagcagtatggtgtacagtagtccttggtcacagacatgagttaacaaacttagttttgttttttttgtgtgttttgtttttgcatctcttagaaattttgctctttgaagtggccatgtgagcataattacaatttgtttttgtgctatcgaaagggcatatgagcgattttctttcatgtgagacttgtaattgaaccaatatattcttaggtagattttcagtaagtagtcattggaaaatgctatatttttagcctttaaaaataaagtcaaaacctcaaaatatctgttttaggagggtgtattctcttagtctttttatttttcattctagaattgggcaacaccttattctataaaatagaacatagcaaactttaaggtcaaagagacgtagaatttgattgtgggaattttgtcaaaaatatcaaggttcaaaaaactttaccaaagtaggatcacaggtcaatgtgaaataatagtcacttatctcatctagagtgataattaaatggcttcaaaaggcaaatgcagaaagttatatagttgtagaaaaacctgagttctttattagagagttttcataagtgatcagatagaataaagacaacatgaagcacagggaatcatcttgataaaatgcagaatctttgtttttttagaccagttacctaataggtaaaggaaaacctttcattatttccaagaaaactaaataccacatttttattatctaatgtctggctggttgcttatacatttactgtatatgtaatatgagacttattcattttgagtttctgtatgaagcttttccaattaagcaagaaaatgatcattttcccagtaggttttgctttggtatgtcaagagggtcatataaccagtgtctgagggaaaaaaattgaagctgaaaaatatgtttttggttatttcttttgataagtaagcatcttaaaatttggattgcctacaatcacatgactaaaattaattaaattaattacagtcaccaattataaagcaaggacaattgaatataatcttaattttaaaatagctatcatatgttattttttccctttttttttttttttttgagacagtctctcgctctgtggcccaggctggagtgcagtggcgtgatcttgactcactgcaacctctgccttctgggttgtggcgtttctcatgcctcagcctcctgagtagctgggattacaggcatatgccaccacgcctggctaatttttgtatttttagtagagatgggttttcccatgttggtcaggctggtctcaaactcctggcctcaagtgatctgtccgccttggctttttggtgtgggattacaggtgtgagccaccacgcctagcccttcttacttttcttaatgagtgatacacgaatttcctatatcacttttaccagttataagaattcaaatttggtcacaatactggtaccaggtaacttagaagattcaattttccaaaattaattatttgatattctaatttttagggatttggtaatagatagtaagtttaatggtataagtttaaaaattttatttttatagcaacaatgtgttatgatagtgttaatttggtatgattgttgtaattaacacctatccgacttcaggtgttaatggctaaaagacttcccttttctcatttgtatattttctagtatttctctgaaatctattaatttactatttgtggactttcttgcactattgacctgttgtattctaataaacttttatctacttttataaatagtacaattaacaccaaaaggtgatgaaaatgataaataacagctttggattttctttattcttgttgttttgagatagaatttcactctgttgcccaggctggagtgcagtagtgcaatcattgctcaccgcagcctcaaacttatgaggtcaagtgatcctcctgccttggcctcctaaggtgccccaggttttaagttttctcttccttattattttttcagctaattcaacttttaagctcagtatcagtgttctgaaacatttttggtaggtattctttgtgagaatgacacttagctcctttcaccactcccagggatgatggaaaggtgtctcctccactactgtatagatcctgcaacaaaagcagtttttgtcctttggagctaaaaagttagcagctatattgatatgaagccagtctttcaagagtaattgagtaatccatctcgaatgaggaaatataagaaaaagattcctccaaatggaatgggaaaggaagagggaagttgagaagttttaggactgtttgagcaaatatgaatgccttttatatatggccacagaagtagattgtggcttagctcacctggttttgtctgtttttctagttgatactaatcattgttattacattagtttcatagaattaattgtgtccattctagccaccatatcgtgtgggcacatctgacaaaactgaatgtcttcatcttgttttcagctaatggtcgaaagccattcagtaaaactcactatttggcctgttataattcacctaataagttggttggatattttgtttgctaattgaacataaaatgctgaagatatttgcccatttctatttgtttaaagtaaattttgttttcatgttgaattttctcttactgtgcttcttttatgtgtgagcactgtttttctgcatagttttgaacttcaaggagcggagtggtagaaaatgtgcaaacccccaaaataaggtctagacattggattttaatttttaaatctctcctctcagtatctgatgttgttcacttcttatataatgtacagtccctctatgtcacaattaattcttgatatttatgttaaacaagatagacttttgtttaaatctcgggtacttgaagagttttctcaatttgatattagggctacagagagaatttgttgaagtgttaagagaaatacatactaatttatattttaaccagaggttatccatgctcaaggatttattgtgtgcttagtgacatgtaataatcaaggtcatatagagccctgaagttgaagttgcttgtgtttctgtagtgtgcacatgtatttgagaccttctttaataaccttcccagaagctcagggcatgctgacaaaactctatgcttctccagtttattttgtgtttattttattcttcaaacaaatggtagtttttttgggaaatggtctatattgtagcactgtgcagttttataagccttttgggatttactcttgccccttctaatacaaggcaatgtgaataattggaagaggtttagagctgattttctaaagtgtgttttggtagaatactaattctgtagattgttaatagatattatatgggattaaaggggttgtattgttaaataagtttgggaagtacaggattaaataatattgaatatgtttcttttgtagagggcttttgagaatttttcttattgtagtgtgctttgtgaattcctaaaagaggaatggatctacaaagatttgaaaagtccagaaacataggatagaacttatatttaagtatatataccattgttcttgtgtttacagaattttgggcattttatacttttgtttgcttttttcagattaatgattggacccattgttaattttaaaggtacctcttctgaaaagtatctgaaagttgaataaaaacattgagcatatatttggaaatgtaactaacacattgtttaaaaatacattcatcctatctttctcaggctcactgtatactgtataaggaggtttctcagtttttttcactggagagtatttttcatatggatcattttcaggaactaaagttctgtgtaacctactttggaaaacatagatctggctctaaaatattcttcaatttggctatatcatgaagtgttcagttttcataatagagaagagatattgcagaaatttgctatgtcatattcactgttagattttggtttgatatcattatcccagttctgccaattactagctctgtgactcagcttcagtttttgcatctacaatggagataataatagaagttaattaattttaagatgtagtattgtaaattaaatttgtgttaattaaaaaagtttttaaattttttttaataccattataaatgtaaggccagtcacggtggcataccttttgggagaccaaagcgggaggattcattgaggccaggagtttgagaccagcctgggcaacatagtgagactctgtctctacaaaaaaatttaaaaattagccaggcatggtggcatgtagctgtagtcccacctactcaggaggctgaagtgggcggatcactggagcccaggagttcagttacagtgagccttgattgtgccactgcacgtcagcctgggccacagagcaagaccctgtatctagaaaaataaataagtttaaagtgggagggaaattggctaaggttattgctaaggaaaatgatatcttagagattcctagaatcatttagttttaaggattgatcacgttgtttattgattttgttaagcaaagtattttgtagtaaagatactcatttgtacaaaatatcacaatttgagttttctgtcaatgataattttttttaaaatgacatttaagatgaatgttttaaattataataatacctgttcacagttgaaaattaaaaaccatgcaggagggtgtaaaaagcaaaagccccaccacattctctaatctcaatccactagatgtgtagaaaccatccactatttaatctgccatacttattccccagctgtaactactattaactgtttgtaagaagtatcttatgtcaaagtctaacttcttctttttttgtttttattttttatggtggagctgtgagttctttggaattgtgaacattcttttgaaatatggagcccagataaatgaacttcatttggcatactgcctgaagtacgagaagttttcgatatttcgctactttttgaggaaaggttgctcattgggaccatggaaccatatatatgaatttgtaaatcatgcaattaaagcacaagcaaaatataaggagtggttgccacatcttctggttgctggatttgacccactgattctactgtgcaattcttggtaagaaattctaccatagtcgggcttaccctttttgagtgaatatactacctttaatttccttcagttgagatcccagtgtttggagaagggtatctgtgttttgactgtgatggctgaattggggtgaaggagttggtggctgctaataatgagattgaatttaagcacagagtcctgggaaaagataagaggtgactggaaggaggtatgaggggatagatgccagtgagctcttctaagagggatatttcttcgacttctgggcattcctcatgcttctcttaaaatgcctgtaacagaagaaagaatgcttggagctgctttggagatttctgttgtctatccctcagccaaccagactgaatagtcctgccgtacagcatcctgtgtatttgaaacttgtcacccttaataaatactgatttctgaagtatctgagactatagtttgtttacttcaggtagttcctcagaagggcaaccctcagtgagagattatacaaacgccgagtcagaattttttggggggcaagaagaagactctttctattaacctccagcctttgcaaaaattgttagtgtcctaacacaagtaattgtagtagcgagaggactcttggcctaataattcaagtcaaatgagaaaataaaatggaagtcttcaggaaaatagaggacttgttattttatagaatttcaataaaatatctagaagtcttcactttcgtgtttcaattcttaccccgtgtgatgtctgtccctaaggcactaattgtcttcttagaaacactccttgtgtttttctaccaaagctattaactctgattcgatatgacttgcccagtactttcagccttcatgctcctttctggtttctaatttatttatttctgtaaccaaaacatagaaactgtctgatacctactgctgtggtttgaatgtgtctcaaatttcaggtgttggaaacagtcctcaaattcatttgttgatgatatttggaggtgagatatttgggaggtaattaggattagataagatcatcaagatggtgccccagtgatgggactggtgggtggctttataagaagagagactggagctgatatgcttttgttctctcaccgagtgatgacctctgccatgttatgacacagcaagaaggccctcatcagatgggccccttgactttggacttcccagtctccagaactgtaagaaataaatgtactttctttataaattacccagtctcaggtattgagttatagcaacagagaatggactaagacagaaatttggtactgagaagtggggctgttgctcataacgattacctaagaatatagaagtagctttcgaactaggtaatgggtagaggctggtaaagtttggaagaacagtctagaaaaagcctatatttccgtaaatggagtgttaagggtgattctggtgagtgctcataagatgagaagactaggaaagtctcaaccttcttagagattatttaagtggttgtgaccaaaatgttgatagaagtatggatagcaaaggccattatgacaaggtctcagatgacaattagcaataccctgttggaaagtggagtaaaggccatccttgttattaattagtgaagaactgggatgaactgtgtctatgcctaaggactttatggaaggctgaatttaagagtgatgaactaggctatctggtgggagaaataactaagtagcaaagcattcaggctgctgcatggctacttgtggccacttatagagagatgtgagggcaaaggaatgacttaggacataatataattagaagggaagaagagtagaaaattttggaaaattctcagcctggctgtgtggaaaagaatgaaagagaattttcaggagaggaacccaacgttgtgactagcaaccctttgctgagcagatttgtacaaatagaagatatcatcaagacaattagaaaaaaaccttgaaggcattccagagatctttgaggctgtccctcccatcacaggcccagggctctaggaggtcagattggttttcaggagggtttgtggggtggtactaattctgtaggcatgtagaatgcaagagctgtgggggcatggattcctccacctagattccagaggttgttgaaaacagtctgggggctcaggcaagagacctgtcccaggagaagagccactgcagagagcctttctagagcaatgcccagtagaaatatagggttagagctgccacaaagtttctaccagggcaatgcctagaggacccatgggagcagggctgccattgagacctcaggactgtagagctaccagcatgaagtgccatcttgggagagctgaagtctgagcaaagccataggggcgccataggggtgggactgagcctagcaaagtcataggggtggagcttcctgaggtagtggaggctcagcctccatcccagtttatccaggaagccctgaagtggagtcagggaagattatcttggagtctcaaggtaatcctcttgaattttggacttacttgggtcctattactctttgcttcttggatatgtctcccttttggaatgggaatgtttgtcttatgcctgtcccaccattgaattttggaagtagataacttgtttgatttcacaggctcacagctggcaggaatttaaggtaaattatgccttgagtctcatccccctcagataccaaaatctatgtgttactggaaaggggtcccaatctagacccaagagagggttcttggatctcgtgcaagaaagaattcggggcaagtccatagagtaaagtgaaatcatgtttattaacaaagtaagggaacaaaagaatggctatttcataggcagagcagcagcacaggctgctgagctgcttatacttattgttacttcttgattacatgctaaacaaggggtgaattattcatgaatgaattttccaggaaaggggtgggcaagtcccaggactgagggtttccccctttttatactatagggtaacttcctgaagtttccatggcattggtaaactgtcatggggctggtgggagtgtcttctagcatgctaatgcgttataattagcatataatgaacaatgaggatgaccagaggtcactttcatcaccatcttcgttttgatggggtttggccagcttctttaccaagtgctgtttcatcagcaagttctttgtgacctgtatcttgtgcggacctcctgtctcatcctgtgactaagaatgccttaatttcctggggatgtagcccaataggtctcagccttattttacctagcccctattcaagatggagttgctctggttcatacacctctgacacatggatgctcaagtcccttatataaaatagcatagtatttgtgtctagtctatgcacttcctcccatatactttgtcatctctagattacttataatacctaatgccttataaatgctatgtaaatagttgttgtactgtattttaaatttgtgttattttttattgttgtattgttatttttcattattgttgttagtattctcaatctaccattggttgactcttaggatgtggagggctatctatagttctattactcaattttagtaatccttaatcccttgcctaacctgagggatttgtgccaatttttcttgcttcttcctgctcctaaattaggaaaaacctaagcagggggaaaaaatcaaacattgcctattttcctttcctccccagccaactaaatggactacttggaggcagaaggatttatttagctttattctcttagaaggctttgtaatttatcccccctttcccaattctgatactgctcccccattttcccccacttgtgaacagttgagaatttttgtcgcaataagccattgggtgtgtgctgtatttatcggatatgtgaaatagaaaagaattaagaactagtaaagtagaaactattttgaagtaagttgtgaaactttcggtattctgaatgcagaatgccaattacatgttttttactcctgaggagtaactttggttactttatattcattagaaaaaatacagtggaaaatttaactttagcaatgaaaatgcttaacatggtcaaatttttgttcactgatcttttttattgaatgggtaaagccaatgtttacactgcatatgataaatgttttgctttctttgatcaaatttacattcaaagagctattataagaaacattctataaaaattccaatatgttgttaaagtagattttgattgttatttatatcacatgtaggtctgttgcttaatctttgtcacgtaaattataaacatattttctgggtattgcttgtcttaaacagtcttgaaaatgtatctggctgaataattgcctgtcacaatatttaaatgcaagactaagtattcctctgcctgcgcaccccacccccatttaatgggataatagaacataaatgtcatttgtgcatttagttgattaaatgtcactcgtttatgattgtacaactggtctatacaatgtaatggtctctgtagtaaagtaacaatacatttttagtggcattatcagtgttggtaaaataaactcaccgttatattaactaaactgtgcaaacagatttacttgtcatgtatatgttcagataactgcataaaaatgactttgtgtttggtcacagtaagacctaaagtgcattaaggcagaaaaatgaaatcgttaaaaaaaaaaataaagaaccagaaccaagtaacctttggtttgggacccctagaaagtcaaggaaattgtttgtctttgaatatattgtatcatttcatttatcctcagtatttctgataagttgtgatttcactgagatatgctgagaaataaaatgttttcccaagacatctgtgctgccctttaagttcttccttagatgtttgcttattggagaattaagaatttgggaaataattttcataatctttagtccatcatttcaaagatattttgactccaaattaccagaagtgtctttgagatggtgagcttagattgttattcagtttatcttctttccttgtatttcctttccttcttcagttgttgttgctccgtaatacctccaaagaggtgaccttgagaagaatttctgttttggtagtaattactagaagccctagtgacttttttttctccaaccattgtgatggtagggggggtctaattgaatacaggataagtaatcttgttaggatttagagttcttttaaaggtttgactaaattttaaagcttctaaaaatataatactgaagttttcaaatcgtttctggtaataccaatttttcgtataatactttatagttttaaaagtatgtttactatgttatctcatattattttcacatatagttccctgaaatgggcagcttatgtattattctcattttaaaaagcaggagcgagagtttaaataattcaggcaacctgtttataagtagcagaagcagtattaaacatcaagacttttcttaagccagtgctctttccattaggtttcaagtgcttataaattttgggttagcctcttttgagtgggttggtagggaatctgacgttattttgaaagaacagaggaaggcctgtttggaaccccttctttcagtccttaaagacaagtcttattctgttacatcgtttagggctgaatttataatggggggaaggttcttagaggagaacagctgtgcatccctgggagttgggcagaaacaagccatacttgtacacttgtacactcagtttagggataacttggggtgtttgggctttatccttttaggattattaaattatatgtctgtaaggatggtcaatttacatttggcaagatagtccaaatgggaggaaataatggcaaatccactgatgtcattggtgctgtcacccatgagaaggaaagttcctactctctctgaggttcctcttgtcatctcttagacagctacatagaaagtcaattcagttaataggaacctgtagatgattgttaatatcctctgatcttgcctctagttacataaatacttaacatgccctggttttctgtctgccctcctcattgagattttgtaagaataggtatgtggtgtttgtttcaagtacgaacccttggcatgttttgtttctaatattatattaacatcttgctaacataggattgactcagtcagcattgacacccttatcttcactttggagtttactaattggaagacacttgcaccagctgttgaaaggatgctctctgctcgtgcctcaaacgcttggattctacagcaacatattggtaagaaagaataacttttaaacacacttcactacttttccttctcttgcttctctagctgtgttgtaattttaagtgataagattcatcggtgaacacaaattagacataatttgcattttcttatgtgaggaaaagatggggttgttaggggatggctagtaattcccttcagtaaaaatcatatttgattttataatcttagcctaaggaacatataaagaaaagcagatgtttactgatattttaattttatgatatccttttatttttaataaggattatatacacaaaagtaggtcctaaaaatctgcttattctgtactttgtggtcagaaaaatgctaaacttaatttttctctttggaatgtctgtggagttatgttctctgtgtaatattttatcatatctaaaaggaaatgtaaccattctttatacctatccttactgaatgtgtatcagtctgttggtatggtataactgtggagataagctgagtgcacattctgtgaactggttgatattttaaaagactattctagaacaaaatttcaacttacctcacttaaaaaaatttttaagctagttgaaaaaatgaaagaaaacacagtgggggaagattttgcacagggaacaagtttaaactgaacataacatatgcaaagtatccctatttactttttcagatttattttgctttgactatattttgttaaccatattatatgtcttaagttaggaaaattgtttcttcactgctatttttacatgaaatgtaactcttcataaaacattttgaataggtttttaacaagtgaacttattcatatgtagaaatgtgtcttctaatttttggaaaattacatttaagtaaattttctcaatcaaaaacagacattcaggaaaataggcttttgaactgaggtgtattcaaactgttaagagaggtttctgttaaagaaaaagaattgatttggagtctttcagccttctagtatagaatttctttaatgataatgttggaaaactcactctgtgtaactcttaatgttgaaaattgcatctgcttttactaattatgtatctgcagcagtagagaacaaatatctgttcagaacagatagactatggaacaatggatttgagaactaagagtcaaaagaggaagcatatgccaaatgggaaaattattgctacatatcgattagtaaggatatatgagagtttacccttaagaccttaacatatggcaagtttgtccagatgaaggtaaaaattgtgcttgagtactgcattaccctgcagtagactaaatccatcaagggcttcttgtttaattaagtactaggtagagtttgtgtagggtaataatcatcatctattgagagatttttattttggctgaagattcaagaaaacctttctcagaggctttttctgagctaatgtagctaatggttttctggtttgtttctctagccaagccctcttttcttgtttccagtctcatttatcccaactatcttttggacatctccatttgctatctcacatcttgacatatgcaaaattgaacttgttatttttcctacaaattcttctgttttgtctctgtttcctggttcaggagatgaggtggtttgggagtgctgtttaccaagagagcgagttaacactggaagctgtttgttatttcatccatagcataggggtgatttttgccccccctgtagacatttggcaatgtctgcagacatttttttggttgtcacaattgttagggatgctattgccatctaaggggtagaggccagggatgctgccaagcatcctacaatgcacaagacagcctcctacactaaagaattatctggctacaaatgtcagtagcgccgaggttgagaaatctggatccacagtgactcttgtgttgtcctatcgtggaaaggctttttatccctctccttgttacaacctgcttggggaaagcttgtattcttcctcctgcttacattggtctctcagggtattctttggtgcttcctcttctgcagacagtaggtaccattacaatgctggaattttagtaagactgggagaaaaacttagttgcctggctttcagatgggattgtgactctcttcctttctataattcaggtctctcttgggggcaccctttactcatcagtttttaggatactcaatttctgtatgttggtcatcgggactccctcctttaccgggattttgagctacaggatctctagtaagcagaagcatgatcagggttttaatactaatgggctcaaacccagcaggacaactctttgattaacctctttacaaaactgaccttcttgcttttacccctcttcctccaataacttatcataatgttaacaaccgctgccttatcaatatatttaaaaatttttttttgaaaagatacttcttgcacctctgccactgttagtaaactcttagataattcctagcttcctagctccactcagtattcagtatgtatctctagggaaatatttttctcccattttttatttgagcccttttcaagtcctggagatgccatgtacttggtcaaaattattctttcctcccctttttcctccctaagtaagtagcaacttgccatggtagtttataaacaaaagtaacaacgcatttcttgcttctcatcttttaatcattgagtcagatttgtcttcaaaaagtttctagcatcagaaaggaaatgtataccaggtaaaatttagtgagtggttgcagtttcagtaacaatcttttaatcaagtgcctcttacatacctcttagaaacatcagcctaaccacatagcaatagatgtcttactcaaaaaatttgccaactcctggtcaggtctaagtaattaaattcttatagataaaagcacttggctttagttcgtcctgaacctttaatgattagatatatataattctatccagagtgttacaaatggatctggatcctagaagggatcctttaaaggaccccaggaaactctcttgatctttttatttctgtgtttccctgctttgttttgaaaaggatttaaaacagtttatataatacatatatattatcacaaaacagtaaaacagaaattaaaagtagaaggaaaagaaaaacgaaaaaaaaaaggtaggagatggataaaaaatggagtcagggaaagcgtagcaatgggaatttgatacttgtctgttgataggctgtacatttggctctgagctctgttgtcaatgacactaggtgactgggttcataagataaaataaacccattcctcagaatagattttcttggatgctgttacagcttcctagacaatgtcttggtagctgtggtttcttgggactttcttttacatggactgttgttatcataccaaagtacaattcagtaaaagcagttcctacgtagtcattacagtgtggttcaggtacctagacttctgttgctatgacttgaccaagagctagattttagaatatctgtaaatggatggcctgtgtgccttttgagcagttctctctaaatattgtatgtctcaactcagtttttaatttaattaattaattaatttatttatttatttatttggggggacagggtcttgttctgttgaccaggctggagtgcagtggcatgatcatggctcactgcagcctctacctcctgggctcaagcaatcttcccacctcagcctcccgagtagctgggatcatagccatgtggcaccatgcccagctaatttttgtattttttgttgagacagggtttcgccatgttacccgggctgctcttgaactcctcctgggctcaagtgatccttccacctcagcctcccaaagtgctggtattataggcatgagacactgtgcctagcttcagcttagtttttagtagtagtacatagcaatgagttcaaagttatactacctaagaagtatcagagtgcagatattttgtattgcaaattggattgagaacatatgtttaagtaacagttgatcttcaaagtagaagcaaaagaaaaatgaaaaatgaaggttgatctgtggtagggtaagtactccaggaacattatgaggattcctagctaaatatggtgggctaagcaagtatccagtttaagcaaaaatttcccttgaaactttgagcaatgccctagttttgagcaatgttcttttctcacatgcccttcaagataaatcatctgtggtaagtacaccaaggtaactacatatgataatttattttatgagattgttagatgcagaaacaaagcttagggttaggaatcattggtctgtaatcctttctgataataatgaactagcattccagttgtctgctaaagccatttctagtttaggataataaaacctattagtttttaaaagaatatttgtttttctgttttctttagcaagaacatgtatcttgctcagtttataacatatcattaagtcacttgttaaaagatgagagttggaacacaaccttattttatgccaaagaaaaattttaacttttctgctgacttcaaccttatggtaatgctctggtgcaggttctgcatgaacagcagacagaatataatggttaaaggttgaagctctagaattaaatagacatgcctccatcactttctcttttttttttcctttgactacccaaatttattcattttaaacttgacatgatttatcttttttaactcttaatatagcactagaccctctttaaaatttcatggaaataaaggatttatgacatatttaaaatttactggctaaaattttaaaaaaaatttagatcaatttattttaggccattgtaatctggtttatatggtcctagagggataattgtgtaccacaaatcctttttcttttttttttcttacactttaagttctgggatacatgtgcaggacgtgcaggtgtgttatgtaggtatacacgtgctctggtggtttgctgcacccatcaacgcatcttctacattaggtatttctcctaatgctatccctcccctagccccccacctcccaacaggccccagtgtgtgatgttcccctccctgtgtgcatgtgttctcattgttcaactcccacttatgagtgagaaaatgcagtgtttggttttctgttcctgtgttagtttgctgagagcctccatcactttctagctatggagaagttacttatatccctgagctttggtttcctcaattataagaagagatggtaatagtagctacctcatatcattttcacaatagatcttgtcattgtggcaaagacagacctcagttaactgagttccgtttcatttttatcttccctggaacaaagaaagactggatttttcagctttgattgttacatgattgaggcaagtggtcaaagcataaaccattgcatgtaagcactctttgctctccctttccttgctgaagcaatttgaaagctcatgtttgagatggtggttacacaggatggttgacacctgggacactcaagtgtcattttaggagaattgcctgacctgcagaggattttgcatgagcaagaagtaaacctgtgttgtattaagacactggtttttcgggtttatttgttagcatagcataacctagcctatagccaagttaacttacaaccagatcctatcccagagtcagtgaccaaggaaaggtcaataaaaacaacaaataggccaggcgtggtggcttacgcctgtaatcccactttgagaggccgaggtgggaggattgcttgaggccaggagttcaagaccagttgggcaacatggcaagaccccatctctacaaaataaaataagaaaattagccagacatggtggtgaatgactgtagtcccagctgcttgggggaggcataggcaggaggatcgcttgagcccaggagatcaaggctgcagtgagccgtgttcatgccattgtactccagcctggatgacagagcctgatcctgtctcttaaaagataaaaaaagagctacaaataatggagcagtatatacttggtaagagtatttatatgagtgatctatggtgcaataactcaccacttgctccttattttaaacattaatatgcaaagccctaacttacagtttttaaaggacatgttcaataaactaagtttggtgggaagtggggcagtagtgggccttttaaaatatatgggttaaactgtgcagtttgtctatcatgggggccatgatcatagagttaataaagctaaatatttagtgagaatcagagcccattcttcacagtagttcttaactctagattcatttcctctggatgtttttcacctgggtgaggcagtattactaagatctcaatcagtaattgcctgttatcttaaaaaactggacacatgacctttcatttgttgagctggaaactttcaacctcccagacaccagccatgtgtggaccttcacaagtttagcagattcgtgccttggttaacattgcctacattctaccttatttctagatttaagagccagactgggatttttgtttttgtttttgttttttttttagcgagaaatttatagttaaacttgacattttaacagggttccaactgcccacttacaattttaacttcacatagcctcttgttaatccaagttttttgggttttgtttttgtggggaaattcttattaaactagatactaatgggttgtactcacatttgctgggacattttgctgttaaaactattttaaagttatcagcatgtctgttggtacgttaagaaaggagcaattggccaggcgccatggctcatgcctgtaatcccagtactttgggaggccaaggcaggcggatcacctgaggttgggagttcgagaccagcctgacaaacatggagaaacctgtctctactgaaaatacaaaattagccgggtgtggtggcaagcgcctgtaatcccagctactcgggaggctgaggcaggagaatcgcttgattctcctgcaggaggtggaggttgcagtgagccgagattgtgccattgcactccagcccgggcaacaagaatgaaactctgtctctctcaaaaaataaataaataaataaataaggagaaattatggccttagagtaaacagaggtgtttttttttacatgttctaagtatgagatcaccagtattggtttgaaagcccgtcccactctttccacataactactttatttattcactgtaggatatttactaggttcctgtctaaaataagtattatgaaaaagctagtgttaaatatcatctagcttcttagggaactgaacaagattagaaggaaaggtttcttgtagctgcttagatgacagctcccttgaacatgaaaaaattaaaggtgaccaatatataaaaggcacaaaaccgtggctctgaggagggtgttgggggcagtgggtgaaaaattgttaaggggttaatgcagagttcatggtccttggtttgaaaatgagatatacttttattttctctatgatttgtctttcatggttggcctgaattacagaatttagaaccttaaaaattaaaataaccatccagaagtagaactgacccaatcacgagagctctcattttgcccaagtttcctgttggttctcaagatgatcaaaggaagctatagagagtagcacttcaagaggcttcttccatgatacttcagaaagggaaggggagcagaatcatgtgataataacgcggctttaaaaaggctattgtaaaggtagcaccagaacctcacttctgcatccctcttgcctcttctatctgtcatgaccctttttaagggagttcccatgtgacagttccatacaggatcagcccaaggcactggatgaagcttctaagaacagatcatttgtatctattggagattgtggaattttaagacccaccatttcttacataaagaaggactagattgtgtgaaatgtcagccaatgccctttctccaggttaaatgtgtgatctgctctagagtgtgtgattttggggaaaattctttgtaacatggttcatgttttttggatagagattcatagttggtgcagaattcatctggaggagacaaagaattagcagatgcagatcgagaaagagtcacttgccataatcctcatctttttataaggtagtctttccataccacatatatttctttggacttgcttcttagtggctgttaagataatgggccacaaaactgtagcagggaaggttaggaggttagaatatgctaagttggaaataaaattgaaacataaaaagactgtcttctatgatgacattttttattttctctggtgggggaaaggtggacaagtagttccttagtttggtgatcctgcgcagctgctttaattgtagatgagaaagttcttccatttctggagaaacattagttacagttgataggttaccatatatggtcagttctactttgtaattatcctccaaatccattcttcttattccatctcttcttctactgcctttgttgattgcaatgatcatttctgacttacttgacttcagtatactcctgagtgctcagcctctattattctgaaaatcactgttaaataaaatgtgtttgaatataccatgccccttaaaaaagagaatgtaaaagaactcgatttctcccagagtaaaggacaaactctagcaaggcatataagggctcttcatactctggccctttccatgcctccccgtgctgtcccaccatgagtactgcatattagtacttgttttcctaaatactacacttcacagatgtgccaacattttctccaagacattaagatcctctaacattcctcccctgctccttttaacgttattgattcatacttgtagtaattcatctctaaataatctcctcctcagcgttatgtttcctgacactcttctaaccatttcctctctcttttacatattggctacattaagggtctcattaggtttcctaacacctggtacttacctctcaaactgcattgcatttgcagatttttgagagtgcaccctttaaaaacagaagagcatttttcacattctcctcatctgatcagaaaaatatcttctcagcttaagtccatgagatgtttcctataaactggtgagaagacagtgggactaccgaggataaactggctaaatccaaaagtgtttgaagattggttgatgggaggtcagcttctgtctagttgcttccattgacaatacatttttaatgaaatgctctttctcataatcagtgagaaccatgagaatcattatggctgatcctaaaactgttcgtctaaatcgaattctggtaatctcctttattcatgaattaggaattatttactatcaggaatagtaaaagcaataataatgaacttggtttgaaatgattaggtagagtggcataattgaaggtggaaaggtggttaggacagaagctttagcttctcatagtctgtccatttgagaacttctaaccactctgtagtgttagttagtgccaaatgtggaccactggcagaagtcttcagtgaagagaggctttcatggaagtatatttattggtaggcatgtacgaatctagttattaattccttaattagtggattccttgattacatgtcagctgtgtatcagacactggtttaaaatttgtaaatgatatagctaaagcatctacattaaaaaagtagaagaactccaaataacctaatgatgcatcttaaagaactagaaaagccagagcaaaccaaacgcaaaattactagaagaaaagaaataataaagatcagagcagaaataaatgaaattgaagcaaagaaaacaataccaaagttcaatgaaacaaacagttggtttcttgaaaatatacacaaaactaacgaacatttagccagactaagaaaaaaagatccaaataaaatcagagaagaaaaagaagacattataaccgataccgtagaaattcaaaggatcattagaagctactatgccaagaaatgggaaaacctggaagaaacggataaattcctcgacacatacaatcttccaagattgaacaatgaagaagtccaaaacctgagcagaccaataacaagtaataagattgaagctgtaataaaaatttcccagcaaaaaaaaagttcaggacctgatggcttcactgctgaattttaccaaatatttaaagaagaactaataccaatcctcctgaaactattctgaaaaatagaggaggaaatatttccaaatgtactgtatgaggccagtattaccctgatacccaaaccagacaaagacacatcaaaaacaaaacaaaacaaaaccaaaaaaaaaacactacaggccagtatccctgatgaatattgatactcaacaaaatactagcaaaccgaattctacaacacatttaaaagatcattcgtcatgaccaagtggaatctatcccagggatgcaagcgtggttcaacatatgcagatcaatcagtgtggtacgttatatcaacaaagtgaaggacaaaacccatatgatcatttcaattgatgctgaaaaaatatcggataaaattcaacatctcttcatgacaaaaccctcaaaaaaccgggtatgcctcaattcagtaaacaccgtttatgacagacccacagctcatatcatagtgaaagggggaaatacttgaagcttttcctctaagatctggaacatgacaaagatgcccactttcaccactatgattcaacacagtagtggaagtcctagttagagcagtcagacaagagaaagaaagaaagggcatccaagttggaatggaagaagtcaaaatgtccttgtttgcagatgatatgattttatatttggaaaaacctaaagactccaccaaaaacctattagaactgatgaacagattcaataagttttcaggatacaaaatcaacatacaaaaattggcgcatttatttatgccagcagtgaacaggctgggcgcagtggctcacacctgtaatcccagcactttgggaggccgaggtgggtggatcacctgaggtcaggagttcgagaccagcctggccaatatggtgaaaccccatctctactaaaaatacaaaaattagccgggcgtggtggtaggcacctgtaatcccagctactcaagaggttgaggcaggagaatcacttgaacccgagaggtggaggttgcagtgagccgagatcgcaccactgcactccagcctgggtgacagagcaagactccatctcaaaataaaagcaaaaagtgaacaatctgaaaaagaaataaaaaattaatctcatttacaatagcaacaaataaaataaaatacctaggaattagtgtgaccaaagaagtgagagatctctacaatgaaagctgtaaaacactgatgaaagaaattaaagaggatacatcaaaagaggaaatacattctgtgttcattgattgaaagaatcaatattgttaaaatggccatactacttaaagcaatctacagattcaatgcaattcctatcaaaataccaatgacattcttcacagaaatagaaaaagcaatcctaatttttttttttttttttttgagacggagtctcgttttgtcacccaggctgaagtgcagtggcatgatctcggctcactgcaacctctgcctcccggattcaagcaattctcctgcctcagcctcccaagtagctggggttacaggcatgtgccaccatgcctggctaatttttttgtacttttagtagagacgaggtttcaccatattggccaggctggtctcgaactcctgactttgtgatccacccacctcaccctcccaaagtgctgggattacaggcatgagccaccgcgcccagccagcaatcctaaaatttatatggacccacaaaagactcataatagccaaagctatcctgagcaaaaagaacaaaactggaggaatcagattaccttacttcaaattgtactacaaagccatagtaactaaaacagcctggtactggcataaacacagacacatagaccaatgaaacagaatagagaacccagaaacaaatacagaaacctacagtgaactcattttcaacaaaggtgccaagaacatacattggggaaaggacagtctctttattaaatggtgctgggaaaactggatatccatatgcagaagaataaaactagacccctatctctggccatatacaaaaatcaaataaaaatgcattaaagagtttaagacctctaactactaaaagaaaacattggggaaactctctagtacattgaactgggcaaaggtttcttgagaaataccccacaagcacaggcaaccaaaacaaaaatggacataggggatcacatcaagtttaaaagtttctgatgcacagcaaaggaaacggtcaacaaagagaagagacggcccacagaaggggagaaagtatttggagtttcctcaaaaaactaaaaatagacctaccatatgatccagcagtcccactgctgggtatatacccaaaagagaggaaatcagtatattgaagagaaaatgtttattgcagcactattcacagtagctaagatttagaagcaactggtgtccattaaaagatcaatggataaagaaactgtgatacatatacacaacagagtactattcaaccataaaaaagaatgagagcctgtcatttgcaacaaaatggatagaactggaggtcattatagtaagtaaaataagctaggcacagaaagacaaacttagcatgttctcacttttttacggagctaaaaattaaagtggttgaattcatggagatacaaagtagaagtctgggaaaggtagtggggatggggggtgagaggtggggatggttggtgagaggtggggatggttaatggatacaaaaatatagttagaatgaataagatctatttgatatcacaatagagtgtctaaggtcaacaatttattgtacatttttcaacaagtgaaagagtataattggatagtttgtaacacaaagaaaggataaatgcttgaggcaatgaataccccatttaccctgatatgattattatgcattgcatgcctgtatcaaagtatctcatgtaccccataaatatatacacctactatgtgcccacacaatttaaaaataaaaaagttttaaaaataaaaataaattctgttttaaaaagaagacacacatccagccaacaatcatatgaaaaaaagttcgacatcactgatcattagagaaatccaaatcaaaaccacaatgagataccatctcatagcagtcagaatggttattactaaaaggtagaaaataatagatgctggcgaggttgcatagaaaaagaaacacttatacactgttgatggaagtgtaaactacttcaaccgttgggaagacagtgtggcaattcctcaaagacctaaaagcagacatactgttcgatccagcaatcccataactgggtatatacccttaggaatagaaatctttctgtcataaagacacatgtacacatatgttccttgcagtgctattcacagtaacaaagacatggaatcaacctaaatgcccatcagtggtagagtgcataaagaaaatgtggtacatacgcaccatggattagaatgcagccataaaaaaagaatgaaatcatgtcctttgcaggaacagaggtggagctggaggccattatccttagcaaactaatgcaggaacagaaaaccatgtactacatgttcccacttataagtgggagcaaaatgatgagaacctagggacacgtagaagggaacaacagacactgtggcctatgttgtgggtggaaggaaggagaggaccaggaaaaaataacgaatgagtactaggcttaatacctgggtgacaaaataatctgtacaacaagcccccatgaaacaagtttatctacgtaatgaacttacacatgtacccctgaacttaaaaattaaatttaaaaaaattatgtgaatgaaaaaataaagtgaacatagttctttgattagtacagtggctaaaagggaaggattcagggttgtggcagagttttctttttgagatgggaggagcttgatcatgttttatagatcaagagggtctcagtttataaaacgacatcaaagattcagagataaaagggataatttgtgtaatgaaatttcgtgtaggccagttggagacgggattagcctcaggtagacccatttctttgagatggagaagaaagatgaggatgggctggacagagataaatttgtagcttggggattggaagctcagaaaaaaaaagcccataagaccagtttttactgtgaagttgggagtaaagtcttgctgaggaggagattgaagtgagaattgggtaggggacttggtgttttggaatggttgctgtgggaaaccaattgagaaccattgaaagatttgcagagcaaaaccctgcaggtctggtagaggttggaagtggaaccagttcatgtagttgtattttccagcattgcttagttttctttgtattggggtgcagaagcaaaatggttagattgatcctgggtattgtcagaacagggataaaggaactgaggataaaataattgaagtgatgggcccatggaatccagtctagataggaaaagaaatgagaaaggatgggacctgaaggatgagataggggaggagttgggacctgaggtctccatgatgttaaagattgggtgtggcaataagggagagcaaactctggaagaatagaaactggtgtctgttggagtttaaagacagaagcgtggatctgaagtggtgcacaagaagtataagaatgctaacattgccccccagaccttgcaacaggtgtagcaaggcatggaaaatgagaagattgtattttcaaaattggccaaggaagtaatttccttgcaagaatcaggcttttgtgaggagaagagggggaggcagaatgttctatacagagttcatggtagaatggggattcccgaggacttatctctcttcccatcctccacttagcatacatggcccagtgccttgtacctacatatccgtaggggttacatcaggatttcccaaagtcgggtgcatggggttgactgtgccaccacatttgtggtgtgctatagtgaatttttgttcatatgtgattgcttagtgcacctataatgatattttgtagttttaatttaaccacttctcacaaattggtcaagtggcttaaaacgatttctgtaaagaagtagtattttctgtagataatattaaaagtgcaagcacaagtgaaccaacataatcatcgtagagctgcattctcttgttatttaccaggcatgttatgtgataaaaatgatgaccacctgggttaccgggttgaaggcgggatggttgtggggaaatgaaaagatgtaggtcaaagggtataaagctgcagttttgtaggatgaggaagttctagagatcatgagaactatagttaaaaatactgtgttgtgtactggtaatttaccaagatagtaaattttaggcacacacatgcacacacacacacacaccagcaaggtaactatatgagatgatgggtatattaatgtttgtttgactgtagtaatcacttcattatggtaggtatatcaacataagcatacaaaacatcacattgtacactttaaatatatacaataaaataataaaaattttaaaaagctaaaaagagctaaaataaaaatgactaccacctaattgcaactgacaaatataaaattatcaagaaaatatttaaaatatagtctcacctttactttaacagtgagccttgtccttaacatgtagtgtgccttgagataattagctaatggaagaaccatactcagcaagacactctaatctacacattcggaacatgagggcaaaccctgtgatttttttttctcaatgttttaagtcctaggatgcccagtgcattattttttacaaaatttactaaacataatgataaaggcttagaactctttttgagttttcttattcaatagcaaaagacaaaaagtcacagaccattggggaaactcatgttcctcctgccacagtaaaactggctgaaataatatgaggacaaaacaaaatgcattccttattagcaaatgttgttaaaggagcatagaaaacactgctaaagcattaaagcagagtttttttttaaaaaaaacctgcagatagaaagtttggtgtactaagttggaaggagatttgtggtatttataacatgttacaacttagggtatttgttaagattctctttcagtgagagaataggcaattttttaagagctgctaaaggaaaaatgcaccagaaaagagatacagtgaggtgtattaacaacggggatacagtctgagaagtgctttgttaggcgattttgtcattgtgcaaatattataaagtattcttatataaactagatggtagagcctactacacacctgaggctacatagtatagcctattgctcctaggccacaaacttgtacagcatgttactgtgctgaatactataggcagttgtaacacattggtaagtatttgtgtttctaaacataggaaaagtacagtaaaaatacagtataggccgggcgcggtggctcacacctgtaatcccagcactttgggaggctgaggcgggtggatcacctgaggtcaggagtttgagaccagcctggccaacatggcgaaatcctgtctctaccaaaaatacaaaaattaatcgggcatggtggcaggcgcctgtaatcccagcaactcgggaggctgaggcaggagaattgcttgaacctgggaggcaaagttgcagtgagctgagatcgtgccactgcactccagcctggtgacagagtgagactccgtctcaaaacaaaacaaaacgaacaaacaaaacagcacaaaagatgaaaaatggtagatctgtatagggcacttactaggaatggaacttgcaggactggaaattgctctgggtgatatcaatgagtgagtggagagtgaatgtgaaggcctcagacattactgtatgctactgtatactttaacgccatatacttaggccacactaaatttataaaaaaattagttgatgttatgacacctgtgacatcactagataataataatttttcagctccattataatcttgtggggccaccatcgtatatgtggtccgtcgtttactaaaatatccttacgcagtgtatgcctgtattggcaacagtaatggcttatttaacagaatgatgtgttttggaaaaggtgtgtaagaatgaccattgaaggagtggtggctgcttttctccaaatgtaaggtaatggagataacatgaaatgagtttactacatcattcataggctagtataggagaagagttgaatccagaattgcacgaagtagtatcactgtggatactttcctaaagcatgacctttaaaatatattagagtctttgcagtactttataatgaggtgggagtgaccatagttattgtttatacatccatagttttgctcattgtctgtgatacaatatataaaagaacccttaagctcaaaggtaaattatgtgcttttcttttacaaaaatacagcttttccaattttcttgagctttttctttcttggtgataaatagctatgcaacctaccatgtattttgtaaaaattctgttgatttagggaagagatgacattttaactgagtgagaagtaactgccttctgaaaggaactcccctccatgccctgcaatgcaggttaaagccaagcaatgaaagaaacttttgctatgtggagatgattttgaaaataggtactaggaaatatttttattgttacgttattttcttgtgaaaagtagtatatatcacctggaaaaactctttcattgacatacttaaaacacttggaaatagttcccctttgttttgaactccatttagtaaaaatgcaaaactttctgattagcttataaactgattgatatcaggaaaaaatagaaatttaccagatgaattttgacaataactttttcataattgctagataggctagatagaatcctgatttagttcagctaagccacagtgtacttctcccatttagaccttatttcagctacatccatgtatcagaataaactgggcttagaaccaactctttgaattgctagatcactaagaattacattaataaagcctagtcaatcaccttgttcttgttaaaatattaatatttaaaggagtcttatacctttaaaaatgaaattatttaaagtatatatcttattttatattggcttattttattttatagtacaaataatgtttggttaatagtatacatgtaatttatatgtaaaatatatattggattctgtggtcagagactttactaatttagtgtgtaatcaaaacatttggagatcactagattctgtggtgcctgggatttgtgtggtgtttcactttatgaaatgcttttgcaaatgtgttccaacttgaacatcatcaacagccttttgatgcagggaagtgtcattatgcccattttgtagatgaggcattattctcattttatggaaaggtaactgaaagtcagaatatttagatgacttgcccagggtcacacagctagttaatagtggcacctcagcgccagcacaggtgttactactagatggtgcttttccatttaatccattcattgcctctactggtcattcctttatactggccattcctattgttttgacttcatgtcctaatctattacttgtttttcagagttctcaggtacttgctttttgtgttttttctagcggttttagttatagtcaatgagagagacaacacaagtaaattaagaaaaactgggaacaaaaggatggataccaacgagaaagacaatatattaatgatgaaaataaaaatggtagtaggtgtctcagaagtcagataaatgcatttgatgtgcaaaacatttcaaaggaaccagagaaatgtagttcaggcagataggttgtttgaacattggcctgagggaaggctaaagatgaatgtagaaaatatagtgggtgtgtatgatatagatatagttttgtgctatagtaaagttggcatttataagcataatgaattaagaattgtgacgtttattttgatcattgtgtgtgcttttgattttaacaaaactttgtataacaacatgtagtcttctattttgattgttctgccagtacatataacaaaatgaacaaaatagaggaattctgtataggaattaaaagttaaatattactcatctgctaatagatctatggataaactaagtttaacatattgaataaaaatgattgggtcagaaaagtgacttagaagtgtagcatggtttcagacgtcattttctaggttacaatcactgccataatccaagaacatggagatgtatttaacaaaactaaaatatagttttaataggttttcatgaaagtatgttttacatacagcttctgtggcctttttcgtattataaattcaaggcatggcttgatcttctagcctagtggcaacacgtctggaaataactatgcatcactaaaactttcatagggattttgtgtgctttgaaatattgcatatatggttataaaattcccttagtatttactggcatattaaacaaaaatggcactgacaggcatattattgtctgtgttaataatctacacatgaaacactccctcagttcagctgaacatagttcttacctctaattgttcattaggccagtgatctgttgtgctcttagaaggaaaaccaaaatggtgcaattaaaatttgaaccaatacctgaagtagctatacttttccttttttattattaaatggaaagatattctgaaatttatgatagtttcagtggtttagaagatgttggagaattatattgagcttatcatagtttaaagaaccctggactgggagtcaaatcattgagatctagttaacaacagctatgttgttgatgtgccacatctcagtgggcaagtcagttacgcttctcctaacaaatgcgaactggtctagtgtggcttgatcactaatggttaagcttctacacataattagcataaacaaatgatttattaagctttaaagatagacctccagtgatgtagtcacataatctagaaaagctggtcagcactacattaagttttagggtatctggaggaatcttcccagtcagcccatagaattttaagccagtgtagtctgtccactctgagaagctggagcatcattaaggatcccttatctccatgtgagcagctctcctccgggttgcacagccatcctttatcttccttctggttgtgtagtaagtattcatgttcctaagaatgtgcagaatgaagagattcaatttaacagatgcctgttaaactctaactgaatataagtagaaattctctttaaaaacacacactggattaaacagtcttgtcattttctctttcatttccatctgactatgtccattggcatgctctgtgtttgcagctggccagctacactctagaatgccagtgttcctaccagcagaggtgtgtgcttaccaaacagcagttatgcttatttctgaaactttttattacgttgtgcatattattggagttaaataattccagattgcacaagctaatgaattatgagtgtgaaaagagaatcattgttgctgttaaggcaaagtagaatgcaaaagacttgataaagataagcacagaacagaaatagatattgaattagacgtggctacaacaactgaaagcaaaaaaacctgtaaaaatatggaaggattatgcactcaccttgtttcatacatgcctttaaatccatgctgtaactcaaagaaagtgaaactgtgtccttatttatatagtggtgagtaaaaaatacataaataaactgcaagccatagatgttgcattctagatgtgttcatgtatccattttaaattagaatgtttaaagtatgtatggttgttgtggtcacctgctttaaggtgagtttctattaactgaccaattattgttcatgatcctactaagagggcttccttatacttgatagttgaacatagtcaatctacttaaacctttggaaaacggtggtgtttgcagcttgggcctgctttccatatgtattcctgcaacttcctccagtggcccctttacctgtgtcttcccatctttcatgtgagaaccatcatttctcctttaagtttacagaaaagtgtcaaatttaagtaagatatggatatgaaaaaagttagaaataaatgtgcgtgctatatactatagatactgtaatcttattatttataatagggaatctatgactcatgatttaagaaaatgcccagcttagacttaggttttatgtacaaaatcgataacttttgctttcttatttggcattttgaaacaccagtttgagtgatttctttaattctgaataaactaaactaaacctaaactagtaaactaaaaacgatgatgagttaacttctatggcttggaagatattgaagatgttagagaattaattggtctcaagccctatgggtattagagtttaaagaaccctatacctggaatcagactagctggtctggtatcagctgtgctcttgatagtacttgtctttgatgctctgatcctggtctgttcatcattgttaaatttcacagggatttataaaagatttcttgaattaacaaaaggctttggtccgattcacataaaagcagacattaacttctttatttaacacttttcatcttggaaaatgaaactgctatcatatgattcttttctttttttttttgagaaggagtttccctcttgttgcccaggctggagtgcagtggcatgatctcggctcactgcaacctccgcctcccaggttcaagcaattattttgcctcagcctccctagtaggtgggattacaggcatgtgccaccacgccaagctaattttgtatttttagtagagacgttgtttcaccatgttggtcaggctggttttgaactcctgacgtcaggtgatctgcccgcctcagcctcccaaagtactgggattacaggcatgagccaccgcgcctggcctatcatacagttcttaattatgtgcatttgaattgtcctttaattggtagttagcttttggctgcactgccttgccagatacacacacacacacacacacacacacacacacacacacacacacacgctttgggttcagatagatctgagtttgaatcctggctctgctgcttactagctctgtgactttggaaagttgtttttttaaatttctacaacagcctgataatatatacttcatgaagttaatgaagataaaaagagaatttgagtgaagtacatgggcttatggcatagaaggcactcagtaaatactccctttctctcagagtcaattaaaaattttcattttatgttatggataaaaaggaaaacttgcaagctgtacatctattcacttgatgtgataggtctggaaaccatttgtaatgaaatagattaagaggaaggtagcatttgctattgtgagcttccaccatttctaaagttggttcatccatttcttaagtgcaggtattaacagatctttagaatttgagcatttagtgtttgcggccctggatactgactttgaatgtgtggccaacaaactgaagggagaggagccagttgaaggctgtagaaaagaataaataaggtttattgtggtcatactgactcaaagtagtcttctttcaagcaatatatcacttttattactaagagttgggggaaaaaaaaatttacctttatgtgctattacatctttctgtttaaaaaagtttcaccttgctttttttgtttctccagccactgttccatccctgacccatctttgtcgtttggaaattcggtccagtctaaaatcagaacgtctacggtctgacagttatattagtcagctgccacttcccagaagcctacataattatttgctctatgaagacgttctgaggatgtatgaagttccagaactggcagctattcaagatggataaatcagtgaaactacttaacacagctaatttttttctctgaaaaatcatcgagacaaaagagccacagagtacaagtttttatgattttatagtcaaaagatgattattgattgtgagataggttaggttttggggggccagtagttcagtgagaatgtttatgtttacaactagccttcccagtaaaaaaaaaaaaaaaaaaaaaaaaaattgtaaacatcacttatattactttattgcagcttcatcaccagtacattatatgttgtaatatttatttacctgatcattttgatcattttctgctttattttgctaataaactgtgatgttacttctagtgctaaacatggcatatttccacctatgattcgtgtttacctggtattaggagctcagaatggaatgcataaagcttcactggaagtgtatacaactgtggtgtagaatctgttattattatcattattattttatttagacttgactatctcttatgtttattaaagaacatgttttcctattcagttgctttttttttttttttttttttggagacagaatcttgcattgtcaccgaggctggagtgcagtggtgcaatctcggctcactgcaacctctgccccagggtaattcagtcacttttatgaagaattgatactcattgccgtttcacatgtaaactcacaggaaaaaattactttgaaagaacatagaaaatcaatcatattgctgggttttcccttccagtttcttttcattctttggcaaaacaaacaaacaaacaaaaccaaccaacccaattctaatctgcaaaggcaagaacagccctaaactcaaagatgtgctcagctgggaaaaaaaatggtttcagttttgagataaatgggcatgttagcacaattaggattttaatcaggagactgagaggggcatgtctgtggcaccatctttaaagaaagaaaggggccgggcgtggtgactcacgcccttaatcccagcactttgggaggccaaggcaggcggatcacgaggtcaggagattgagaccatcctggctaacatggtgaaaccccatctgtactaaaaatacaaaaaaattatctgtgcatggtgatgggtgcctgtagtcccaactaccctggaggctgaggcagtagaatggcgtgaacctgggagacggagcttgcagtgagccgagatggcgccactgcactccagcctgggagacagagtgagactccgtctcgaaagaaagaaaggtaggtattaccgagttacttagtattatatataaaattcaggttccattcagctctagaatcattgagcagctttgttcctatgaagcagtaatagccagttctactaatattatggtgtttttccttcttattatctagataagctgtcaaacagtccatgaaataaagacctcagaatcctagattaatgaggcgccacctcatgggtttttacaattgcttgatctaaatctagagtcaggaagaactaaacgctggatcaagtgagccatgataagaggctatagagagtgaccttgagaaaaaggttatgagagcattactgtcacagtagactaccaggaggcaatgtcttctgtcctgttgggatcctgtggcttaaaatagatgagagcgggccagctgtgcctgtttctgatagacgtttggtgtttggcaaaagcagtgatgaaggtggaccaaacaaggatgacatcactaagacccaaagggatgactgagctgttacctcagactagaactgcctgtgggttggagataagagtttgaatgtgggtgtacaggcagaaataaggttgcatatagaaaaccaggtggacattctgataatttcatatggaaattccaaaactgtgtatattgtatagtattttttaaatgtcataatctttattttctaaaccctaagtctctgatttgtaagatagcacccagctttttcttgggggaaaatgtatgtagaatgtttaatttttttttttaatttttatctatttctataggttgctggggaacaggtagcatttggttacatgagtaagttctttagtggtgatgtgtgagattttggtgcacccatcacccaagcagtgtacactgtacccaatatgtagtcttttttttttttttttaataagtagacagtttatttgggtcaagtttaaggattataacctgggagcaaagactcaagttgcctggaatctacactttgattagcagcagttgccaatgtgtagtcttttatccctcaccctcctctcaccctttccctgagtccccaaaatcccctgtattattcttacgcctttgcatcctcatggcttagctcccactcatgaccgagaacatacgatgtttgattttccatttctcagttacttcacttagaataatggtctccaattccatccaggttgccgcagatgtaattatttcacttttttttt

SEQ ID NO: 17412 - DNA, 8190 bp, Human
ccattgcttctttgcatataatcagtacacaattaatactggacagtggaatctttaatttcagtctccttgactccttctgcatcctcttttggagtcctgtggccaggggacggtacagggaattttaatgacgagaagacagggctggtttcccccttagcagacatatatgtttgcagcatcagaagtctagggctggaagctacctttgacatcatttcctctgcgaatgcatgtataatttctacagaacctattagaaaggatcacccagcctctgcttttgtacaactttcccttaaaaaactgccaattccactgctgtttggcccaatagtgagaactttttcctgctgcctcttggtgcttttgcctatggcccctattctgcctgctgaagacactcttgccagcatggacttaaacccctccagctctgacaatcctctttctcttttgttttacatgaagggtctggcagccaaagcaatcactcaaagttcaaaccttatcattttttgctttgttcctcttggccttggttttgtacatcagctttgaaaataccatcccagggttaatgctggggttaatttataactaagagtgctctagttttgcaatacaggacatgctataaaaatggaaagatgttgctttctgagagatgcaggtggattcttgggcatttgctgtaagtactttttttctctttggaaactttgaacatctctatcagcaagtcagagtcccaaataaccaagttggcaagtcagagtcccaaaccaaattcctggctctaggggtgaaggtctaagtgtggtcatctaataattgactttctaccagcctcagtgacttttaaagaaagaggactctgatgatgatatggagattggatagagtggtgaacaaagggggttggtatggaggatataggagatggtgtgatctgttaggagctgatatagtagctcaggccatgaactgagaggcagaggcagcaggaatgaagagaagggagaagttttgagagttatttaagagttagtattcataagacatcatgcttcattagatatggggaatgagaataaaaggaggctatgattattcccaggtatctggcttaggtgtctctatagacagtgatgtgataaactgagatgtggaatgaagatgagggagcaagcttaaggtgtagggagatgatatgtttacatctggcaactttgagattttcttattgagactgaggtctgtgtggaccatcctggtggttatatccaaaagaaagctggataaatggctaggagctcaggagagcaatctgagagagatacagtttctagcaattgagtgcggagggtaagatcactcaggaagaagatggagggtggaggaaggatcctttttctgagttcatagacctcttccttctaagcacacatgtccactttcattggatttccacacctgacttctttactccatttctttgcactctttcaggatcagagaaccttacaccttatctttctggctttctttataataattaaaagtaacatgcataggtgtaagaataatagtgttaagatgtcttacaacttagaaatgactgtttagatgttactaagattaatggtgaaagaaatgtaaaatttagaaaattattctttcattttctggttgttcgaaaatacctctatggcttccatgcattgcaaaatgcatgaatttcagctcatgaccttgtacgtggctccataaaccaccacccatccattccaactaatcatatattgtacaaattactttcattttgtcttttagccaaataagatgcgagtgttctctcatctcatagattttatcttaagaaaatgccagatgaaaaaaaaaatctaaaattctaatctacaatgaataatgtatacagagggagtactagtttaacctaagaatatcccctctctccaaaaggctgcctctagttcagaaaaaaagtgattcaatttccataaatttaatttactcacagcgttttcataatgttgctataacatctgaatgacagtccatggcattatttccgtggttgcagcaagccacttctcctactccctgtccatattagatgcatctcctgtttttcaagggagagaaacccctgctcagcccctgatgagcacatcatcaaatatttactattgttttattaatcaatgtgggtggttattatgtgtctctggctcagggagtgtttcatccaactaagctccctcagtggttgtctcacttcatctcttatagattaacttccttccaaaatgtcaccattcctgtatctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccatcatggtcttagtgaactatattcactttaaaggtaagactttcagatgtcaattttcagtctagggctcagatacttgggtggagtgctgaggggagctcatggtctcttattactggcatcagtaggtgtccctcataccacagtgatctgctccactggacatagctgtgaatagtattggatcttccaagatggacacacagctctgtgaatgagtccaggaaatttctagggagagcgccctttcagagaggtgggtgacaatggtatgaacatcttgctcataattggctaaagattcatggtttccaaaagatttggtgaggtgggacaagcttgcacttgtcaagtagacatatttgtatgtaaagcctactgtgattctcacttgctgtacatacttaggcatgttacatacataattttaccatgtattatgcactcactgtgtactaaacaccatctgacatgtgtggtatacacacactgtctcaatcaatactcataagtgtccaagtttacacagttaataagttttagaactgatattaccaacaaggtctgtgtgagtctaaagctggtgcttgtagaaacaagaatcatgtgactatttcctaaaggtactgtgctcaaatgatttctcctggttctatagtatatgtcagccacatttcttggaggagtaatcaattgtcggccacaaaccacacatagatagattggctaaaattgcagaacagatctgttttctcacttctccctagtgtgttggatgtcgttatacctttttatggaagaggaaactatggctctgatgggcttagtgtggtatagtagttttgaatacagactgtggagcccaacagccctgggtatgattcctggctctgccacctgttaactgggagaccatgacaaatgactttctctgcctgatcctcagtcacttgtaaaactgattgactgtaggtacctaactctgtggtgatcttaatttctaaatgaaatcactaatggaaaaggtcttgttggtactgataccggtttaaaataaacacctctcttttctttgtattttaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaaggggtaaatgccttagaggatgtgtgggtggaaggtgggcataaaagtgcaggtgagacagagttcagcagaaacccagaggcagaagaatcaccctgaactacccaacagctatgtatgatcactagaatatgccaagaaaatactgtctaccaggcccttggctgggcattctacatacttcatatcatccaagcacatcaacaaacctacaaaggaggcagtataattggcatttttcaaattaggaagtctggtcttgaaagataagatgagctccccaaagtcagcctattagtaaattgatggcttcctgtagaccaactagagctcaaagaacaggttggattttgatgttgaaaggtgattgggcagccactctgtactggaagtgcaaggcagaaaactgtgaagctcctgggtgctacccattaaccttcatgccactagctccccaaccttggtcgtcacctcagggatattttctcttgattataaaggagttacatctccctactcccagtgcttcagtccaacattggctgtacctgagtgcattcctttcagaataacttctgtgagtttggtgccatgtattgacttacatagtaatggttatcaatactcagggaagaagcagagtccaatataataccatcatgagagagagaaggagagaatcataagcttgatatggtgattgccatgtgttcccttcctcttttcccacagatgggttgacttgtttgttccaaagttttccatttctgccacatatgaccttggagccacacttttgaagatgggcattcagcatgcctattctgaaaatgctgatttttctggactcacagaggacaatggtctgaaactttccaatgtaagttgataaactagagttcttaaatgtatgaactggaagagcaattaggagtcaattgattcaactttcttattttaccaattagcaatctgatgcctagagaggcggtgtgactcctcctaagctagaatcactccagagtcattcccattactccaaataagtaattgtatcagtttcttccatccttgacctttatgtcccagaattactctgatagaacagcttaatgatcagaagtgactctggtgagatgcagttctgaaggaggtgtgaggagggaatgcttaagaggtgactcctggcggcagcaggccatagtgaatgaggtgtttcccaatggctagccgtagaatcgccagagaatgattgactacatttagcagaggaaacttcatattctagcaccatcaacatagtatagcaaaggggcggccccacctttcctttccctttcttacttctagaccttcccaaagactgttcctgtttcttcagagacccgcaggatttgttctccccacacaggctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcccttttctgtcttctggggaatagctaaaaagcaggtcaggtcttcgtatcccagtactccaataagatcaatggacataaaacaatgcagatgcattgtcttatatgtgaacttctcaacccccttcccactgtcccattagtaggattctctgagttcttgccagatctgacactggtaggttgaataaaggaactcccactatggggatgagttacagactgagacaactgaacaagttactgaacaagcatgggacaatacagcaagagataaacttgcctgtccaaccccaccttccccccaagaaaacatacttccaccttgccaatgtataagctgggagtggagaaagaaagtaattcattcatgtcatatctcatagaccctctttttctgtatcccaatcagactcctttccatatatagcacccctgtcccacttgtttaagtaggaatctcctttttggctctaatttcactgaatattggtacttttgtatccccagatccttcaacaaccttccctctacctgtacatgccaactcattaccacctaccaaactagattttatttcagacactatgtatttaaagcttgagtataaatggcacagtgagtggtaatgatgtagtatctgaaattctagccctgaggtaaaacacttcagtgacaggaaaatagtaaaaaaaatgcataagtactgttgcagatgttgtacttccatattgaaataaatatttatgtttagaaaagcatgtgtattacaaacattctaattttttctgattagacccatttgcatggaagtttgtttattcctggtatagttcacactttgcttttgtgtaagcaatttttgaagcccagagcagaatctctggtacaaaaattcattgttaacatggagttgtgtttcactaaagttacattacaatcctggccctgctacttagtgtttggtgatcttggacaaggcacttaaaccctgtaccttattttcttcatctgtaaaatgggaacaataagaatatccatgtcattgggattttgtgaaccttcaatgttgcaaagcaggtagcatgtaatatgctcatcacagagcctgagacctgataaaaagccctgtaaatattagttgtttcaatcatgttggtcaacaccagacagtgggctggtatcagaaccaggattgtaatgtgagtctcttgatttgcgggtttctgttctctagctcaggctctacctccagaggccagagtaaatgtaaatatcaactccttcctaccccctaccgtccaaatgagttccatcagaacttgttctggaaggaatatcagtatcttcagagggaagtcagggattaaaagacattatccctcaagtagttcatgtgtctccttagagactaaacctcattcagtcattctttcctgtggtcagatcatgaagggctatcactgtttgtcctgtgacaaactaagaatagcaaactaagaatagaacataacttccttaacctcatgaagtttacccacaaaataactagaacatgtatctcacttaatagagaaaatttgtagcagaatttttactaaattgggaataagacaaggattctatatattattgcttttatttaaaatgatattggagatgttagtgcagtaaaacaagaaaaataaataaacattaaaagaatagagtggaaaggaagaaaaatctgtctacacagaaaaaccaagaaaatatattaacgaattcttagaacaaaagacagaaaacttatctgggaaccagccacaagaaagcagtggtatggattgcacggaatttatcaattctgctttcctttctacattgtgatagaattatagacacacggcttccctgataaactacatgttctagcctccctagcagttaggtgtggccttgtaagtaaattctcaacaatgaaatatgaatgtaggtgacatataacatct

SEQ ID NO: 17413 - DNA, 15507 bp, Human
gcgccactgcactccagcctgggggacagagcaagactccgtctcaaaaagaaaaaaaaagaaagaaagaaaaactaaaagggccaagcgcagtggctcatacttgtaatcctagcattttggaaggccgaggcaggaggatcacatgagctcaggagttcaagaccagcctgggcaacatagtgagacacccatctcaacaaaaaatataaaaactagcccagcatggtggcctgcacccacctgtagttccacctactcaggtggctgaggtggaagaatcacttgagcatgggaggttgaggctgcagtgagttatatagaaccactgcattccagcctgggtgacagagcaagactctgtctaaaaaaaaaaagtctttgctggctctccagtgtttccctacagagttcaaactcctgggcagtgtgtataatgcctttcaaaatgtaacctttccccagccttcgatcctttcttattactctgtaagatccaaactgtgaacttggcttcctaagcgacttgctttttcttgcttcactgcctttgcacgtgaggttcccactgagagaaaccctaactagactttcaagactcaattcaagctttttcatttttccttcaagctttcacagtcccctgcctcccagaacctgggctagatgccacgtctccctgttcccaggcgctgtgcttccctctgccatagcacaaatcacaaatcacagtaaaatacagtgttaggtctgcgtttctgccccccttccagaaaaagccaatgcttggataagaggggtctttctcctcttcatccccagcgcccggcttggagcaggcaccaataaaacgtgaatgaagggtcaacgccaggacccgagggctgaggaagggatttacgaggaatagctggggccgggcgcggcagctcacgcctgtaatcccagcactttggaaggcccacgcaggaggatcgctttgaggccaagagttggagaccaacctgggcaacatagcgagagcccgtcaccacataacaaattaaaaattaaccaggcgtggggcctcatgcttgcagttccagccactccggaggctgaggtgggaggatggtttgatcccaggaaatcgaggctgcagtgagctatgactatgccactgcactccagcctaggcgaaagagcgagaccaaaaaagaggaatgactaggtaagaaaattctaggactgacttgggaaggggaagggggcgaaccgcgggggctcacatacccgaagttttcttctccaccattggcacaacacaactgtcggaagaaactgctgcgcacgcgtactaaccccaaggctttagtaggggcgccatcacttccggtagcttgtacttctgcgcgtgcgccacagctttgactcattacgtggcgtttccttggagacaagaaagcttttcgccatgttttataggggcaaaaccacttccggcctcagtgtggaggtgtaaatcttgtgggagccacgaaatgggtcattttaaagatgtggtcacggtgttcttacaagaaatcttattttcctttggtccttgtgaagatgctgtgatcacaaaggcagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccaggtgagatcccggggaggcccggcacggccgagggggcagaggctggcgtgcctgccagcctggcccggagagggtcggaggctcgaggaggtgtctggcccgtcccccgcccagcgtgctcttgaggctgagtcgcgccaagcccctcgcccatcactaccctgaactggggtttccagcctccctatgcaaagggactcggaattcctgggcaccactcccaccctgccctccttggggtcagagtgttcctgggtgagaagagtttaagaatgggaaggaagaaagggagggaagtcgagtgagagggaggacagcaaagcacgtgaggcccggagctgggcggtggatctcaagtgccatttccctctggtaacagagaagctgctggtgatcactgtggccacagctgaaaccgaggggtacctgcgtttcctgcgctctgcggagttcttcaactacactgtgcgggtgaggagagggaaaggcccctgggagggggtcccagcaggaggggtgggctgaagtctggatgcccaggtccccacggtaagcctggtcaggagttccccccacaactccccaccccttgcctggcacggggcaatcttctccacagaccctgggcctgggagaggagtggcgagggggtgatgtggctcgaacagttggtggaggacagaaggtccggtggttaaagaaggaaatggagaaatacgctgaccgggaggatatgatcatcatgtttgtggataggtaacggggctggggatagggagcggggtaaggatgctgaggttcccagtggacccctgcccatcctccccttcctcacccagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggtgagtggcagagtgcccaaggcagaggggccaagagcggtgggacacagagtgttaaaggcgcctgagggctggagacagcctgggggacaggccctgggaccctgggagtctcgaggtcaacactccccctccccgccaggattcatcggttttgccaccaccatccaccaaatcgtgcgccagtggaagtacaaggatgatgacgacgaccagctgttctacacacggctctacctggacccaggactgagggtagggaaggcagaggagtgggcgcatcccgcagctctgtgggagtggaggcctcaggctgaatgggatttggggagcaaagggggttgcaaagagaaaaatgtgtgcctgggcgtggtggctcacgcctgtcatccaagacttttgggaggcttaggcaggaggattgcttgagtccaggaatttaagaccagcctggacaacatagttgagacctcatctctacaaaaaaaaagaaagaaaaaattagccaggcttcatggtgtacgcctgtaatcccagctacttgggaggctgaggtgggaccatcacttgagcccaggagtttgaggatgttttgcaccactgcattccagcctgggtgacagaatgagactctgtctctcacaaaaaaaggaaaaccatggtggctcatgcctataatcccagcactttgggaggctgaggcgggtggatcacctgagattgggagtttgagaccagcctggccaacatggtgaaaccccgtctctactaaaaatacaaaaattagccaggcgtggtgacactctcctgtagtcccagttacttggaaggctgaagcaagagaatcaattaaaccgggaggcagaggttgcagtgagctgagatcgtgccattgcactccagcctaagcaacaaaagcaagagaagaaaaaaagagagagaaaagtgagaaatgatgtcctttccactccttccattttaaccactccatcgcatctcattccatttaggagaaactcagccttaatctggatcataagtctcggatctttcagaacctcaacggggctttaggtgaggaggaagacagccgcaggtgggcgatgcgcagcctctgcagctaggggtcttgagctgggagaggcttctggaggagctgggctgatccaagcccacctctatgtggttttgtcaggcgtctgagtggctggttgtgtaagttgcactgtgctgatggtactaccagaagcaagggaagcaaaaacgtgtctggcatctgttgcacacatgctgtgcctgggcaccgggccagggacttttttttttgagacagagtttcgctctgttgcccgggccggagtgcagtggtccaatcttggctcactgcagcctccacctcccgggttcaagtgattcttctgcctcagcctcccgagtagctgggattacaggcatgcgccaccacgcccagctcattttgtatttttagtagagacagggtttcaccatggtggccaggctagtctcgaactcccaacctcaggtgatccgcctgcctcaacctcccaaagtgctgggattacaggcatgagccactgtgcccggtctacttctgtgattccatttaacaaagggaaggtccctggttatccttcttgtacagatgaggaaaacagcttgtggaggggttggtgacttgcctcaggggatggggagaacggggagagagagaggccaggcacggtgcctcacgcctgtaatcccaacattttgggaggcccaggcaggaggatcacttgaggtcaggagtttgagaccagcctggccaacatggcgaaaacccgtctctactaaaaaaaagtacaaaaatgagctgggcgtggtggcgggtgcctgtaatcccagctattcagaaggctgaggcaggagaatcactggaacccgggaggcagagcttgcagtgagccgagattgcgccactgcactcctgcctgggtgacagagtgagattccttctcaaaaaaaaaaaaggccaggtgcgacagctcacatctgtaatcccagcactttggaaggctgaggcgggcagatcatgaagtcagaagtttgagaccagcctggctgacatagtgaaacccagtctctactaaatatacaaaaattaggctgggtgtggtggctcatgcttgtaatcctagcactttgggaggccgaggcaggtggatcacctgaggtcaggagttcaaggccagcctggtcgacatggtgaaaccctgtctctactaaaaacacaaaaattagccgggcatggtggtgcgcgcctgtaatcctggctacccgggaggctgaggaaggagaatcgcttgaaccctggaggtggaagttgcaatgagccaagatcgtgccactgcactccagcctgcgtgttgggagtgagactccatctcagcataaaaaacaaaaaatacaaatacaaaaattagccaggtgtagtggcatgtgcccatagtctcagctacctgaaaggctgaggcaagagaatcttttgaactcaggaggcagaggttgcagtgagccgagaccacgccattgcactccagcctgggtgacagagtgagactccatctcaaaaaataaaaataaaaaaaaaaaaaaacaaggagagagagaatatgaggaggggtagggatgctgaggctcctactggcctcccgctcagctcaccctccccttcctcgcccagctgcggtgtgatcacgcaggtagtaggcagtggagctctctgggccagcagcctggtcagaacccaaaggttcctgcccacaacgagccacactccaggatagccctggtgtccctttattccctggagaatttgggaccccatatttagaagaatgtgttgcttggtagctcccagagaaagggggtctgaagcctggcctttttcttccccagatgaagtggttttaaagtttgatcggaaccgtgtgcgtatccggaacgtggcctacgacacgctccccattgtggtccatggaaacggtcccactaaggtgccaccagtggtctcaacccccgccccgccctgccccaacccccaggcacctccaacccttctgagaagctggcccttcccagcccccatatcagaggtgcctgacccccacctccacccctggaggcctcagccactcagcctcagtctgtccccaacagctgcagctcaactacctgggaaactacgtccccaatggctggactcctgagggaggctgtggcttctgcaaccaggaccggaggacactcccgggggggcaggtgaggtgggggtgccagggaggggcacgagagggcagcgtgctgagcaggaggtacaaggacagcggactggggggcggtgggggcatcgctcctgggtccctgcacctgtcagggtggaggttgggtgggggcagcagggaagtccgggcttctctctgagtccctgcgtgttgcatcttccagcctcccccccgggtgtttctggccgtgtttgtggaacagcctactccgtttctgccccgcttcctgcagcggctgctactcctggactatccccccgacagggtcacccttttcctgcacaacaacgtgagactcccctgttggagcctctcctgagggaccctttccctgccctgatcagaactctcgtgcccccacccccatctccttcctgcacccccatccctcaggtgccgcctccctgccctctgagcccatccccctatgtcttcccctcccaggaggtcttccatgaaccccacatcgctgactcctggccgcagctccaggaccacttctcagctgtgaagctcgtggggccggaggaggctctgagcccaggcgaggccagggacatggccatgtgagcgggtgcttgcggggaggagagggtgggatgaggctgtagggtcaggggtgctgccacctgctgcctggcccttgcctcacctgtcacccatccagcccctcctgggcctccccattcgcatccttgcagcccccatgctgtcactcctgcccttgccagctcacccagacagcagagagcctggggaaggaaggatagacactgcctccctcctcttctcctgggggcatgggccagttaccccatccacaccgcctccccacctgccgccgtctcagctcgcctctcacctccagggacctgtgtcggcaggaccccgagtgtgagttctacttcagcctggacgccgacgctgtcctcaccaacctgcagaccctgcgtatcctcattgaggagaacaggtggcttaccccctctccccgcagccggagggcaccccaacaggccccgggaaccccactcctgccctgggcaccgggctccccaggcctgctcccgtctgcccagccctcacccccacctgtccgcaggaaggtgatcgcccccatgctgtcccgccacggcaagctgtggtccaacttctggggcgccctgagccccgatgagtactacgcccgctccgaggactacgtggagctggtgcagcggaagcgagtgtgagtcccgccagcctgcagccccccgcctcctccgacccggggcccaggtagacccaagccccctactctcaggggtttggagtggtcaccagtcagaggtgccatgaggctggctgcagtggctcacacttttgatgccaccactttgggaggctgaggtaggaggactgcttgagcctgggagtttaagatcagcctgagcaacgtagcaagagcctatctctacaaaaaacttaaaatattagctgggcacggtggtgcgtgcctgtggtcccagctactacggaggctgaggtgggagaatcacttgaacttgggaggttgaggctgcagtgagccatgtttccaccactgcactccagcctggaaacagagggagaccctttctcaagaaaataaaaaacaagggccggccgcggtggctgacgcctgtaatcccagcactttggaaggcagaggcaggtggattactcgaggtcaggagttcgagaccagcctggccaacatggtgaaaccccatctctaccaaaaatacaaaaatcagccgggcatggtggctggcacctctaatcccagctatttgggaggctaaggtgggagaattgcttgaacctgggaggtggaggttgcagtgagccaagatcacaccactgcattccagcctgggtgacagagcaagactccgtctcaaaaaccaaaaacaagaaacaaaaaagaagtgccacagcttggggtaggaactgaccgcattttgggaggtggggtggttgggaccagcagtgcttgacaagggacatgcaggggccttatgttcagggactgggataccctgagggaagaaggacttcccgggatgagctgggcagaatttggggggctgtcctcccagctgaccgcggtgtcggtgcctccaggggtgtgtggaatgtaccatacatctcccaggcctatgtgatccggggtgataccctgcggatggagctgccccagagggatgtgttctcgggcagtgacacagacccggacatggccttctgtaagagctttcgagacaaggtgagcgcgggtgcacggtctggcctgggggcagtcccccagactccaggcatcgcctgcatcacggacacccccaccccactacagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtatattgggtatactggtgttatgcttgaaatcacatcttaaaagaagaatggggctgggctcagtggctcatgcctgtaatcccagcactttgggaggccaaggtgggtggatcggttgaggccagaagtccaagaccagcctgggcaacatagcgagaatctgtctctacaacaacaacaaaaaaattaaataagaaatgaggccaggagtggtgctcatgcttgtaatcccagtacattgagaggccgaggcaggcagatcacctgaggtcaggagttcgagaccagcctggccaacatggcaaatcctgtctctaccaaaaaaaaaaaaaaaaaaaacacaaaaattagtcaggtgtgatggcgtgcacctgtagtcccagctactcgggaggctgaggtgggagaatcgcttgaacctgggaggcagaggttgcagtgagccaagatcacgccactgcactccaccttgggtgacacagcgagaccctgtctcaaaaaaaaaagaaaagaaaaaattagcttggcatggtggcatgtgcctgtagttccagctacttgggagtctgaggcgggaggatcgcttgagcccagaaggtcgaggctgtagtgagctatgattgtgccactgcactccagcctggttgacagagcaataccctatctcaaaaaaaaaaaaaagaggtatgcactgttacggaagtttggaaaccactgtcccagcacgaggggctccaggaccctctgccacctctcctgtgccagaaaccggtcctcagccttgccactccctcagcccctacctggcgggtccccggctgctctcacaaagccttccctgctcctccctgccccttcccattctgcctgctgcctgtccccttccccgttctgcggcgtcagctagccctgttctccctcgccccatcctcagccatgcccggacgtgtactggttcccactgctgtcagaacaaatgtgtgatgagctggtggcagagatggagcactacggccagtggtcaggcggccggcatgaggtaagggcctgggcgaggagggcagaggccttcccagaggaggaggtgcaggatctggtaaacaaacaatggaatcaggaaaatgggagcaaagaggggttcccaggggggaggcagaccctggggtcacaactgcattcattcatgtattcaagaaatatttactgctgggcacagtggctcatgcctgtaatcctagcactttgggaggctgaggcgggaggattgctcgagcagggggagtttgaggccagcctgggcaacatagcgagaccctgtctctacaaaaaatttaaaaattagccgagtttgggccaggtgcggtggctcacgcctgtaatcccagcactttgggaggccgaggcaggtggatcacctggggtcaggagttcgagaccagcctgaccaacatggagaaaccccatctctactaaaaacacaaaattagccgggcatggtggcgggcgcctgtagtcccagctactcgggagctgaggtagaattgcttgaacccgggaggcagaggttgcagtgagccaagattgaactccaggctgggcaacaagagtgaaactccatctcagaaaaaccaacaaattagccgggcatggtggcatgtcccagctattcaggaggctgaggcagaaggatcacttgagccccagagttagaggctgcagtgagctatgatcatgccgcagtactccagcctgggtgacagagcaagactctgtctctaaaaaaagagaaaaggaaatcattcctgggccactgtcctagactgcactgcaggaatgcctcatgccggtcgagctctgccctgctgtgagcagcagccaccacacagcttctaaggctgcgatgagcagcctgggtgcaatagaagccacggggaagccttgacccagacttgggaggagtagggagcttcacaggacaggtgacatcttagctgagacttgaagggccgggagcagtgagtcaggccgagaagtagcaaagaagactgttctgcacagaggaacacaggtgtgaaggctggaggacgggaggaaggaggctggactgccctggggtggggagcgccatggctggaggggcgggtggctcagtgcccgccgcccccaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggtgcgctgcccacctgccagctgcctccccaccttccccaccccagtcccggacaggaagtctccacgcagacccctttcggccccggcagcatttgggctccatgcattttagttcccaggggaatgagacgctgcaggaggcaccccaggggagggagggcgccaggctgagacccaaggtgaggcttggccctaatttaatgccagtgagcagcgagagcctcctacgcaggggtcccgccgcccctcccctcccctccctggacagggaccgtcatctccctgaagacaccctgcgatggccgggcgtggtggctcacacatgtaatcccagcactttgcgaggctgaggtgggtggatcacctgaggtcaggagttcaagaccagcctggccaagatggtgaaacctcgtctctactaaaaatacaaaaattagccgggtgtggtggcaggtgcctataatcccagctactcgggaggctgaggcatgagaattgcttgaaaccgggaggcagaggttgcagtgagccaagatcgagccaagatcgcaccactgcactccagcctgagtgacagagcgagactatctcaaaagaataataataatacaaaataaaagaccccctgcgcccgcagctgtccctgcagcctcttccctcctctcccccaggcgcgggcggtgatgaactttgtggttcgctaccggccagacgagcagccgtctctgcggccacaccacgactcatccaccttcaccctcaacgttgccctcaaccacaagggcctggactatgaggtgcgccccagtcacactacccacccacgcttcacctcaggaccctcgggtccccacctagagcccctgcgtgcatcccccagctcccctccctgcccatttcccagtgactttgtgggtatcagctcctggatcgcttctgggcaggcggcctctgcttcctcctggatcttcctgtctgcaggcaccccagcctccggtgtctgccatatctgccatctcccttgtcaccccggtctgctgcaccgtgccccccggtctggccgccctgccccgtgtatctgcctgctccccaggccccacgtctgctcactccatgtttcctttcccttctctttccagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttgagtccattggtctgcccattaaccccatctcccctcctgccagcagcgtagaggggagagacccagaaaagcgaagacaagaggaaaagggagaggcagaatgttagaccctcgtgggaacctgggagcttccctggctcccactttccccttcccctgtattgcctgagctggagacagtgtgtgagaggggccgggcgcggtggctcacgcctgtaatcccaacactttgggaggccaaggggggcggatcacgaggtcaggagatccagaccatcctggctaacatggtgaaaccccgtctctactaaaaatacaaaaaattatccaggcgtggtggcgggcatctgtagtcccagctaatcaggaggctgaggcaggagaatgacatgaacccgggaggcagagcttgcagtgagctgagattgtgccccggcactccagcctgggccacagagtgagactccatctcaaaaaaaaaaaaagtgcatgagagggcacagaccaaaagagggacttcccaggctgggcacagtggctcacacctataatcccagtactttcagaggccaaggcaggcggaggatcactggaggccaggagttcaagaccagcctggacaacatagcgagaccccccccatctctacaaaaaataaattagctgggcgcgatggctcacgcctgtaattccagcactttgggaggctgaggtggatggatcacctgaagttgggagtttgagaccaccctggccaacatggtgaaaccctgtctctacttaaaaaatacataattaagctgggcacggtggcccatgcctgtaatcccagcactttgggaggctgaggcggacagatcacgaggtgaggagttcaagaccagccaggccaaaatggtgaaaccgcatctctactaaaaaatacaaaaattagctgggcatggtggcgggcgcctgtaatcccggctacttgggaggctgaggcaggataattgcttgaacctgggagggggaggttgcagtgagctgagatcgcgccatcacactccagcctgggcagcaagaatgaaactccaactcaaaaaaataaataagccgggctcagtggctcacgcctgtaatcctagcactttgggaggccgaggcaggcaggcagatcacttgaggtcaggagtttgagaccagcctggccaacatggtgaaaccctgtctctactaaaaatacaaaaattagccaggtgtggtggcacaggcctgtaatcccagctactcaggaggctgaggcaggagaattgcttgaacctaggagacggaggctgcagtgagccaagatcgtgccacggtactccagcctgggtgacagagcaagacttcgtctcaaaacaaaaaaacaaaacaaaaaaagctttccacgctacccacagagggctccatccggcgttgttctggattcctgttgtaacttaaagagaaactttcacaacatccggagcccttgatgtcctgcaaatgaaggaggaagatgtccttaatttccttgcagcaggaaaccaattaggtggcaccaaccttgacttacagatggaacagtacatgtataaaaggaaaagtgatggcatctacatcccaaatctgaagaggacctgggagaagcttctgctggcagctcgtggcattgttgccattgaaaaccccgctgatgtcagtgtcataccctccagaaatactggccagagggccgtgctgaagtttgctgctgccactggagccactccaatcgctggccgcttcactcctggaaccttcactaaccagatccaggcagccttccgggagccacggcttcttgtgtttactgaccccagggctgatcagcagcctctcacagaagcatcttatgttaacctacctaccttgctctgtgtctcacagattctcctctgcgccatgtggacattgccatcccaagcaacaacaagggagctcactcagtgg

SEQ ID NO: 17414 - DNA, 10187 bp, Human
cagtagtgagaccccatctctacaacaaaatatttttttaattaattggatgcactggttcatgcctgcagtcacagctacttgggaggctgaggtgaaaggatgtagctgtaatccagctattagggatgctgagacacaagaatggcttgaacccaggaggtggaggttgcagtgagctgagatcacgccactgcactacagcctgggcaacagatcaagactctgtctcaagaaaaaaaaaaaaggaagaaagataattaagttttgctttgatgtacttacctactagaatgtcaaggatagttaaattaacagaataataaattttgtcatgccattggcccatctgcacattgactcggcttagtttagtctctacaaaaacaagacccctatataagaaaaacttaaaggtcaggggcggtggctcatacctgtaatcccaacactttgggaggctgaggagtgtggataccttgagtccaggagtcccagaccagcttgggtagcatgacaataccctgtgtctacaaaacatacaactattagctggctgtggtggtgcatgcctgtagtcctagctacttgggagactgaagtgggaggatcgcttgagctcaggaggtggaggctgcagtgaactatgatcatgctactacactccagcctgggcaacagagtaagaccctgtctcaaaaaaagaagaaaaaaaaaaagaaagaaagaaaagaaaaacttaagacagtgtgttcctctgtttgctttctgaggacgccctactccgtaagggtgtagctttcaataaactctctcttctcatcgcactctacgacttgctttgggttccttcctgcatgagatccaagaattctctcttggggtctggatcgggacccctttttccagtaacatgtagacacacacacacattcagtttaaaagcccatattacaacgtacatccacctcatcttcacactgagatttgggtgacatctgtccctttttgagttttgacccaagttaaccttttaagacgctctttatttcttccccttttgcctcagttcacgttcctcccccttctccttacatgccttttatagcagcctctccttttctcttttattctttttctacacatttctcttactgtaaaatcagaagccaggcgcggtggctcacgcctgtaatcccagcagtttgggaaaccgaggcgggagggtctcttgaacccaagagttcgagaccagcctgggcaacatagtaagacccccgtctctactaaaaaaaaattaaaaattagctgggcatgacggtgtgcgtctgtagtcccagctactcaggaggctgaggcgggaggatcgcttgaggccaggagttcaaggctgcagagagtcacgatcccaccactgcactccaacctgggtgacgcggccagaccctgtctctaaaaagaaaaaaactagaggggtgtatctatcacgctttcaatagatattcagcttgggttctatacttttctcatgaccctttgtctttctgttttccaggtcactcctcctcccctacacttaattcccaccctgctcccttttcacggcccactccccttccaggagtcctgcctgctgcttcgaactccaatgatcgtcccattcacctctccaccccttttcccgcctttttgccccacaaggctccaaagcgcgaggaccttattgtcctcctcccccatcctccaaccagcccacaggacagccgcgttaccatgacgaccgggctcctagaagctgcagtcaaggacctggttgccatggtttccgcttctccgcctccagccccgcccgcgctccccgcggcgtcggcgcctgcgcagtgcgtggcgcgccgggagtcagagcctgggcgggacggggcggggcttcgggcgagagggagggcagcaggagaaaggataagaaagggagtgggactggcgcctacggtggccgaagtgggacgcgccgagccggaggctgcaggatggtaggctgtgcgaagagggaggggagggggaagcgaggggcgtgggctgcacctgcgggggtcctcgggggccgccctcggggtgaaccgccctgtcttccctctggtcctcagaggcctcccttgcctcggcgggtgggcgagccgggctcgggaggaagagggggaggtggcattcgggagaggggcggggagggggcgcatttgcagggcgagcgggggctgacgaaggggcggcggggccgtcccgagccgggaggggcgctctggtcttggcccctggggtccctcgatccccgctgcagggaagccgcccgaagcagagggttgcgggagtctctttgctgagggagggagcgggggtcagcagtcaccgagacccccttcccgggctgcacaggcgggagcggggacccgggtggggagaggggtgtgggaggggagtttccgggtcggaaaagggagcgccctactgcgttcgtggccgtgcttgcctagaggctgggcccaggtagggaagcgaagtggactcgtggtttttctccgagggacccaggctttgggatcccgggctccggggctctctgccccccttcccattctctttccggaatccaggccttccgtcttcctgcttgctccccacccccctatctgagcgccgcacgaggctccccagcgcccctcttttcccctccaccaaaaaaatcagttctcctgaattctgatttttcacttactaagctagtacagtgccacacacccagggattccaagcctgggcatgtccatgaatagaagagctactgggggaaggagaagactccaggatgtggcccagaccccccggaactgggaagctggggtacactgggcagtgagggttctgtcttccatcccacttgacccagcttgctgtctgttctgcagacattcttttaggggaaccccctgggtggcggggccctaactgagggaaattggtcacctggtgtctggggaggagtgggcgcttagcaggaggcaccctaaaaggaagaaaagttaaagagaaatgtcgaagaccaaatgcctgggtgcctgcagagaggaagataggatttgggcatctgcataccctgtgtggtgttggagatacatactacagaggaggatacccctgggcataggcctggcactggaggatgatatgtttgggagatcattaagatcttatggctatgatggggtggaaaattgaggtagcttctccagggacaaaataccagatttcagcatggtgatggatagagagagggtggaagagaacaggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgccttaatgccagcactttgggaggcctaggtgggtggatcacctgaggtcgggagttcgagaccagggcctggccaacatggtgaaaccacatctctactaaaaatacaaatattagccgggcgtggtggcacgtgactgtaatcccagctactcaggaggctgaggcaggagaatcgctggaacttgggaggcggagattgcactgaacagtgattgcgccactgcactccagcctgggcgacagagagagactctgtctcaaaaataataataataatagctaacatgttatactgcctgcctgtgctagggacttgcatgtatcaaatcatttagtctcacctaacaactgtgcaaggcaggtacaatgtccattttacacataaggaaactgaggcccagagacttacagtagtaattgggccaaggccttgcataactagtagagccaggatttgaacccagctgacagactcagaagctctgacttccccctgctggtggaaacacccagccttgagagcaaggggctggatgttggaagaaagtagagaagaattagctggagataagtttggggaatgtgtggttaccctcggttctgccctcccatcccccacagatgcggttcatgctattattcagccggcagggaaaactgcggctgcaaaaatggtacctggccacttcggacaaggaacggaagaagatggtgcgcgagctcatgcaggttgtcctggctcgaaagcccaagatgtgcagcttcctggagtggagggacctcaaagttgtctataagaggtgactccccacctactttcagacctgcctagattcaagttgggcagtgggttaaaatgtctgagaaatggtcgtcccgtaggtcagggagacctgggagctgaggacatctggaggacagtaatgaatgtcagcttccttttttttttttttttttctccccaaactcttaaagaagttcttgtttaccacttggttttgctcacgtgcaacacctgcctcactcacgtgtccctttgggccctgtcttgccccactgcgcatgtcccttgcagtcaaaggtcctgccctacttttcctaacacacacgcacacacacaccctttccggttccttctcctcggagcaggtaaattacttggctcaggtttttgctgagtcaaacttaggaggtcagagggcaggaaggaaaaagcatgcgttctttgcatgtttttaagacagcacaaagaggcaggtgagttactctttacatgccctagggccacctcacctgtggccagccagggcacagaccacctccaggctggtgagaggtttgagaccagaatgcctgggtcctgaagcaagcttgtagcgatgtctcatgcgctcctctccgcagatatgccagcctctacttctgctgcgccatcgagggccaagacaatgagctcatcacactggagctgatccaccgatacgtggagctcttagacaaatactttggcagtgtaagtctcctctgcccaccagtttccattcccagcaatcccctttggtaatccaccaaactttgaggcccctccagtctctgccctggaagtttcaggggagaggtgaagttggagcagtaagaacagtaattaatttccctttttaagctttaagcctattaaccatgtcccataatcgtccctgagtggggaaactgggggcaggatcaggcacttaatctccacttagagcttagctcggacttttcacacagagaccaagttcagatgttttgattagttcaaatttttatttttttagagacacagtctcaccctatcacctggaggaatgccgcctatggctggagtgcagtggcacaatcgtagctcactgcagccttaacctctgggctcaagccatcctcctgcctcagtcccctgaggaggtgggactgcaggtgcacaccactatgcccagctaatttttgtatttttttttttaagagatgaggtcttgctatgttgcccaggctgggtctctaactctggggctcaagtgatcctcccacctcagcctcccaaagtctgggattataggcgtgagccactgtacccagccccatattcagatttttatcactggttgctgatcttggatttgcattggagttttctggagaatttttttgaatggcaatgtccaggttccactcccagagattctgaattaacttatctgagggacagctcagatcttagatggggcgtagtagtaactccataatttgtgttataaagtgcttttgcgtcctctcgtttgctccttatcccatcctagcagtaggtgttggtatccccatttttgaggccagaaaactgagacttagagatgtttcatgacttgtttagctagatggttagtggcagagccctgcttggaactcaagtcttccaccccatggtccagaattccctctttccctgccccacagtgtccaggaagcggggctaccacagcctttggtgggaagaacgtcacagattttggggggaaggcaaggggaaccatagacaaaggtagataaggcaactaatgtttcatgatcaggaggaaagatgcaagaggaagagggaaaaaaactgatccaaggcaaggcgcggtggctcacgcctgtgatcccagcaatttgggaagctgaggcaggtgggtcacttgaggccagaagttcgagaccagcctggccaacatggcaagaccctatctctacaaaatattttaaaaatgaggtgggcgtgatagcatgcacctgtagtcccagctactcaggaagctgaggcaggaggatcacttgagcccaggagtttgaggctgcagtgagctgtgatcatgccactgcactgcagcctggacgacagagcaagagaccctgtctctaacaaaataacgaaacaaaaaaactgaaaaagctgaccaatgactaaggcttggaggttgggggcagaacccaaggtgggaggcacggtcttgaaaaggaagtggctccagttgcccctccatgctcaacttagcctctccccgccctcccaggtgtgcgagctggacatcatcttcaactttgagaaggcctacttcatcctggatgagtttttgatggggggggatgtccaggacacctccaagaagagtgtgctgaaagccatcgagcaggctgacctactgcaagaggtacgggccagggacagtgaggaggaggaggaagcgcacagtggcggacagggtcctccctcccctggacacccggcctgccctgcccaccgtcgccaaggagccccccctccctgtggtatctgacccccaccacgcccagctctccagcttactctcaagccctgaccccatggggtgggaggtagggtggcagatagcccacctgtgcacccctcattccaagctctgtccttctcccaagcccccagatgtctcgtggccacccagtctcctttgtccaattctctgagcaaggcttaacaccagagggttaagggtttgctctggagttaagggttgcttggagaattggagaaggggcacctggtaggtcattcttttcttccctgatttcttcccccacctctcttttttttttcttttttttttttttaacacacacatactccaaagcctctgcgtctcaggaggaaaaggctatggggatttgggggctggcagagggcacctggatgttggttctccctgctccccagcgcccccgccctcaccccattactgcctgccccctctctgctgtgccatcaccgagccctggtgcagggagatgagtcaccggaatctgcagtgatgagcgagcccggcctgagctggctctgaggagggggagagatggggggcgagggagggctcatctttgcagtgggagagagggcagaactgaacttgccacctcactggtcgagcttcaccttcccacacacgcacacacacacaccctggcgcacacacacacacacacacacacatgccctggcacacacacccatcgtgtcaccagtgttgcgctcagaccctaatgacgcatctccctgcagcctggttcaccttccctcagggacctggcactcacctccctctgccttttccccactctgaaaaacaggacccagtcagctgtaccccccagggccccagaaagatcccccacctccttgtcccggcttcactccctttacccccaggtgtcaaggcggggcccctgcttaccaaggtcctggctttgggttctctgggtggtgacggactcaacctggaccccccctgccactgttggctggctctggggctggccctgggaggctggtgggtgccccatgaagggctcactggtccggccttgggctcacattggcttctctccccctcccccgtgtctgtgcctcccccgtctgactcttcctcgtgactgctgtcttgcccaccctgtcggcctctcctggtgtctctgcgtcaccctctgtctgtctctgccttaggaggatgagtcgccacggagtgtgctggaggagatgggtttggcatagcccctgctgggccggggtgtggcgatggggtcctggcagcgtggcgggaacggctgcttctcctctgcccagggccctgttcttggtgggactcggctgcccctcctctgctgcctcacctttcggagtgagctgtgggctcaggcccttcaaacattccctccctccaccccctacctccactttccccttttcccactgaaggttttagaagctaggaggcaggaaaatgtgacccagatgggggtgctatttggcttttattccctgcctttgcagaactgatgtcaccccagatgtccttccctccctaataactgtaaatatataaatatgtcaggttaaagggaaaaggtgttcagggcacttcttgtcctctctgtcccataacctacctccaccctccccctagccagccaggcagcttctctgcctgggaggggagcctggacccccctctttctccttggctgcagtggggcctttatccagtgccagggaggaacaacatagttaatttttttctaaccttgccactttgagggaaggaagggttgggggaagggcaagctttatgggaccctggtcctggccctggcctttcactccagttctgggtgaggcaggagctgggaggggtggggagggggagggggaagtgtctgcctttatgtcctttcttctgaaataaaaggaaaagcatttctggactttgctggccttgggctctgtgaaggaaggcagggctgctggcatcatcgggaggccaaggggatcctgccagccttgggaagaaacggagagcacgcagttaaatgagaattccagatacacaacaaatcattttagggataaatgtgttgcatgcagtgtttgggacacacttaactctaaaactgcatctgttgtgtatctggaatttcagatttcatttcctgtattttatctggccaccctaccttaaacggatttttatgcccaatgcgtctccaaacgggctgcccccaactccctgagctgcctttatggaaggaggagcaactcttcaggatgcgggtctgttgtgggtgatttcgtttgcccagtttagttttatttgaatcagttcacaagtacctgcgattagaaaaggcttaagatgggaggccaaggtggggaggtcgcttgagcccaggagttccagaccagctgagcaacctggcaaaacctcatccctacaaaaaatgcaaacattagctgggcataatggtgcacacttgtagtcccagctactcaggaggttggggtaggaggatcacttgagcccaggaagtcgaggttgcagtgagctgtgattgcaccactgcactccagcctgggcaacatagtgagaccctgtctcaaaaaaaaaaaaaaaaaaaaagttaagaagtggctttagccagcatgtctctgtggctgccactccctcctccccgcatttcttgcaaagtacctaggaccaggaatgtagggatcagtggagggaggtgggtgggtgaacacaggaaactccggcattacccgcgcggccccaggatcttgggaaaaaggagcccactggcacccagagttgtggcaccttctgcgggtcacctttttcttttgaaccagaggtcgctggactgatcgcagacaattggctcttttattgcattccgctgggcctctctctgtcaagccctggggaaagatgactttaccaccagcccccaagctggaagtggaatttcgggtttcttaatgggtgcgagccacattcttctcctctaaaaacagtttgaggactttccccacttacccctcgccttagtttgggggcaggaagcaggaggagatggggactgtggctggcgcttccctcaccgccccttgggaaggaccacacaggcccaaggggacgggtgaataaccgagaacaaagtcctaataaaatagtcacttttatttcttagcaaaactatttcctccgtgaggggtatttacaacagagaaaggaaagaaggggtcaattcacagcgacttggagaggctggaggggctcgtgggaggcccgaagggctggagacagacacacttcacacaattaa

SEQ ID NO: 17415 - DNA, 27184 bp, Human
gtggaattagggtaggccccatttggtgctgtgggagcatgaggagggagtgatggagaaagtctgtgtttttaagctgatgtttcccagaagtgagcagtttattttaaacagtgttaaatatccctggatcccctagtgaaagcgtaggctctttcatcacttgccctgctgatggaggaggcaagattctcaatttggtgctatcgcatcttaaacactactctctctttttttgtgttttgttttgtttttttttgagacagagtgtcttgctctgttgcccaggctggagtacagtggtgtaatctctgctcactgcaacctccgcctcttcctgggttcaagcaattctcctgtctcagcctcctgagtagctgggattataggcacacaccatcacacccggctaatttttgtatttttagtagagatggggtttcgccgtgttggccaggctggtctcgaactcctgacctcaaatgatcctcccacctcggcctcccaaagtgctgggattacaggcatgacccagtgtgcccggcctccctttcttaactttaaacaaagacaaaccacatctccagtttctaggactctcaggcaggcagtagcatgtcactaaaattcaattactgcctttgtttttcttgtatttagtttttatgttgtattgtatttagttttatggtaagttgattgttttgtttaagtaacacttatataatatctgctatatgccaggcactgttctaaatgctttataaatgttgactaatttaattctcccaaagacctatgaggcaggtgctgtgattatcattactcccattttacagatgaggcccagaaaggttaagcaaactgcccaaggccacaaagcctataagtggcagagctgggatttgaactgagaccagccagctccatagtctgtgtcttgaccagcatggcgcacactgcctatttcatgccagttatctgctgatggtcatgatataatatttttgagacatgtttattggagtaaaaaataggaggcaaggtaaagatcaatagtaagtggataattaatagtagcaccagtgaaaacctcaaacgcaataggctagtggcaggagttctggaacactccagtgtggctgcagggatacagcacatggaccatgaaagttgagttgagaggatgggaggggaaaggtgttggagggcaggagtctgctccagcagaggcaaagatgcatgacgaagcctgggctgccggggagacgatgagtaattcagggcagtcagccagtaatggcaggaaacccgtgcactggtacagcacttcacagtccgtgaagcactaccacatctgctttctcacagcctcttcttcactgccaggtgcagtgagcactattgtccccatttcagagatggtaactgagttcagagaataaaagagccagagaagagctactatttgcttcaagatcttctggcttcaaattctgagcccttttctcaactccactgtgtcagggatctttggtggcaagtgacagaaatagaattcaacatgattaagcaacataggtggtttttggctcatgggaatgagaaatccacagggtggacatcagatatggctggatccaggacctcccatgatgccatggggactcctgacctgtatttctcagtatggctgtcattttcaaggaggctgtctctaagaggtgacaaagatggctacaagctctgagaagataccaaaaaaagtgtcagttttctagagttctagaaaaaaaatctcaggactgctttcactggccttgcctgggttgacatccatccctgatgcaatcactgtggtcagacagatggggtgttttgattggccaagcctgggtcaggagcccactttgtggagcatggggtggagtcagcctcaggcaaaccactagaggcagctcagatagaggagctctttgggaagagacgccgggcaggcagaagcagcaggtaccccctccacatccctagggctctgtgatgtaggcagaggtaagaaattaggagggatgaggagttttttgtttgtctgtttgtttttttaaagacagggtctcactctttcattcaggctggagtgcaatagtgcaatcatggctcactgcagcctggacctccggcactcaagtgatcctccttcctcagtctcccgaatagctgggaccacaggcacacagcacccggctaacttatttttacttctatttttatttttggtagagacaaggtcttgctatgttggtcaagctggagatgaggaatattgaatctgggcaaaggagtttgcactttttgctgtgctgtggtcaagataaaaccatcagggagtgacggggacagagctatgtcaggactcgcaccgtggctggggtgatggatgtggacagaatagtgagggggcagacacagactccccctcctgcgatcagaggccacatcttcaaagtgtgataacaggacctctgcaggggttggaatcacacaggattcatattcctaaaagcaggttgaaactgcatctacctcaacattattttatttgagtagtgatgttattgcttaggatgatgctggagttaaatttttaagtgtgcttatctatagaaaatatattaaaatatgtattaaaataaacaacagtgcacacaatatacaaatatggccaaaattttggatatgagatattttggcaactcttggctagatcattctgagaccccctctgtttctgaggctctaccttctccatcaattacagctgttgtttgagtgtttatgtgatgggggccatctgcagggttttatgcaaatcacctccttgaattctcacaagaagcctggaagcaggccttgctgtttccactttacaaggctcagagagggcaagggactggcccggagccacacagctggtcatctgaaccttcctggccccccagcctgtgccctgccccagggttctttgatggctctgtgagggaggtcagagggaactatggatggggccagagtaggatctttgggaaccccggcacagaggaggaggatcttccccttgtggagtcagggatggcgtctggagaaagccatgcctgtgacttgggtcctgcatggggcatccctcttaggtttagctttagctccattcttgtctataggggctggtctgggaggggctcctgagtctgggcaggtggaccactgccctctggctggcacttcctcaaacagacacagagctggtgggtgaaacagacaagtcccaggagaagcctggcatcgccagactggtggggcattcctctgcccaagacagtagagggcactctttctggataaactcactctgctccccaaagaggttccttctccatcctggcccaaattaggaggtcaggttgtctctgtttggtcaggcctggatttcctagcatgctcccgagtgggctaatctgggctttgtgatggagtaaggagcctcattattgggctaaccttatcttaagtattcagcagtggttaactttgtgggttaactttggatttattattcagtaagaagccaatttattgatggctgggtgcagtggctcatgcctgtaattccagcactttgagaggctgaggtgggtggatcacctgtggccaggagttcgagaccagcctagtccacatggcaaaaccctgtctctactaaaaatacaaaaattagccaggcgtggtggcggccacctgtattcccagctacttgggaagctgaggcaggagaatcgcttgaacctgggaggtagaggttgcagtgagccaagatcgggccactgcactccagcctgggcgatagagtgagactttgtctaaaaaataaacataaaaaagccaatttactggcttttttttacaacatggatgtttataggaaggaagatccaaaattgctcctcagcagatccccctttccaaactagttttttctccttttctctctcccttcctctctttttccctccctctttctttgttagatagataaatacacaagtttaatttcacacacaatgctacatcaataggctcagcaagggcaaaatagtcagcagtctcctccctctttaaattcaccttgtgctgggcgtggtgactcatgcctgtcatcccagcactttgagaggccgaggtaggaggatcatgtgatcccaggagtttgagaccagcctgggcaacatagcaagatgccgtctctacaaaaatgttttaaaaattagccaggcgtggtggcacgtgcctttggtcccagctactcgggaggctgatgcaggaggatcgcttgagcccaggaggttgaggctgcagtgagccgtgattgcgccattgcactccagcctgggcaacagaacatgaccccatctctaaaaatattaaaataaaataataaaacaaattcactttgcatttgtgacgtgatggggcgggggcaggaagaaggtgggagaagggattcttggggtgaatctgccatttctaagaggtgggagttcttggggtcatccacaggcccctcgggatcttgcatttttcttaagacagttccaagaatcgggggcaagtctgcctgggaagagacaggatgagggggaggccgggggagccctgagcccgcctggctcaccctccactgtacgtctcttgcaggcccgtgggagtcagcatgccgcgtggctgggccgcccccttgctcctgctgctgctccagggaggtaagtggctgccccgtggtctgcgggtggggagggcccccatcacagagctgagccagggccgggctggctttctgggctcaaaaacacggctagagtccacagattcagaaaagatgacatccatgcccttgaggctgacacgagtccagtagccggctctccactaatcagaatccatccaccaaagggctccatgaaacagaagcggtagacatgagtctcaggtggcccagcccacaggcttgtgtcttcgggtgtcactggggggatgaaaggcttcgtccttcatttcccctgacctctgccttggctggctcccaactctctgagtgaggaagttctgccttccatctaacctcagtttctccttatgtaatgactctccttggaaatgtttttcaacaattgctgcaccgggtgcggtggctcctactggaatcccagccctttgggaggctgaggagggtaggtcgcttgagctcaggatctcaagaccagcctgggcaacatggtgaagccctgtctctacaaaagaaaaaaaattagccaggcataggagcgcatgcttgtagtctcagctttttgtggggctgaggcgggaggattgcttgagcctgggaggtggaggttacagtgagtcaaggtgacaactgtactccagcctgggcaacagagcgagaccctgtctcaaaacaacagcaacaacaacaacaataaacaaacaaaaaaatcgctagattcttagcaggcactggtggtccctgggctggggacaggaggaagagccaaaaggagactgaaccttggtaggcagcccccagaggaccagatgttgtggttagagggggtgacgttagaaagcagaactgggaagaccaggagtccgactgaaagggcactgcctaggactaagagatcctggagggcttcctggaggagggggccatgaggaggcgggatccagcacagacttgtgtggaggccggcctaggggcaggggaggaactcaacagctgctctgctgactcatgggcatttttctctggtttttaccagaagacccaggacctcaaatagctccttcaggaaacagatgtcaagctttgattttccctttctgagtggcaagcatcctcatcttggttctaaaaagcctttgggtcacccaccatggctccacatctggcgggtgcagataacaagccctggctgcatgcaaagctcggagcgtcatcccattccactgtcccaacagccccacaaggcgcatgttgtaatgacgcccagttttttggctgaggaggctcagagaggctaagagacaggtgcatggccacactacccggaagaggcagagctgggatcagtttgctcttggggtctgtcttagtctgtctgtgctgctgtgactgaatacgtgagactgggtaatttataaataatagacatttactgctcgcagttctggaggctgggaagtccaagatcaaggcaccagcagtagctttgattccggtgaggggcccatctttgctttttttttttgagactgagccttgctttctcacacaggctggagtgcaatggtgcaatcttggctcactgcaacctctgcctcccaggttcaagcaattctcatgcctcagcctcccgagcagctgggataacaggcacatgccatggctaattttcgtatttttagtagagttggggtttcaccatgttggccaggatggtcttgaactcctgacctcaaatgatccacccgcctcggcctcccaaaagtgctgggattaccgcacccagcccccatctttgcctttaagatgccacattgaacgctgcaccccccccagaggggacacacgctgcatcctcacatggcagaagggcaaaaagggtctgaatgttgggttcgtccagccctcttatagcatcaataattcattcaggggggctctgcccccatgacttaatcatctcctagagtccccaccttttaatatgatcacattggcaactgagtttctggggagacacagacgtcaaaccgtagcacggccttcaccatgctgtgctgctatctgtggagtgatagccatgtgcgggcagcatgcaggcacaggcatgatctcatctcaacacctcaacagcctctagggcaagcagtgtctccggcttacacatggggaggagaagcagttttgagtcacatgtttgcagtcacagagctactttgtgcacctctcactgcctcctgcacgctttcataaccccagacatgggatggccctggggctctctgccctgtggctggggtactgacagggcattttcccaccctctcatccctggtgccacctccctgccactcaggggctgccgttgcctccccaagtttggagacaaaccctgtcccttggtagctttgagcctggctaggaatggtagctcctctccaaattcccagagctctgagaaagaaccacgaggatacgaactcagagatgacacagctacttagaggctctgtgttgaggttttgccaaaatcagtcctgttttctccaccaagtgctggaactagctccttttcactccaccgacaagttctgtgtgtctccctgaggaaagccccctcctagagcaagatttacttccatgactcagatcccttggtagccactgcctcgagagaagttgagaagcattccgaggtcacacctaggggagggagtgctgtgatccattagcaatatctgtcatgtgtgcggctatgaaaaactagcacagactaggtatttccttccctgggtgagtgtctcagcagcccagaccaagagagacaagaggcatggtctagtcttggagcctcagtgttctcatctctacaatgaactaaaggatatttccagacacagtattcttggctccgcatataggttctgtcctagagtgagacccaggaagggaatctaccaccaccacctcaggggtcttcattagtccagggaaaataggaaaaagccaccaaaaatgaacctacttaaaaaggggaacaaggtcaggcacgatggctcattcttacaatcccagcactttgggaggctgaggcaggtggatcgcttgagctcaggagattgagaccagcctgggcaacatggtgaaaccctgtctctacaaaaacacaaaaattatccaggcatggtggtgcacaactgtagtctcagctactcaggaagttgaagtgggaggactgcttgagcctaggaggtggaggctgcagtgagctgagatcgcaccactgcattccagcctgggcaacagagcaagagatcctatctcaaaaagaggtgagcggtacaagtttctagtaaatagcagcaaaaaatagtggaattggcactcgaatatacaaaacaaagctacaaattattccattgattttgtccacatttaacaaaatgtagatgatgattgcacccctgttttagaacacagcgaaacaattaatgtttggggagcaggatggaaaggtgttaaatcttccaacaaaattgcctcatagggcaatacctagaagacttcttggtggcggtggcatttttggccgcaggatcacgcagacctttatgcaaaagtgtccgagggctttttaattctctcacggtttcctactccttgaagcacttcctgaatctccgagagtgggtgtcctgtggatccaacttctgtagagccgagacctcttccttgtcagggttttgggacattttcagcatagctgtccttgactctatgaggtcctgaccctcttggggtgtgtgcgtgtgctctggctgggttcctaccacatctggggcatttaggatattgccattctgagtgggagcttggccaggagggacacagacctggtggccgggcgcagggctctggaggagggtgctgagctggggaccagctagttttatattatttgccatcacatgcatcctgtcttcatagccagccttgaaacattggtgctcaaacaaggaatttccaggtggtgaggccccctgggtgccaggcctacatctaagcagctcctgagtcctcatatttgtcccggcctggggacccctgcacccattcttcctccagccctcgaggggatggagaggaagctctgcagtcccaagccaccccccaccaaggcctctctccccactgaccctccaggctggggctgccccgacctcgtctgctacaccgattacctccagacggtcatctgcatcctggaaatgtggaacctccaccccagcacgctcacccttacctggtaagtagccgggcctcaccagtccccggggatgcaattcagggtgcctgctcagtgattcccccaggaggacactgtgcactgaggaccactgtgtccgcctttcagacaaccactcagggctcacaggacttgaaaagtcaggagcccgcagggttggtctatccaccagcttcaaaggccactctctcacccacacaggtcggccatggttttgagaccccgggatggctggtttcccgcatgatttttcaagcacttaggtaccaggcccccaactacacgcttcccatgaatggtcacccccaaccctcacaatgattactcccattttacagatgaggacattgaggttcagagaggttaagcaacttgcctaaggtcacacagccagtgaatgctggagctgggattcaaattcagaccgcccaactccaaagtccatgggtcccttttagaccctatgcagctcaggataaagaagagcttctgttatccatcagctcattcattcattcaaaaccatttataggccaggtgcagtggctcatgtttctaaccccagcactttgggaggccaaggaaggaggatcacttgagcccaggagtttgagaccagcctgggcaacatcacaaaaccctgtctctacaaaaaataaatcagtcgggcgtggtggcacaatcctgtaatcccagctacttgagagtctaaggcagggggaccaagctcaggaggtcgaggctgcagtgagctatgatcacgccactgcactccagcctgggcaaaaaagcaagatcccaactcaaaaacaaaacaaaacaaaacaaaacatgtattaagttcctgccagacactgttgcaggcactggggattcagcagagcaagactgaccaggccccagatgccttggaactgacgtaccacggtggggcggaggctgggggagacagacacacaaaacaaccaacaaggtgctttctcttttttattttattttattttattttattttatttttttgagacagggtcttgctctgttgcccaggctggagtgcagtggtgggatcagaactcactgtagccttgacctcctgggctcaagcaatccctccacctaagcctcctgagtagctgggactacaggcatgcatcaccatacctggataatttttgtagtttttgtaaagacagggttttgccatgttacccaggctggattcaaactcctgggctcaagcaatctgcccacctcagcctcccaaagtgctgggattacaggtgtgagccaccatgccaggcccaaacaggacactttctttctttcttttttttggagacggagtctcactctgttgcccaggctggagtgcggtggcatgatctcggctcactgcaacctccacctcctgggttcaagcaattctcctgcctcaacctcccaagtatctgggattgcatccaggtgtgcaccaccatgcctggctaatttttgtattttaagtagagacagggttttgtcatgttagcccacctggtctcgaactcctggcctcaagtgatccgcccactgtacccgcctttcagacaaccactcagggctcacaggacttgaaaagtcaggagcccgcagggttggtctatccaccagcttcaaagaccactctctcgcccacacaggtcgcccatggttttgagaccccgggatggccggtctgccgcatggccagcctcccaaagtgttgggattacaggcataagccaccgtgttctgccccaaacaggatactttctaataatactgggtgctatatcaaggacagaacactggacctcaggtaaagggaccacaactgctagtgagaaggaggaagccagggagctgggcagagggcactgccagtgcaaaggccctgtgggagaagagctggtgcgtttgaggaatagggaggaggtcagtgtggctggagtggagtgaggcagggtgagggggaataaggagcaagttcaggctgggaggcttggagagcatttattcagcaggaacttgtattccagcaaatttggcagagaactcagtccacacatccctactgggcctagagagtggtcatgttcagatcctgaacatctaggtagggaaattaatatccggtaaactactatacatacttcaaaacccatcatttttgtccagtgggagttaaaaagccacagcattttccctaatcccatcccaccaactttcccagaagtccacccagaggaggagatgaggttcatttagctcttttcctggccctcagcacaggctattattagatattcagtggatttggggactgggcgaggtggctcagtcctgtaatcccagcactttgggaggccaaggctggcagatcacttgagcccaggagtttgagaccagcctaagcaacatggtgggaccccatctctacaaaaaatacaaaaagttagctgggcatggtggtgcatgcatgtagtcccaggtactgaggaggctgaggtgggaggatcagctgagcctgggaaggtcgaggctgcagtaagccatgatcacactactatactccagcctggggccagagtgagaccctgtctcaaaaaaatggatgttggacagaaaggagagaaggaaacccaaaatgcctagcgcccttcctgcaggacagccatctggttgttgggaccaacagggacagatttaggcttagtccaagcaagaatggcccaaatttccaaaattgagagctgctgccctaaatgaggtagtgagttcctggcccctgggaggtgtgcaagctgagcccggacacaattcattgaggatgctgtaggggaggtgataccttccctgggaaaaggttggttggaccaggtgaccaccccccagccctgcctcaaatccctcccagccctgagagtctgggcttctgccctggccctgagcactgagcccaccaccatcccccctgcccctggcttccagccatgaccggctgctttgtccttgaaggcaagaccagtatgaagagctgaaggacgaggccacctcctgcagcctccacaggtcggcccacaatgccacgcatgccacctacacctgccacatggatgtattccacttcatggccgacgacattttcagtgtcaacatcacagaccagtctggcaactactcccaggagtgtggcagctttctcctggctgagagcagtgagtatcctgggaccccaggcttagggtggcactcaatcttagctcaccgcagccctgacctctctgggctcaggtgatcctcccacctcagcctcccgtgtagctgggacaacaggtgtacaccactacacccagctaatttttgtatttttagtagagacggggatcttgccatgttgcccaggccagtctcgaactcctgggctccagcgatccacttgccttggcctcccaaagtgctaggattataggtaggggctgggtcccctactccctgccctctgggccagctctcctccttccatcagatctgacctggcctatgtcctcactacaccttagagttctgttttgagttgcgctattttttactaaagtgtgaaaggttgataataggtttgagaggtattgaaggagctaggctgggacccgggacttctgggttcgtgttccggctcagctctgcccatctgtgtgaccatggatgaggcatacctacctctgggacagcttccctatttgtagagcaaatgtccttttaaccctgactttctgggatcctgaccccataatgaggcgaatggacgacactgagttacagaaaaaaaaaaccctcttgggttttttccccttcataagctccagggaggcctggaatttccctccaggctggaggtagaggggggtcccaggggcaggagggcctggttggtgggagcagttttatctgtgagttcagaattagggcaggtggcagggcgaggtggctcatgcctgtaattccaacactttggaaggctgaggcaggaggattgcttgaacctggggctttaagaccaacctgggcaatatagcgagacctcatctcaaaacacaaaacaagaaccagggcaggggccaggcactgtggctcacgcctctaatcccagcactttgggaagctgaggcaggtggatcgtttgaggtcaggtgttcgagaccagcctgggcaacatggtgaaaccccatctctactaaaaatacaaaaaaatttgccgggcgtggtggcacacgcccgtaatcccggctactcgggaggctgaggcaggagaattgtttgaacctgggagacagaggttgcaatgagccaagatcatgccaccgcactccagcctgggcgtcagagtgagactccgtctcaaacaaaacaaaacagaactaggcagggcatggaagggcctgggaggtggctttggcatggtgtgtgtgtgtgtgtgtgtgtgtgtatgtgtgtacccaaagcggccccagaggcaaacacaggctgcaaagggagcctgccctcaggaaggccccgcccatgagctcgggagtttctgccgctagattcccagcagaggggctggggtataagaggtgtctgtgattcacactctgggggtccaggtttgcacctctttgctgagtggatgtcacaccacagagcgtgagagtgaagcttcacacactcccagacacatgcacactcacgcaaattcccagggtcacagactcacgcacacacagactcatagatgcgccctcaaactcacagatgtctccccagccccagcctgcatggcatggacacagaggcccacactgcctctctctcttgctctctctcactctcatacacactgcacacatacatacacacacacacacacacacacgtacacaatacacacacactcacacatatactctcacatcactcatacatgggcacacacacgcacacactcacacatgcattctcacacacgtgtagactcacacatgcacacacatatacactttctcacacgtgtgcacacacgcacatatacacatactcatacactctcacatcacacacgggcacacatatgcacacactcacacatgcattctcacacacgtgtacactcatgcacagacacacacattactcacgggcacacatgcacacactcacacatgcacagactcacaaggggaccctccttgccacttgtcttgcagcgtgaatccaagcatttctctctggcattccctccctccctgccaggatctgcagctagcctggtcccagctggggcaggaagtgattttctaaccacctcccgccgagggtcccttcctcctcctgggccctgggcctcgctgggctgagcagcccctcttcacgacccccaggctctgcaaacatctcccgagtacccacggggcagttctcagtaccctggtgtcttctgggactcatcctcacccagccacacagggaagccgagagccggcctccacctgccccggggaagacaaaagaggggttagaaacgatttcagtcaaaaacatcccattactggaacagcaacagcaacaacccagtgttcaccatggcattctgtaaaatgtgcacctctgtcacctcggggcgtggtgggagccctcagtgcgggtttcaggatcacaggcagccttagagctcctttctggaggccttgcaaggttcattagttaatctgacaaatatatatatatatatatatatatatagagagagagagagagagagagagagagagagcgagcaagcgcgcgccagggtgtagctttgtcctccagcctggggtgcagtggcacaaccatagctcattgcagcctggaactcctgggctcaagcgatcctcccacttcggcctcctgagtggttgggactacaggtgcacatcaccatcctggctaatttttaaattttttgtagagctgggatcttgctgtgttgtccaggctggtcttgaacacctggcctcaagcaatcctcccacctcagcctcccaaagtgctgagatttttggcatgagccaccttgcccagcctaatttgccaaatatttattgagggcctactgtgccccaggctgtgttctaggagctgtgggcacagactgaacctggaggacaaaacctctgccccaaggagctaagagcccagtgagggaggcacatagtaaacaaaatcacagggtgagaggtgcagagtgttagatggtggcagattgaaagtgaagaaggtggctgggtgtggtggctcacacctgtagtcccagcactttgggaggttgaggtgggtggatcacttgaggtcagaagatcaagaccagtctggccaacatggggaaactacttctctactaaaaatacaaaaattagccagtcatggtggtgcgcacctatggtcccagctacttgggaggctgaggccgtgtaatcgcttgggcttgggaggtggagactgcagtgagctgagatcacgccactgcactccagcctgggtgacagagattctgtctcaaaaaaaaaaaaaaaaaagaaagaagagaaaaaagaaagggagggagggagggaaggagggagaaaggaaggaaggaaggagaacaaaaaaagaaaaagtggagaaggtgagggcagaggcctgcaactcctctctgacactaatagacacttgtcactcagttcctctgaagttactgccttctgctaaatagcttcatccctttgaacttgaagccccatgatataggaactgagcccattttacaagagaggaatttaaggcccttaacatattgtgttctgctcaagttcatgaaatgtccttcgaatggagcaaaaacagaatgccggctttgaccttcacctggaggccgcccatgaaagcttgctgttatggctcagagctcggctcttgcacttgccaggagacgctgaaagatgaggaccatcagattggcctcccagggccactgtggggtgtcaaactgcccagagcagggcagccaggcaggctctgtgtaaatggcagccctcaccattagcattcatgctaagaagagtcatcaactgcttgaagtagctggggttgaaagaaaatgataccatcatttagaacagaaatggaaaatgaatggatttgccagcacgttgctgagaacatttttggatgggttgctaactttaaaacttaatataggccaggtgcagtggcttgttcttgcaatcccaggattttgggaggctgaggtgggagcatcacttgaggccaggagtttgagaccagcctgggcaaagatagtgagaccccatttctacaaaacagacaaataattagccaagtgtggtcgcatccacctgtagtctcagctacttgggaggctgaagtgggaggatggcttgagcccaggaggttgaggctgctagtgagctatgatcgcaccactgcactccagcctgggcaacacagtgagatcctgtctctagggggaaaaaacccttggagatttcacatgataattccaggggtctcccgtttcccattctgcacctcatattgaaacttgcccttcagtgcatagaaagcagggtttcagatttcatgtgtgtgcgtgtgcatttgtgtgtgtgcatgctgtgcgtgtgcatgtgtgttgcatgtgtaggcatgcgtttgggtgtgcatgtgtgggcatgcatgtgtgtgggtgtgcatgtgcacatgtgtgtttgtgtatgcgtgtgtgtaggcatgtgcgtgtgtgtttccctagaaaacttagaaaagctgaccactctgtgctgctggggccattcacttttaactcttttatttatttatttttgttcgtttttgagatggagtctcgctctgtcgcccgggctggagtgcagtggcgcaatcttggctcactccaagctctgcctcccgggttcacgccattctcctgcctcagcctcccgagtagatgggactacaggcgcccgccaccacgcccggctaatttttgtatttttagtaaagatggggtttcaccgtgttagccaggatggtctcgatctcctgacctcgtgacccacctgccttggccttccaaagtgctgggattacaggcatgagccactgcacccagccagactgttttatttcgtcacagtccctaaacctgcttcactcctctctgtgacctgcccgcccctgagtttgcaatcctgatcaggtctaaatctcccaggtcccagatgaataaactgaagcccagagttgggagtactttgcccaaagtcactcagggttgttggtcttcatctcatccatgatgggtcaggcatggaggcaggggtgggggcaggcaggacttcctcccatcaccaaatccttttcacctgcagcaaattctcaccccattttcttttcctgggtttttccaccaagtcaagccggctccccctttcaacgtgactgtgaccttctcaggacagtataatatctcctggcgctcagattacgaagaccctgccttctacatgctgaagggcaagcttcagtatgagctgcagtacaggaaccggggagacccctgggctgtggtgaggaatgtggggatcagtgcagctttgtgggaggggaggggagatgacggagtgcaaaggcatctgggtgggagagacgggtgaacaacatcattcatggccaagaacagagaccaagggcacgagcactcccttacagcgggccctcctcctcccctcacttctccccaaggtaggagacccctgaataatctgtcctccccaaactggtctcctcggcggtcagcatgccaaagagactgtcccttccccagactccaccccaggtctagcatagtcacaatagaagaagtttcagaaatggggcaacctggaagcttcccaattgcttagaatggccatagttggagagttccagaaatatcaattattaagaaggtccagccaggtgcggtggctcatgcctgtaatcccagcactttggaggccaaggcaggtggatctcttgaggtcaggagtttgagaccagccagggcaacatggtgaaactctgtttctactaaaaatacaaaaaattagccaggcgtggtgacatgcacctgtaatccagctattctggaggcttaggcaggagaatcacttgaatccaggaggcggaggttgcagtgagctgggatcgcgcgctactgcactctagcctgggcaacagagtgagactcgatctcaaaaaaaaaaaaaggtccagtgttagagggcccattgtttcaaacatgaaggtgttgagtgatgtccttccagcccactatttagaacagtcacaagtgatgtactgtctctaaaaaataaaaaatagtaacaatgatagaacagtcacagctgaagagttctagaattgcccatcctttaggatagtcccagctgaagatgtccatgagtgccatactttagaaagtccccagtggaagacttccagaggtatccattgctaagatgtctgtagttagagttctagaaatgcctgctgttgggaatgtcagtatgtcaactcttggaattcttcaacagttgaagacattctccactgatgtactgagacttatatcagtagtacatcggttgagaatgtcctcaactgttgaagaattccaaaagtatgcattgcctggaatgctgccagaccattaccactcctgagatatgcccagtcctgcagggagagtccactgccaggactgtgagtggctgaattggatcaaagagaaatcaaacagagcatcctatcacatgcacgggccaggcagtgctggtgagtctgtgctccccatgcctgagtccagctactcaggcataggcttgattcttgtgggaagagaagagacactcagcccctttgatggaagctgggaaaagaggtggctctgctggaggcaggggctggcctggtttaaccctgacctggtgcatcctttccttgtactggcagagtccgaggagaaagctgatctcagtggactcaagaagtgtctccctcctccccctggagttccgcaaagactcgagctatgagctgcaggtgcgggcagggcccatgcctggctcctcctaccaggggacctggagtgaatggagtgacccggtcatctttcagacccagtcagagggtaggtgtgaagctgggatggacaccccactcctggtatcaaattttgtcctgttctagccaccctaagccctgagctttctggcacagctgggaggtattcagttgttcatcctcagatgtagcccttcaattacatttctagagcccctgctggccaggccctgttgggtgccagctgcttcttctgttaggcatttgatccccctaactctgaagtgggaatcagccctgtttttcagacgagataacttaggctcagagaaatgaagttacttgcctggggtgaggaatgagaacaagatttgaacccagatccatctcacttcaagacactagcagtaacagcctctcctaccctcttccactctaccccagacccatttcccaccatgcccaccccatatggcctctggtagagttggtgccatttaaccctttctttgcttccttcccagagttaaaggaaggctggaaccctcacctgctgcttctcctcctgcttgtcatagtcttcattcctgccttctggagcctgaagacccatccattgtggaggtgaggccaggggatgaggaaggcagggaggtggtcagcctgggccactgcccctgtatgatacatgcagggttggaaaacatgactgtcatcatggtaacaatgatgatgatgggataataaccaactcacagccaccatgtgctggacactgtggagggcactcccttcacccccatggctgccctatgagcttgagacactgcagttgcccttattttacaaatggagaaactgaggcaaggagatgtcaaggacaaagtcacacagctccaaggtggagaaattgggattgaaaatctgtgcccttaaacagggacctcagctgtgatcttgtccagtggattttaagctttgaggcttaatgggcttaaggggccactaggtggtggtgaagaggtggctgtaatagtccacacctctgaaatggcctctctgcgcacccctggttgcagataaagaagttgaggctcagaaggggcaacatttgcccagcacgcaacaggcagccaagaacataaccacgatatcccttcaggagcctgtgagggagacttactgctcccattttacagaaggggaaaccaagccccagggaaggagggaggcgcctgggctgagtcttgggatgctcggaagctcctgtaggatgaagctggggagcgtccgaatgggaggccaggctgccctctggtgatgtcagggtcctcacccctctctgccccctcaggctatggaagaagatatgggccgtccccagccctgagcggttcttcatgcccctgtacaagggctgcagcggagacttcaaggtgagctcccgaccctgtgatgagctcctcggagcccctcctcctcttcaggagccccacctcccctcaccccaggctccccagcctcaccccacaggcctagagcatgcaggtctcagccaagccacaagccaggcctcagtttccccatgtgcaaagtgtagacagtcattcttgtggtgcagaattggcagaagaattaaacaagatttgaccaggtgtggtggctgacatctgcaatcccagcactttgggaggccaaagcaagtggactgcttgaggccaggagttcaaaaacagcctgggcaacatagggagaccctcaccaccactccgcctccccatctctaccaaaaacttaaaaatcattcaagtgaggtggtgcacgcctgtagtcccagcaactcgggaggctgaggcaggacgatcgttcagaggctgccgtgagctatgatcacaccactgccctccagcctggccaacagacagagactatatcttaaaaaaaaaaaaatcaaaaagaaaaagtaaacaaaataatgcagcattggcccagcccaaggaaccagactgggatagggggtgaggctggtggtctcctgagtcacagattgccccactggtcctttcttaggtgtccttaatctgagttggagagggaatagattctggaaagagcctggcccacggggcaaaacacactaacgtttgccaagcctccaactcaccaccacccgccagcacccacaggttgtctgtgcccatttacagccgtgtcacccaccctgcagcagtgggagtggctgccacagagaggatgtggtgacagaggtgggagggccagccccacctgctgcagcccagcctgaaagtcagacagtgtagacctagaccattgattgagctcctgctgtctgcctggtgctgcgctggacacccttcctgcctcactcattctcatattcacagcagcccctgcagagtggatgttccactgcccccagggcacccatgaggaggccaaagagtgggcagggaggaacatggaccccaacccacataagacccaccctttcctcttccctaaagctcaaatatcacattgattttgggttgatttttaccaatactcatatagcacttgctatataccaggcagtcccctaggagcatcacaaacagtgactcatttaatcctcacgacggccctacgggtgggtgctattattaggtccattttacagatgaggaaactgaggcaccgagagggtaagtaattggcttaagggcacacagctgagaagcgactttgaatcagtggtggtggccacatcacagttctgagatgagtttttgaggaagatgagctcaaaacagggagatacccattcctggggattttccttgccaattgcatgaggattctggtgtcgtgagtgggagtcctggcaggggagggaaggggagggtccttcaagtttaagggccaccgcctcagccagcatcacccacatcctttatcctcaaagtgtacaaaggcctttccaagtggcttttcattgatccactccacccattcatttcgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtaggagggggatccactagggtgggagcacattgtggtcctgattcctctctctctctctgtctctcggtgtctttgtctatcttcatgtctctgtctgtctctcttgatgtctctttgtcttgtctctgtgtctgtgtctgtctttctgtctgtttaaaccctcaccttggctgggcacagtgactcacgcctgtaatcccaacactttgggaggctgaggcgggtggatcacctgacgtcaggagttcaagatcagtctggccaacatggtgaaaccacgtctctactaaaaatacaaaaattagccaggtgtggtgacaggcgcctgtagtcccagctacttgggaggctgaggcaggagaatcacttgatcctgggaggcagaggttgcagtgaaccgagatggcaccactgcattccagcctgggcagcagagccagactgtctcaaaagaataaaagtaaaagaaaaataaaccctcaccttaccctcatcctgtgctatgactctctctttttctctctcacagaaatgggtgggtgcacccttcactggctccagcctggagctgggaccctggagcccagaggtgccctccaccctggaggtgtacagctgccacccaccacggagcccggccaagaggctgcagctcacggagctacaagaaccagcagagctggtggagtctgacggtgtgcccaagcccagcttctggccgacagcccagaactcggggggctcagcttacagtgaggagagggatcggccatacggcctggtgtccattgacacagtgactgtgctagatgcagaggggccatgcacctggccctgcagctgtgaggatgacggctacccagccctggacctggatgctggcctggagcccagcccaggcctagaggacccactcttggatgcagggaccacagtcctgtcctgtggctgtgtctcagctggcagccctgggctaggagggcccctgggaagcctcctggacagactaaagccaccccttgcagatggggaggactgggctgggggactgccctggggtggccggtcacctggaggggtctcagagagtgaggcgggctcacccctggccggcctggatatggacacgtttgacagtggctttgtgggctctgactgcagcagccctgtggagtgtgacttcaccagccccggggacgaaggacccccccggagctacctccgccagtgggtggtcattcctccgccactttcgagccctggaccccaggccagctaatgaggctgactggatgtccagagctggccaggccactgggccctgagccagagacaaggtcacctgggctgtgatgtgaagacacctgcagcctttggtctcctggatgggcctttgagcctgatgtttacagtgtctgtgtgtgtgtgtgcatatgtgtgtgtgtgcatatgcatgtgtgtgtgtgtgtgtgtgtcttaggtgcgcagtggcatgtccacgtgtgtgtgtgattgcacgtgcctgtgggcctgggataatgcccatggtactccatgcattcacctgccctgtacatgtctggactcacggagctcacccatgtgcacaagtgtgcacagtaaacgtgtttgtggtcaacagatgacaacagccgtcctccctcctagggtcttgtgttgcaagttggtccacagcatctccggggctttgtgggatcagggcattgcctgtgactgaggcggaacccagccctccagcgtctgcctccaggagctgcaagaagtccatattgttccttatcacctgccaacaggaagcgaaaggggatggagtgagcccatggtgacctcgggaatggcaattttttgggcggcccatggacgaaggtctgaatcccgactctgataccttctggctgtgctacctgagccaagtcgcctcccctctctgggctagagtttccttatccagacagtggggaaggcatgacacacctgggggaaattggcgatgtcacccgtgtacggtacgcagcccagagcagaccctcaataaacgtcagcttccttccttctgcggccagagccgaggcgggcgggggtgagaacatcaatcgtcagcgacagcctgggcacccgcggggccgtcccgcctgcagagggccactcgggggggtttccaggcttaaaatcagtccgtttcgtctcttggaaacagctccccaccaaccaagatttctttttctaacttctgctactaagtttttaaaaattccctttatgcacccaagagatatttattaaacaccaattacgtagcaggccatggctcatgggacccaccccccgtggcactcatggaggggggtgcaggttggaactatgcagtgtgctccggccacacatcctgctgggccccctaccctgccccaattcaatcctgccaataaatcctgtcttatttgttcatcctggagaattgaagggaggtcaagttgtttgtcaatgatttgtcagagaacctgttgaaatgtgaattaagaagctaagaaaatatttcttagcaacattttctttttcttttttttttttttcttttgagacagagtctcactctcgtcgcccaggctggaatgcagtggtgcgatctcggctctctgcaacctctgtctcccgggttcaagcgatttcctgcgtcagccccagagtagctggaattacaggcacacaccaccacgcctggctagtttttgtatttttagtagagctggggccaccctggcccggccccgtcttcctccccaaaggtcagactgcaggctgcagggctgtgctggaggagccagctctagctcacccatgcttttgcaacagggtcgggttggaagtcagcacaggtcagtcctgcggaaggttccttcgtgactcatctgtgaagtggggtggttgggagaggtagctgagagaatgcatgagagtcctcggtgcctggcaggaggctggaaggttctagaacactgatggttataagagtgggactgtgagcctgggatcggggggtgtgagacttggatgggagcacaagagtggaaacacagcttctgcacggagcaggcgcagccctcaacaccccgtgcacctgcaccctagggactcttgggtccagatgtgctgtggttttcacaccttcttgggggcaacaggttccaggagccacctgtgggtgccacctgagccacaggctcccaggaaagcagcacagctctcctgcacccagagcttgctgggtggcggaggggaacacagatggttggggaaggcctgaggccagattgggggactctggactggggcagatgaggctcctcagaatcccacctttgaagggaactcagcttataaacacagaggagcaaagttggagggccgggcgtagtggctcacacctgtgatctcagcactttgggaggccaaggaaggtggatcacttgaggccaggagttcgagaccagcctgggcaacatagcaaggccccatctctacaaaaattattattttttaaaaaaattagccaggtgtggtggtgcttgcctatagtcccagctactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagcatttgcttatttccatggtgtaatttcatgctcctgatttgagtctaaacacagagttgggaagagatatgcacaatctgccctcttggctggtatgagtgagtcccagctcaccgatggtagcccagagagaacatcaagaggggtagggggcttcagggaggaggtggtgttggttggacttcgaaaaatgaataggaggctgggagtggtggctcatgactgtaatcctagcactttgggaggccgaggcgggcagatcattagaggtcaggagtttgagaccagcctgggcaacgtggtgaaacccagtctctactaaaaatacaaaaattagctgggtgcggtggcgggtgcctgtaaccccagctactcaggaggctgaggcaggagaatctgagagatggaggttgcagcgagcagagatcacaccactgcactccag

SEQ ID NO: 17416 - DNA, 51161 bp, Human
aaggtaagttcatgtcactattaaaataaaatgaattctgggaattttgttgatattcaattttaatcttaattatgcaaagatctgttacttaactaagactatgtaacataatatagcatatgacttctggataatgaaaataatcctaaacttaaccataaaaaaataagggtatgaaagtcaaaataaggtagaaaatgactgcaccaaatagccaacaaccttaaaaagggtaggatttttttaaatcactaaattaagattggttcattgcatttagtacatctcttttatgaagaggagttataagctacagaatcaataaattatgttttgatataaatttttcacccttaaagttcctagctaggaggaaattattcttttacacttacacgttttagatagaatggctataagtaagcacagataaatgaagaaatgaaagagaagggaaaaatagagatggttgattctgcctctgcaattgctaattcataaacatcaaactttcccagtgtacactgtcttctttgggaatttgctccatctttttccttaaactgaaaggtggcttactgaggctatcactttcctaaaggtctccccaatactgcctaattattttctcttatcacaggatacagggtggatgtccatctacttccttgttgtcacttcccagatcactttcactttatgctcttctaaaattaaaacaaagatcatcgaccacaaaacacaattgttcttttgtagctcatgctagaataccctctttgttacatctccttcatttttctgatccaaaatttagtagcctactatatctcacccactgtccttctttcctccagctatggtagagaactgctcctccaactttatgtacatttgaatcacctgggagttcctgtgaacttcgggttctgatttaataaggacacccaaagagtctgcatttcctgtaactctcaaaagaagctgtggagtactctgaatagcaaagcactgtaagtgctgtttctgttagtatctaatctattagtcctaatctcccatttatgctttggcactcattccctcctgctttcggtatcttaatatctatcattccttcactcttccctcaggttccctacatagtttatctctaccccctctaagccgctcagtatcgcccattaaagaactaaaccaaaactagaaaaccctcatttaacccttcactccccctacatacaatctgatgtgtctctcatccacagctaaacttggaagaaaaattgcctgcttgaggatgccattttgttatcttcagctcaatcctgtacccacttcaatgttatttgcaggcccattaccccaacactgcattcacgaaagtcatcagtgactacacattgagaaaacaagaatgacattttcagttctcaactaatttgaatttctcaacagtattcaatattgttaattactcccaatatttttccacatggtcctccatgacacaatacataatagtccccttattatctatattcctgtctattgtaaagacttcccccgcacaccaaaaaaggtcaaggaaactcctagccttcaagtctcaactcaaatctggccttctgaagccttcccaactaggaaaatatacagtcccattggttgtctaccagttgtctaccagttaattgtaattcttagccacaagttagctgacccaccgtctctcaaacaggtgaagttaagctcaatatttggcatatcttgatatactttgtacagtctagctacaataagtttgcctatgcacgaagatggctaccggcgggggggggcgtccttacgtcctacgtcatcacgtgccgggatgagggtggggccctcaaggaagacggaatggaatccagatgggcgggggcaagcaggacggggcggggctacgcgggatctgggcggggcggggccggtgaggggtcgggggtgctcctgctattcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacgtgagtgtcccgagcgcgtcctcatcgcgggggctgggcgctcaggcacgcgggtgcgggaggcagccccaccccgcccccaaatccctgcgatcctgggattaggtccattcccggcactgcccgtggaatcgaggtttggaggccggctgggagacagaggacttggattctcccgttttcaatgattgcattttaaaaattgtcctcccacccatcctcttcccccgcaccagtgcatacacaccctctcacatttgcaactttgttctttctgatttggtcctgatttgttgacagctctgatctgccttgggctaatggattagttagtataaacctgtcttgaaatctccttccacttttcatatccgcatgggttaggttagaggacggtcttaattctcattcttcgtagagtttggtaaggcgagatgttttaaagagctaaacacatgctgacttttacgaaggggctgagtgcctctaaaggtactttttggtccccaccaactggctttgtgttgcgctcatatttacttatttggcagcaattttgtagcgctcatcgtgaccatatcggtaaagtggatagaagtggtagcaggtgggagtggatgcaacggacaggatacggtggaggatttgtattcttcagacatctttttcggaagcttgcttatcacttttggggtggctttagggtctgtaaaataaaagatttagaactgcatttgagagaggttttcattcttaacatctacctctaattcttttccccttcaaagttttcttctagttgagtgagtacaaacttgcttttgtcgttgtcggttgattttggtggaatatttgtgtgagatggccaattttttgtgtgtgtcagaaaaaactatccgtgctcaaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaagtatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgtcatgggttttatgtgtatggtgagaaaacatgaagatctccctgatgtgtttttaagatactgggtttcagttagggtgttatcaaaggacctggatggctttgtaaacaaaaacaaatgccataattttgtattcattacacagtttaacatttatggattttggttattttgcgtaaaatgtactttttattagattatcctaatattatacttacttagtttttaatatacttgtattaatttcttataatataacaaaagtattttttccattcacccacattttgttagcatagatgtttatcagatctctgctgagcaccgtatattgcttctaatcatacagatgccttaaatattaccagcttgctctgtaagaataggctagtgctggcattttcattatcaagtgaaagtgtttatataaattatttttacctgaatgaaaaattgttaactttataatgcagttaatcaaagtttattttagaaatgaagtcattaaacctagtattaaatttgagttttaaaattaaactaccagtttgtggcctaatgagccccaaaacatgccaacattggggaaaatagatcttgttttgagctgaaaatgctatccagacctacttaactttgacctcttaaatgagagccattttattttatttacagataaaatatgctgtagcattattataggactgtttaaaaagacagccaattaaatataaattttatggaatataagtattccataaaattttggagtaaagtaggtgacaattgtaacctgaagctctttcaatcttgagttgaatttattaagaaaaatcaaccccccctagtggcggctctcacattgaaaattatctttattagtaggaaatacattttaaatgtgttcaatttaatcccactgaagtatctccaacatagtagactctcaataaatatttcctttctttttggagtaatgaaggttgggaaattaaaggctctgaagcaactttacgtccaattcatgttcctaccttcaagaagaaaatatcaaagataactttcattatagaatctactataactttgcttagactgttgccccatacttagtgaccctactcagaaaaagagaacaaatcctgtgtttattttattctctttggaaatgaaagtgtttatttattttgtctcatgaagatagtcaaaaaggccattatataattaaatagaatgtttttccctagtgataattttgtatatatttttgtatttttaaggttttaatcataaagaaaaagttgtaatggatttcagcttacctgtacatagaaagttggcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccatttttaaaatagcatctaaaataaaagaatgggtcttttcatttacacaattatttctccatcatttttctttccaatagctttagatagcatatacatagtagttatggacacttgcttattagaactatgaaatgaagtaagtgaaagtgtttagttataggtaacattaaatggcaaaaagaggaaacaggtataaattgaaagcactggatctaaactaaaaaatgaggtctagtttcttcactgttacagatctgggcaagtttcttgaccaataaagcacgacagtcagcacctgtactgctactctcacaactaaaacagaacaaaaaaaaaatatatatatatatataaactgtgaagactgctaaagatacaaatgaaacagaaacgtaaattctattcttttagcttacattatcacagaacaatcaattcgcccgtgaaacagtaagaggcagtatacgattatgttctcaattacggctacggctgaaatgtgctacttcactggtgaataaatttacatagtacgtgcttactcatgtatttaattaagacagttacttagaaataaataccatacaaatcttttacaacagtacctttctacttttatgcttcttttaaaattgatattttgctagtggcttaatatgacaaaagatgactgtttattagcacttattctgatacaagcttgcccagttctttacatcattttcttcatttttataatagtactaaagaaaggtagtattatttaagtttatagatagggaactgagattcaaattcagagttgctcagataatgagaaagagtttggatattggatcccaggtctttttgcttcaaagcttgtgttcttactgacttgtgttcgtactgtccaggtgaacagattcagtgatgcatacagtacagccatatcctagggattttcactgtttcttctcagatagtgttatggctgaaataaattatttgtcatttcccatacataatttgtacttgctcatccccatacttgtgtttttacgtcctttcctcttagagtcttttctcctgtcttattgatttgctacccacctcccttcctctttaaaacattgtttttaaaggctgcataatactctgttgtactaatattctataatttttttaactgtttttcttttgggaggaaattttattcccaaccatttaatactttaatatttcagagaatacccttgggacgtgtaaattttaatgcaaatttatttttttaggaaaaaattcctgtaagggaattttgggataggaaagtatgtgttgttttaaggttgaaccaaatcgtacactccaagagatagtatcaaattaagaaaaatttactaattacattccatcatcaatctggggatgtgactatatctttgcatttttgcttaaaaaatattattgtcaatttcataggcaaaagtgtggttggtaattaaagttatatgttgggatcatggttatgtataggagaagcacttgtatttgcagattttctacttagggtgtcctttacgtattcatttgttttgtcttacatttttcagtcatcttttagtttgttctttttacttctttctattgaaatattgttttaaaatgtattcctattaaataatactggcagattttaaaagtcaattatatatgtggcacatcttaagtatagcatgtgaggccttatcttttgatgtcttactgtggtagttagggattttagtgctgtcttgtctcactttaacctttttcaccttcctgcatcctcccaatatattttatcacaattttggattatatacacattagtgttgtattatttttgactgtatattgtttactgtttagctaagtaatatactgtgattatatttgccttcctgttctatgctattattgatttcttttctaccatcttcctgtttattagcatctgggtttagctgtcacttaggttcatcggagacagagtttgtgtttctggctcctgcttttcttgttttggtgtggttttctggaagagaagggtagttgcagaaagctagatattctgccgtcacagaaacagaagtgtcttgcctgtatttaagacccgatttagatgccacatctccatgaactcttttgcagcacctgtgttactgagcaatatattatgcttgattttgccatgttataaaatatatttcctcctagtaggaaaaagaatgtctttaaagataggactattatttgtctttgaaactaccagagcttcccagtacagtaccatgcacttagtacatatttgagatgtactaatttaacaattaactaccacttaaaatttttttggtaatgttttagtgattctggtaaggcagatacattttatgcgggttcgagggggaataaaaatgtgtgtttgcgtagaagaagggggaggggaaacaatgagttttccaggattatggaactagtagtggtttctaggccatatttcattttcctgatcttccctgctaatgtcttgtgctagaaactatgctgtttatatctcatcatctctcctcaggtatagcaaacaaaagggaaaggaaagaactcatcacaattatagggcagcagcaggagggtggcagaagacttctgactcattaaaagtggcttccagccagaattctcagaagtttttgtagatgtttttgactcatatagggaaataaaatatccagctgtgttcagcctgacaatgaagttggggtctatttgtgctatgtgtcacctccattacattaagcacatagtttatgattgtaaatatttgaaatttatattcagagataaatacggatgcactgaagctgggggaaggaaacgaagaatgaatggggttaagagttgggctttattgggtgtaggtagtatggtagggggattttattgaggaatacttcagatttcctagctgttagatggagagtagcaccatagtgctgagaagcgggtgcccaactccaggggaatgttgaatggaagggcacagggtcaggtacagggactggaaataaagataaacaagttatgggtaagtagaccaacgcagtaagagtagattaaatcaccccgaggaaaaatccgatagagcaaactcagtactgtgagaggcaatctcttgttaaaaaacgtcactttgatctcataggattactgaaaccatatctttgcatgtcattttgaggttttataatgaatattatataaaacagttatatttatgagtaaacttggttaattttttcagctttgcttcaaacactggctacaaatgatgaacctcatagacttttttgatggagatgttaaaaaggctttcaagatagcattcagactggcattgggcatactgttgggcctgttaccaccagcagttaaagcttgcagggcttctaaacagaagcatggcatgcagtcagctggagtcttgatttcataacaattttacagattgggacaagatttttgaggtaaaggtttcaaaaaataataagttactcctttgcctgaccaacatcatacggtctatttcaggagatgtttgaactccagagctcccaaatccaatcttacagggatgtttatttatatttcaaacaggcttttccttaaataatggttagcagtgtcctttcttaaagattcgaagacaatacaaaagtaaaaatattagcgtaatccaagtcaagtgcagttaatgtaagattactctatttttaattgttctgtatatcttcaagatgtatggatagatattaaatattttaacaaaatctgtacatttctcacaaaatcagtgaaaaagtgggtcaaatgcattacctttgttagctttaacaatctgacattttaaaagcttcaaatccagtacatctgaattgttaagttctgagggtacttcttagccctgaccttaattcctctgtgtatttgactttcttcctctgtgtatttgactttcttctatgacctccaaaatattctaccctggtttttttccgtctatcatttcttctctgtgtctatgcctcttccatagccctatacctaaatgttggtattactgaggtctatcctcaagccacttttttccttttctggtacagctctcattaggaaatgtagttgttcttctgagctacaaatcgcagaaccatttgcaacctctcctcactcaatggtttcctcttccttacttcctatagtgagttagtttagttcagtgaacatttgagtctggcttaaatctctcttcaagccagtcctttcttaacctcactgtcactgcctttggtcaggttgtgatcattccttttcttggcacttttggtcagcaaacattaattgagaatccactctattatgctgggcattaaggatacaaaaatgatttaagcttacatagaaataagggtgttaggcaaacaagtataagcaattatgttacttgacaatggaaatttgctctcatgttaaatattttgtaagacacatagtaatgcattagaaatgtagacaattttgcattatgaaaagcaagcctcagaatctagtgtgaggctgaatattgcaaagagccagcacaagacaggcagcagtaccacatggagggatacctttatgttactattagttctccctgtgtcatagcatgttgccttgtttcagcgtttgtgtcactctcttctctccagtgtttcataatcattactggaaagccaccaagagtgcaggactggattgtgtacacactttctatttctgtgaagttgtttgtatggaatattccttaatggaatcattatattagacatttgtataagaagtcaaatggggcagagttgctaatccattgtgaggtaggtcagggaggacttcatgaaagtgatctacttgagcggggacttgaaaccaatgggacataacaaggaggttgtatgaaagcactaaaccacatgttgtaactgtaagtaatttcttagctctggggtagaatagacaaaagcggcttcaatagaagaaatgaagccagaggggtaaatgaagctagaaagatcatgaaggattttgtgtgctaagctaaggaacatggacagttcagagctactgaaggagtttaatcagaggagtgacacagtcagatttatgttttagaaagaagttcctggcatcccggaatcctaacttcagcgaaccctgccctgctttctgtatactctatcaccagagtcagcttggtgaaacacaggctgatcttgtaaatctcagctcaacacttaagaacagatgcctaagtccgatttctatcgttactttgctgtctcctctatcttgaacatttttgcatcagacacccacatagctcacttcattttactcatgtctgtcctgaaacatcacatcagagagaccttcctaggctgtccaaaccagcatcacgtctgtcaccccttagtttcttaccttgctttatttttcttcttagcactcaccgccctaaaagttatatgtttatttgtttatttctccatcctccacctaggatgtaagctccatgacaacaggagcttttgtatattttgtttacctgtaagtgttctgtgctgggcacttgataggtgttcagcatttgttgaaagaatgtggccccaaccatccttcttcttttctctctttcaccctgtgcctctcccttcatgtgggggaattcttacagttcactaatccttagttatgcctcttcatgaaatcctgtccctcactcaagatccatctcagataccaccttttctgtaaaatcttttttcaagcagttgctgcttctgcttagctcccataacactttttgaatagttaggagaaaagtgtttacctgggctgtacaggatgtgatggatataaataaatacttgtcagcaagttattaattaaccagtagagaattacacaatgaggtagacaagcattataggtaaagtttgaaattcagttggttaagtggagaagtgaagtaattaggtgtgacttgaaatttgtttataaatgcaatatgattaggggaaaatagctaggggaaccatcaccaatttctattatatacacagttgtacagacaacctggagaaggtatctgttgatacatacataaacacacacacacacacacacacacacacacatcattttaccgatgtattaccttttttgtagaagtatttacttttcatcttctttctgcctaaagtattacttctccacatacatcactgaaaagaaattatctagaaatgttttgattgggtcatattaatagcactatgcccaggccaatttctactttacaaaagctgatataattccatttgaattgtcaaaaatgtctttgttgtaagaaaacgctagataattactcttctggctaacaggaaggtatagaggtataaggtataaattactttagtttcccagttcagcgtgggtatctgatgatttttaaattcactttaagtgattaatgtctgctgtgaaatcctggctggggtctttgtgtgaagttattcaacttttcttttctgaactcatgttcctctttgacccataagtgtctttattctcaggtgaaaatcatgctaaattgtttagggttccgttgaactttctaattgagacacaagctacgaaagctaataattaagtataattattgtctacatgtaaaagcaaaagttgctggtaatcaccattaacctctaatatttgccaacaagaaatgtaaatagcaaaagtcaaatttattcttcttttaatatttgaggaccacattagatggctggaggaccatctgcaggtgtcagaggggctttgggacattatctctaatgagttgaaagtaaataaatacagaaagctggtgatatgaagataaatactttatttagggttgtccttgtttattgacaacgtcaatgatgctgagatgcttcctgtggaagatagcaaaggaagtatgattttcatataatttatcacaaatttctctttttaattttccaccaaacaatggctaatgcatttgagaggggaaaaaaatcccagtagatctgttaattgggaatcactgtgctacaaatgcttgaagtataagcaaacattttcctatgatgagttcataagctttttaatgaaatattcggaagaatttaacccattccctgtttttcttaagatgtgaaaggaagattttagaaagacttacgtaaactttaagtagactttaaaagtttgttgtgttagagaaatatttgaggagatgttataatgcaatagaaatttttgctttatattttttaaaggattttttatggtattttgtttgtttttcagagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatggtaagacagaagggtttaatttgtctacaataacgtataaaaaatacttgtactagatatagctgtttctgtgttaataactacaaaaattagccgtatttggaaaatttattgctgtatagtaaaatttcagtggcaaagccagatttataagtcttaaaatcaattttccagttttattcacccaacagatgcagccactgaaatgatgcatggtatcattctttgaaaatcatatatttagaagttacactcaaattgattatgtcaaattccagtttcccttctacttcaatatttaaaagtcttttttaaaaaaaaagaaaagataaaacaccatcttgctggattttctgtgttttcatagacatgtcattttatttatccctccaaacttacgtatatttctaatctttttttttttttttgaggcagacttttgctcttgttgcccaggctcgagtgcaatgacacgatcttggctcactgcaacctctgactcccgggttcaagcgattctcctgcttcagcctcccaagtagctgggattataggcgcccaccaccacgcccagctaattttttgtatttttattagagatggggtttcactatattggccaggctgctctcaaactcctgacctcaggtgatctgcccgtctcagcctcccaaagtgctgggattacaggcatgagccactgcgcctggcctatttctaatattttacattaattgtataccgactgcaagaaatataattaaaacatgtttttcactagaaagaacatttgattgtaagagtcaatagaatttgatttcattctctattgtgtcactgaaaactgtttgtcattaaccaaaccaggtagcatccccgtatctcagttttctcagcagtaaaggttggggttttgagctaggcagctggatgatatttgttacctttaaattgcaatggaagtttttgtttgcaaatgatgtttcagtgtattttctcatgtaaaattaatttttgatttatcttttatctgtctataaggcagaaatagattttttaaggaaatggtctttttaaaatatcatataattttactaaccatagcaagttaatgataaaatctcagtgggctatgtcagtcaatgcttctcatacattaatgtgcttacaaatcacatagggatcttgttaagatgcagattcttgttcagtagctttaggtgtgtccctagattttgcatgtctaacaagctccgagatgatgctgatcctgctggtctaggtcactaggaagtgcctagacaacacgtttatggatatttgactggtaatttgtgtttagaatattgcaacagttaatttccctttagatttatgtttacataatctgatgtgtttcgtctgagcatctttttattgatttgcttgcttgctctcccgtctttcttttggacaaaagctatttagtttaacagttgtggtctgggcaatatacagatttgaggatagtgatttcaggaaagattatatatttcaaagtttcatagtacacaaattttctctgacctatataaaaagtgtttgaattttcagttgcctctataccaaacccttcatcttgggagaagagttacgcagtattcagtgatggtctgtaagtatgtgtgtattagctatagtcatttagctgacatagttggaactagaactcaggtttctagattccttatattgtttttcctgaccaaataatacctacttttttctgggaaccttcgcataggaaagcactgaggattttttcctagacctgtggttcttaaaagtgtagtatccagacaggcagcatcagcatcacctgggaacttgctagaaatgcaaattattgggtccaaccctagacctgtggaatctaaggtggtgggacctttggtgatagggctagatgcatattgaagtttaggagccactgctgtagattgtaacttcaggcctcctcccagcgtcacggaatgctgtcctgatccctagcatttactcacatgctgtgcttagtgcttgaccatgtggtggcagattctgtgatgtgtaagacgtggttgccacccttagagattctggagtctagaagccaaggaggcattattctctgactctgataaagctttattgacttgagtcattttacctttccatttcttgttcctttgtaatggggaatcaaattatatatgttaaaaagaaaaaaaaagtataggtttttcctctgtttagaagtagtacatatgtgtgtatctagacagatacatataaatgtgtgtgaaacacacatatataaacagatatatttctatatttaatgtctacattatgtgtgtatgtgtgttcatgtatgtatacacacagacacatacatgattagataagtgtcctattattcagtgcttcaagtaaaggagatctcacagtctatcttataaagcatgtcatagtttaacacagggttcatcacggaattgttaaaaacttttttctcagctcttcattaatgagtttgtctgttttttattctggttcagtgtatttgacagtaggatcttattacctatttgcatgattccttcatcaactacattatcattatctttaacgttagattcttttcaaactgcattgtgcataagaattacctagaaagctttttaaaatgcaaatttggaggcatgcccctgctgataacaaggaagttctgtgtaaaacccaagaatcagtattttaacaagcatgttacggagtctgaggcagtgatttagcctagccttgattatgccctgaacaagttaatttttgtttctttgccttcagaatgacaaatgcaaacatacaaaatttaaagaagtctatgaatatttttgcttgtgttatagtggtgtacattcagcctaagcagtttcttagattgtttgatacagaaacatacagttagatggaaaatgaaaataataaggttttttttttaatccccaaatttcctccagactaccagtggtctggaaaggcaatgcaacatttcagagcacacagagaatgaaattataagggtgacccttatgaactgaaaaaatggtagatgcaaacgaagagatttgaaacatgctaacaatgattaggatttttgtgtgcagttggacccactcttccactattagggaaacagtatagcgaagcgaagggaagctcaaagtgaataacaggatgcaaacagggggtgtgtaaattcctgcggaaagaacaatataaacgagtaatcatacaatcttgttagaaaggaaactcaagttttactgtaacaatagatatttttccaagaaaatacatctatttattgcaagtttaaataatccaacttggatggatcttcttaaagtttggaaccatgactatactgctgctgctgtctgaaaagcaacactataaagttttaagtactacattaatatttatccatttctaattaattaaaacatattgaaatataactttaaaatacttgaacaaggcttagcaatttttcagttataaagtcgaaaatagtttctttgacatgatttaagcattacatttaaatatattatctctgagatggagggtattttaaaaatttaaataacaatggttacaatcaataatagtttattaatagagactaggatttgggtggttacaatctaatctttgaaactggttgatgtgaagagaaaggattgtttcctcctatatcatgtctctcaaaattgttaaacagtgtacactgggcttgttgatcaatctaatcagcattgtaatgtttcattcctaatttcagcatatctttaatacaatttttaatgagatttccttactattttttgaaatgcccattattatgtaaatattttgttcaaattattctgtttttatacagctgccccaaaattgagaattcgggaatgactacttttgttttctgtttacatacaaacacctaatgagcctgacaaaatggagcttagggatccgagtttctgatttcaaagtcttgcatttgcagctgtcatagggaatagtagtattctagttatttttaaaacaaggtaatgttagggaaaatctaagtcttgaatcattatacatgcttaaaataatcaccattttataaaatgtagaattatttacatgttaaaatattttcattcattaagcctaaaaatgctgtgggaagagaggataatagttatattatgtgatgatctaacatttatttgaccccattgtttatcatggatctttcttgactttattttaaattaaaaattacaagtgctctgttcttggtcttccttttgcagatgctttaacagttcattcccagttcattaggttttccaaagagagctattgtgtttattcatcttcagcttgtgcatttctctgaatttcagttgttttggtatctctctagatcagaacattattcttgaaaaacaagtatacgtacatgtgtatatgcaaagaacaagcttgaacaagcagtaaaaatgaagtaatgcacttctaagtgttgatgttttataaaatctaatagatttgtatgtctgctttttcattcatgagaattctataatttcatctgctttgttgtaattttaaaatttctgtgtgtcaagtaatttaccaaagtttcagtatgatagtatcatagcaaatgttatttcttaattctaggactatccaaagtaggtttgtttgcataacagtttagcacatttgaaatcaccaaataaagtatttgttgaatttgatttacccatggcattatccatcttaaatggtgatttaactgttatcttttttcctaattcacattttaaaacatgaaactctaattacaatattcatgataactttcatagctaaaactatataaacctaggttcttttaaaattttaatttatggaacccctgcagatttaaacatgaataaatacaaagaatagtagcgcattcttattgaatgaatatacaaatcctggctctcatatttaatattgtgacctctttggttcaggaatttaatctctcttttcctcagatatcccaatttacagtataagatttattagattatatgaataaattaatatgatagaactttatataggatacttttatctctgcttttgtttgctttgacaactattttgaagaacacagtgacaaatatctgagattcaaacaatctaaactcattgtatcatatattatgtattttgctgctttcctgtctcttttaaatttactgatttaatggatttctctttgatcattacctagtcttgcatggttctagaatccttgcttatttggccatgaacaggtcattagtcatcattttttttctttttagggagactaccgtgggctaacattaaaatcaccaactttcagcaattttccttttttagaaaattttcaaatacagacatttaaaaatctgtagttaagtcttaagatatttcgtgagggtttgtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggagaacatgtagaataagaggaaaagtaccaaagataagatgttttaaggatgagcaggggtagtaaaaagtgaaatctgtggagtatgaaagtatgctaaggtgatagagttgacttaagatactttcatttgatgtgttcttaaattggagagccagagagaaaactgtacatgaaagtgaaaactgaaatgaaatgaaagtgtaaactgaaatgaaatgaaagtgtaaactgaaatgcaatgaaagtgtgtacagaaaaataataacactagagaaggtgatttctgttccttgtttgtccatagaggccaaaaagccattcagttgttagcagtgggagattaagagggagacaaatgtctgggctctgtggctcatgcctgtaatcccagcattttgagaagccaaagcaggaggactgcttgaaagcaggagttcgagaccagccaggacaacgtagtgagacctcgtctccatacaaaataaaaaattagctgggcttggtggtgtacttctgtatcccagttattcgtgacactgaggtgggaagatatcttgagcccaggatgtcaaggctgcattgagccatgatcgtgccactgaacttcaggagtgagactgtttcacacacacacaaaagacggagacaagtagtctgatgggattggttgacataaagaaccttaatgaattgtacctactgaattcttcatgtattttctagcctgaaattttctcatacaattgtcatatttacagagcattctgttgtcagctggatttttttttatcgtgtctaatttctgtgttatggagacatttcatctctttatctcagcatggtagagggaggttgtgttttgtgattaaagcactgacagcaggagctgtggatgctagttcagttaacgaatcttgtgttttttgatagactttaacctcactgttccacagggtcttcatcttctcagcatgtttgataaagatgcttgcttgccctgatatattaggtttgtagtaaattctaaaaatgagagatctgtgaaaaatttttataattaaaattgttactgttatggaaatcatagttatttcctgcagaatcctgatatttcacttgttttagtggagaattttgttttttttttttttttttgaatatgcataagggcctttacggacctggtattaatatcaattgagaatccctttgtttaattaatttcatattttttatttagagatggaaatttgttaataaactgtttttccccttttgatataatacataataatttacttacatatactgttttcttttatcgaaagtggcacatattccaaatctggacacttggaaaagtgtgatagcttgctttggtgaggatagaaattttgggcattgtatgctacttgctttattgggatacatgtcaaattttctgttattgcgctatgtcttaagataggtgcttcagcttttgtgtttgtaaaattgttattatttcccgaagaagttcacaataataactgtgctgaacagcatggaatgataattttaagaagtatgagggaattcaatccagaacatacgtgagttatttcctaaatcctgaggttctaagtctctgtttctcaaagaatggcacctcattctcagcatcactggggaacttgttacctatgcaaactgtaaagccctatcctagacctactgaatcagaaattctagaggtgtggctaagcattgtattttaagccttccaggtgattctaatgtctgtgaaagcttaaggatcactgccctcattgagtatttacattatgttacttaaaatgcaatttaaatactactcttgtatatatgaaaagctaagtgcaactcattccccactgaaaaggtcaattaactgctcttgttccattaatgcagagatttgtcatatagttatagaggaattgtataaaactgagtgcgtaccaatgagtaactggaagaatgttaaacatctttggaagtcagtttttatgtaagagtttggatagaacaaacttttaaggactaccctgccaaagtagtaaaggggatggtaaatattatgaaattaattgaatttatagcagcagttagggactaaaaggggatatgctttccctggcaagatcatctttctgtttaaatgcaaactatagtaacaaaatacaaaatatagtttaccactattcggtattcctcatgaatttttttttccttgaccaattcaaagcatgggatatgaagagatgtggcatttagggagtaggggaaatctgagcttagatgtctaaggaaggaaagtaccgtattaggaaacatggatatggttaaatgcatgtgggaataaaacttgagtcatctgtggtatgaccatttgataatgctgtgatgtatttgcactctaaattccatcatttgttagattaaattcttatttgtattgtacgactccttcatagatctttcaatgaggaaatagtggaaatattttggtggtttactatcttaacattctactgaatgttcagagtctgattctcacactttggaaagtggtacatatcctcactgatggggaagattttaacaaatgcccattacggtacagcagatacttcccagctggtgacctattttcagatactacattttgtttctgtggactgtcataaatttaattccagtggtgtaatatttaaagtgtcgttatgcatataatttatgtaacaatttacagttttgaagtatagttgacccttgaacaatgcattaataacatgaacagccgattaatgtgtcttttgtatatgtattatatactgtattcttaaagtaggccagagaaaagaaaatgttattaagaaaatcataaggaagagaaaatatatttactgttcattaagtggagtggatcatcatacaggtcttcatcctcattgtcttcatgttgagtaggctgaggaagggttggtcttgctggcttgggagtggcagaggcatgtaagtggacttgcatagttcaaacccatgttgttcaagggtcagctgtactttcaaatgtgtcatatagttaccatagtaatcctattagatactaattactgctttccacttaaagatgataaaaatactcagttacctccttaggggcactttaattgtaagtttctcatcatggtttgagggtgtataaagtcagcatagacttcgttacctctgtccttgattgtcagtgattgattccaggcattaccctggtattgtacatgttattttaatcctcacaagaatttgtctcaagaggtagcattgtcctcatttaaagatgaggaaactaaaggtcaaaggtagttagcaaagtgggcggtggctaataatagctcacacactgaggtctggctacctgagtttttgtctaagctctgccacttaaatctctatgactctgaacattttctcaatctccttaagtctcacctttctaatatattgaaataacagtgtcagtctcatagaactattatgaagattaaataggatataatacgtggaaagtgctaggtgtacagtgtgtgcccaatatcacatatgagtactaagtaaggtcactccaatggtaggaagcagctcttgtgacagtgtctcatgtcactttcttactcattgttttctttctaatcagcacaagcaatatatacatgaaaatgagtagtattgatagagcctctagtaatttactaagttagaggtagtaggcatgagagcaagaaatagaagaaaaacttcatgcaggggtagacattacatagtttaggctgaaaggccatgacataaaatgtttcctgaaaaagcacagcagtgtttttttaaatgattttaaaagtccacccttctcagactcatctttgcacaatatttacttcaattatttaccagtgattaaccttaaacacaagagcaacagaaatatttgcatatttgtttttggtagaaacctccagtgatcattccgccaaatgaacttgtcacttttcctacttatgtagtagttacacatattatctatcatccttccaacatttggaattataagcattgttgtttagaaagaatttgttctttttattttttctctacttcaagttcctgtaatactttaattaaaccctattctggtacttagtatttttgacattgttttctagttatttccatagcttatatcccctacttaaagacagggtctgactcaagtgtctaattacattggctaatactcccagtacaagcccaagaacaaattataaattactctaagatgaatggtctctttcattgcttagtcatcttctcagtgatcaagtagttatctcttaatatttatgtttttctactgccagtgactctaggtggaactaatatcaattgtgttgattaaatattaattttaagagattccaaacaataatttagatatataaagtctgacactgttattgtccgtttttaggcttatttcataatgtaagggtttggctttgttgttttctttttaaaagcaagtgttactgatgcttcataccagagcttttagaaaagtaacagaatatagttgactctgacgttgtatggttttagtgcattcaagcaaatgtggccattagtaagcaagcaacaacataacttaccgaatagaaagggagaaaaggccattctctcttctgccattctctctgtgtacagattaaacatttcctttggtcttgatgaactgttaggtcagtttacctcaaactgttttttggcctaaggaaatctgttctctggccttttgaagttacattcagagaccgtgcttttggctgtttcttgcaaagagatatgttttaacttctgcaaaggccagaatggcatgagattctggtgtgacacattcactgatgatttaccagaaaatacactgcaaatatgaaagactgcagacaggttttatatgtggaactctgctcagactgagagaaagtctagttattagtaaatctctagttttttcagagctggattattttgtcacataaaaatatagtgagataaatgttaagaggactgccagagtcagttttatttaatggtttctcttattcaaatatcacaggttaaaagaaggtcagaaagtggcaagtatctaaaagattatgctttataaccaagcaatccataagctctgagaaatatttctactaattacagctactgtttgttgaacagtattgatccactatgtgtcagaaactttacatatattctcattactcttcacaacagccctgcaagatgtgctttaaaatttttttttttaattaccacctcacatattaggagacaggctcaaataactcccacttttagtaaatgtcagaggtaaggtttgagcccaattctgtcagttaccaatatccacatgcttttaagtgagataatatttgaaagtgcttggcaaaatgtttaagtggtagctgttattatttctattcagctgcgcttcctcccagactataaatacatacataccacacacatacacacacacacacacacacacacacacacacacagtgaggaaaaaaaagaagagatagcattataacatgacacctccaatagtaagcatcctatcatgccatcagactttccttcacatatataatccacaagcagttaaaagctataccggaaaagccactttacaagatgtaatacctaggagtaaatataaagatacctgtgcacatcttttttgtagacaactttaaaacattctagcaggacaaaatatagacttgaacaaatggaaagaaatgtatgttcttggatagaatgattcaagattataaagacattaattctccatgagttaatttataaatttaacatgaacctattaaatagtcacagtaattaacagtttttacccaaatgctggacaagaagattccaaacatcagaaatccgtctctcaataaggtgtatagttgctttttttctcctcaccaccaccagttccctaatatttcaataaatacataaaaatgttggattcatttttataggttacattatggagaactttagtctcctaagaaaggaggtaggagtggagaggagtgtttgtaacagtgttgtgcagttctttgaaactcctaagttttgtgacaaaattatatcgtgaactcatcaaaaattatttttaacaatctgtcagctgacaacttgactaaacccttcagttttgttactagcatagaataaggagctacccactggcaacaggattacttacctagtatttattatttaccttgttttagccaaatactaaaaataccagtggatgccagtatttcaaattgtctttgtttggtgttcagaagttttctattatagctctttactcttgcttacttttaaaatcattgtttttcctttttttccatagttgcattaaaatcctcccctactgaaagaaacggaggccaggataactgtagagcagcaaatttcagagaaggcctgaacttacaagaaggagaattcttattacaggtaaattttagtaaatatagtttcttacactaaggacagttgtaaatggaaaatgaattaataagtcttttagtaattccctgtttacttaggatttgctcaatgttttttgccactttcatctgaactgcgatagtgaatgatgcttaatacatgaaaaactggaattatagtcatgcaccatataatgatgtttcagttaacaacagaccacatatgcgacagtggtcccgtaagattataccatattttttactgtaatttttctagtttagatacaaaaatgcttaccatgtgttaaaattgcctacagtattcagtatagtaacatgctgtacaggtctgtagccttggagcaataagttatactgtatagcgtaagtgtatggtagactataccatctaggtttgtgtaagtacactctatgatgtttgcatgatgatgaaaatcacctaaccacatatttctttgaatgtgtccctgttaagtaatgcatgactgtatatgaagtagattagttagaagaccggtcaaccccttctgttgtattaatatttcttcaaacagcaagaactcctagagtattttagaggttctaatttaagatgttgaatttatatatatttttatggaatgtatctctattaaaattgttaaatgcatttcttaaatagtttaaaatagttcttaacccaaatttcattttgccaatatgttataacttacattttattttagcaactgtttgtgacttattaacatactaaagattttctcaacaactccaatccctatttttatgcttcagaatttagtttctaatttgtctatgaaagcattttgcatctttttttactcttttttttagaattgatgccatgattgattctcacttaaaattctcagatacttattttgttgaaaaaagatagaataaagatgtgtgccatgtgtgctgtcaccgctatgtgatcattatcagtttcacccactgaactgactagaaaaacttcaccattgttacaaaaagtaaccctaagtttcggtaactccactagttcattcagtggatggtgatgtgcctaataatataacatttttattacaattgtgtaatcacattcaaagtcctgttagcaaaaattaacttatgttaaacaaagtaaatctattaaagcatgagtcctcccctagccccaactgaggatcttcatgtatatgtaaacccaaacataaagactccttattcaggtcataggaaagcattttaataattgctatttaagatgattaaacacacctcttgggttttctactaagggcctaatgaaatcctgtatttcaggtgaaatagacagatatgtactgattgacgtaacacttggcaagttggtttaaattatgggccatttttatttttttcccaaaacatttaggcaaattgtgtacataccctatgtcagggaaacagaataacaataatatgaatgcaaagctgtaaagctataattatatggaatatatatattttaaattatctgcaaattggtaacccttaagaagttaaaataaacttacctgtttatattgaataccatttgtagattgctcttttaataggaagactcacattctctatgattttcttaggattgtgcttatatgttatctttttatgaagaagatgactaaaaacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagatacccaggaggctgaggcccgagaatcgcttgaagccaggaggcagtagttgcagtgagcagagatcacaccactgcactccagcccgggtgacaatgcgagactccatctgaaaaaaaaaaaaaatttattaaaagtttaagacatctttctaggttagcttcaatttattactattttacaaggaataaaaatgaaacaatgtgaataactgtgtctttatttacttcacatgtttatttcataagtttaaaatatatctcttgctatttaatactgtattgttaaaatcttgcagctttgtttttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttaatcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagaacacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagtaaaaaaatagaacaaaacagtcagaaccatgcaccaatttgggatcgataacacataaaggcagcatatcatgttatttaagtgagtacgctttggagccagactgaatttatctcctggatcagccattttctggctatgtgaccttgggcaagttacttttaaaggtatagtccttgacctcagtttcttctattgtaaaactggaacatggcacttacctcattgggtttttgggagaagaaaccactcaaatacataaaaacatttagaaaaaggaatactaaataatagttgttatctttgtagtcaagttcttagaagtataatatagatcaagaatcttgaaggtggaaagtaattggagtggaaagagagacagtcactgtatttcatttatttcatctgataatgaagatatcgactggactatatgtgagcagcataagcactagggcaaagacttgttaactcttaaatcccagtacttagcatacatatctcctcttgggtatgtaatagtttattacgtgttgaataaatgaatcactattatttatatagctctttatagttctcaaagcatggtgatataaatctttatttgctcatttctacaaccatataacattgtaccttattacactgagtgctggctctgtgccaagcattgagttaggtgggatatcgtcattatatctacctgatgaagtgccagtttttgaaataacactgaagcctaaaaagcagtaaatagcttaaccaaagccacacagctagtaatagacagagacaggagtccagaccaaatctgtctgactacacagtacaattcttaaactaaaccatactgtgtttctccttacatgaaaaacagggtgttagaagacattagctgtgatcacatagtaaagaatagatcaagtaccaaattgaactcaaggagaaaatagtgagggcttgtagaattaaaatatatgataataataaagtgatctatgatactattgttatccaagaggagaataaaggtattagttgatattggacttgaattatccagtaataggaaaagaaactataacatccaaactaaagagtatgggctaataaaaaataatggacccaaagtaggcaaaacagagagaaaaagaaacattatacatgtgaatgtgctgtgaacaaatagaaataacacatataaaatgataaatttaggtatgtgttcataatgacattaaattttagtggactaaattcactgtatgcttgctttacatgtgtattatagtttaattacatgtatattttatatatatagtgttttcctgtaaaagtcttaaaatgttctgtgacttaaaatgttagcatcagtgcttgaaatgtctttgtacaagaagagttttctattaatgttcccagtttaagaatctaatcaacatctttgcctcctgtttccctctaaaaaaaagcagtgtgatagactatagtgaatgatgtctagtttgttttttaaaaaatatatacaatatatttaaaagagaaaatctgaaacatgaagaagatgaattccatattctaccaaagttattctgattgagcattaaatttagccatttttccatagacaaatcaaaaggtatgaatagatatttcttagtccaggagtgtatgttttggctgtgtttgtgaaatgtgacaattttaactattttgaagagaagaattttcagagataaaagtaataacctttatctgatggtcaatattaagtcatattactaattttagaacttcctttccttgtaggctctgaatggctttgtattagttgtcactacagatgctttggtcttttatgcttcttctactatacaagattatctagggtttcagcaggtaagtatatattatttatatcatttatattattatatcatttactttttatatatatttaggacacagttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaaggacaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaactttcggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccatagaaaagcctgtttgaagcctaatgtattatataactgtcttaatcaggatttgatattgtgatttatattagtaagaaaatcagagagattagccattttccaatccatttttttctcgcatatacacatggatttttttcctaaaagaatattcatatctgacgcaagtggtagattaagacaccatttttaaaactgcaagttatgactcgctcatgggtatgcagtcgagacagtggatcactatcaaactgttttttagttgtttaggatagaataaaataatatagaatacacagtgttatctcatgtaataatggtaagtgttttgtgaaacttttccatgtgtttatgtctgtgcacacacctgtgacagatggaaatgtattttttatcataacttgcagttaaaaaaaaaggaaaactctggtttaagcactaaggactcagcaccgtagtaaatggtgagaggcaagagaaggaaagtgggtttaatatggtaaaggcacaatcccttgctcttgtggagtctacttggagtgaaaattttatatgaagaaaattttagagaacagtgaaggaaatacataaagaataccattaagcttagagaagtcaaagaggcctggggtggttaggaaaagctgcatggaagagataagaatctaaaaactaacaaatgaatatggaacataaacagattttaatatgttgcatttaaggaatggggatgtgacttatttgagcaagagcattcatgttgggaactgatgacaagtaacttttggcttatctgttgtagtgccagtctctttagctttttctaccttaggttctatcttaggtgactagggaattttaggaatcattcaattcgtattcatcaccactagcaagcacccactaatctaaataggctttaaaattaatttagccatattttttaatcagtccttttgttgtattccttgtatcttttttctttagtctgatgtcatacatcagagtgtatatgaacttatccataccgaagaccgagctgaatttcagcgtcagctacactgggcattaaatccttctcagtgtacagagtctggacaaggaattgaaggtaagaattgatggtacaaaaaatagtgttggtagtttttaaatatgagtctgtgaaaggaggctgggaacctgtagggtcatagaactccatgatagggaagtagtggaaagatgtaaagtctgcaatcataggccacagctaggtcacaaagagcctgatgagctaaggaatattttggcaaatgagagccatttaatgagtttcaggcaacagagtattgccatagtcagtaatgtattttataaaaataagtagtaccttcatgaaagatggaaggaaggtacaaggttgatacctgagtgcatgtaaattattgtgtttaaaatgcaccaaagaaaaaagtaagctagcatatgcaagtataaaaatgcttttctcaatgcaaaaaatgtttttggaaatttgttaaagtgttaagaaaacaaaaatgcattagaaaatatgaaaattgttgacagtgatagctcaataaaaatttaaaaaattatgcaagttctatctgataaaagtgatatttaataaacttttagtttcttgtcattagctcttttgaaaatgatttttttgtattcagaacacagactccagtttagaaactaatacaaattttacctattcaagtgcttaattttacagcaaaatggaaagtaaattttgttttgcctttatttctacagaagccactggtctcccccagacagtagtctgttataacccagaccagattcctccagaaaactctcctttaatggagaggtgcttcatatgtcgtctaaggtgtctgctggataattcatctggttttctggtaaggtacaaaattttatgatactggcttttactattgttacaataaaagcttgaggcaaatttaatttagcaaaatataattcagcagagaactattcccaaatcaggcaaccctcagaaccagagagcttcagagagctcacttaaaaacatgggctggagcatttatgaacagaaaatgcaagtgaggtacagaaatggcttgattgattacagcttgggatttgccttatttgaagatgatctgattagttggccacctgtgactgactgagactcagctatttggttacaaaagtttaattctactgttaggctttccgttagcttatatagtaaatgaagttgcaattccttggtaaggacttaaggagcagaggcatcttcagcccaaatttagtttaacattaagttatagaaaaaacaagccaattttctttggttatctttgatttcagctttaaaaatctgctaccaaataatttgataaaggaaagtaacattttaaagtaattatttctgattttgactatcttctataactcagaaaactgttctttaggatatagtaacaaaaattgagtgaaataacacgaagccttgtattttgactattttaggatttttaaggtatgagagaattatgtagcccttttttaataggaggatgcttaccatcttgggattgaatgcctgctagacagagaaattatggcctttccatatgtctcaaataactgccacatagaaaaacgattgtatattcatgattgtggaatcatcatttgataggagatgctgttttcttgttacaaagtctgaacacctgcataggagttgactgtagggagcagcttaggattcctcagagtggacttgtctgttatctcattgtatccttagctcatgttaccaagtacaggagaagaaaatacaaagtatattgtatattctttttgtgaataacaaggaatttgaaacagataatcaaatcttaaattaacattaccaagcaatgatttttgtttatgtgtttatttctgaagaggattttgctgacccagaattagaattatgctttgagacagttttcccagtgttattgctcatgaacaattagtatgtagagtcatgtcctgcataatgatgctttggtcaataacagaccatgtatatgatggtagtcccatgagatcataatggagccgaaaaatccctatcacttaatgatgtcatagcattgctcacatgttgatggtgatgctgatggaagcaaacctgtgttgccagtcatataaaaagtatagcacatacaattatatatgatacataatacttgaaaataaaacaataataaatcactatgtatttactattaatcattattttactttatttttaaatgtattatacttttaattattttattttaatcattattttagaataaggttaactgtaaaacaggctcaggcaggtccttcaggaaatattccaaaagaaggcattgttatcacaggagatgacagctccatgcatgttattgcccccgcagaccttccagtgggacaagatgtagaggtggaagataggatcattaatgatcctcaccctgtacagacctaagctaatgtgtgggtttgtgtcttagtttttaacaaaaaaagtttaaaaagtaaaaaaattaaaaattaaaaaatagaagaaagcttatagaataaggatataaagaaagaaaatgtttttgtatggctgtacactgtgtttaagtgttattacagaagagtcaaaagttaaaaatgcaaaagtttatgaagtaaaaatgttacagtaaactgtgctgggattacaggcataagccactgcacctggccaaaaggaaaatattttttataaattcagcgtagcctaagtgtatagtgtttataaactctatagtagtgtacggtaatgtctcaggccttcacattcactcaccactcactcactgactaaaccaaagcaactttcagtcctgcctaccttgtttacaataagtgctcttatacaggtataccattttttgtcttttatactgtatttttactgtatattttctatgtttagatacacaaatacttaccatcatgttacaattgctttaagtattcagtacgatagcatgctgtacaggtttgtagcctaggaacaaaaggctatactgtatagcttagatgcgtagtaagctataccatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgtttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaagtaagtgagactttttcacttttattttattggatgtacattatgtttcagtaagtctctcttagcatgtaaaacatacagtgtatgtaatattgtttattattagattggctattatcgtacattcttccagtgtagccttttacagtaaaataatttaatcaggctcacaaatcatctttttaatttttgcaatacttgtctcaaatgatgatgttcttatatattagtaaggtttattcttctgatgacatttatgttggtttgttttacatttttaaatggcacaaatgttatttgatttctagccccagaagttttagtaactttcagaaaattgtgagcaggagtctgatattaaacatttatatcatatcaaacatatcagtgcttttctcctttctaatgtgggaatgcagagaggtaattagaaaaaccttcttccctaaaaatagattataaaaacattccagatttttattaaagatgttctgttacccatacatctgctctattagattcatttttagcatactaatttccatggatttattcaggaaaagaaaataggctgaaactgaaatttgcaatcataagcaaagaagatcagtttacatggatgtgtttaatttcacatctacttatgtgaaattctaaatgtgaactaaaacatattgcagaaactagcgtaaaaccaatgaatttatcttggttatttcatttatgttaaatcttaatccattcttattttacctttttttattttaaacagaggaagaattgttttaggatatactgaagcagagctgtgcacgagaggctcaggttatcagtttattcatgcagctgatatgctttattgtgccgagtcccatatccgaagtaagttgtagttccttatgaacatgtcagaagaaaacggcatatactgttgtacatgtttcaaattcttacgtaatgtaaagtgtttaagtaaagtatatggataaacttctacttagtaacatatcattatgattaaccagggttacactctttgttcattaacttgtctacacctgccatgtagaaatattgttgtttagttattaaaaaatgaccattttggcccatgaagttttgcttgggaattttttaattacatcgttatcaattcataaatctatgttaatattgtaacaataatagtgttaataattctagtttaaaattataaagtattaggctgtaggaaaatattccctatttaaaatgaaaataattttttccccaacttatgttctctctatactttcctgtgttactagaattgtttggtacataatcttccctttaacatttaaaataataaatttaaaacaactctgaaaaactatttccatgccttttattattttttgtttaaaatttattgtctttggggataaaggaaatacatccagaactatgtcacaagagctttgttttaggaataatctttactatattgatttgggggtttgataatttaattttttaattttattttagtgattaagactggagaaagtggcatgatagttttccggcttcttacaaaaaacaaccgatggacttgggtccagtctaatgcacgcctgctttataaaaatggaagaccagattatatcattgtaactcagagaccactaacgtaagcacaaataatgtttcctgttttaacagttttgttttcataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacacatgaaaagctagtgtcattggtaaaaaagaagaaaaatataacaatgctttatttagaatatattctctaaacccagcagtgattttaagagtttcttacacatgctgcagatgagtcctttatcaaatatttgtattgcaaatgtttcctcccactctggagaattgatttttgtctgtagcttgaggtaaggattgattccccccagccattatacgtatacccaattgaccagtaacattgaaaagatgatttaccgagaaggtcattgtttcccggctgcgctgtattttgatcaggggattttgtctgtggttctctgtctggattgtgttgttctattaatagctccattagtgcagttgtctattttgtctagcattacactgtcttagttattctatctttattatatatttctatgtcagagtgtgtcattttgtttgttttgccttttttgttctccttcaagattgccttggttcttctttgccctctataattccatatacattttagaaagcagttgtctgaaaatctgttgagattttgagtgcaattaccttgaaactgtagatcatttggggagaattaacatctttttaatactgaatctttgagcccatgaacatgatgaatgtatgtatgtgtataagtacccatggaagtacatgagtatgtgtgtaccatatgtatatgagtgcatgggtatgtgtgtacctctacaaatttgtcacttctcccttgatcaatgtttctagaaggcactttttttaattagattttattagtctttattaggatccaacttttggtttattgatttttttctattttatacatttgttttcaattttaattatgtctgctcattattattttcttccttctactttctttgggtataatttatcattttttgcaacttttaaaaaatatatacttaaacatatatatcagtttccctttaagtacagcattacaaccctcatcttttgctatcttatttttattatttaattgaaaatactggctaatttgtttttatttttattcatgaattatttagaaatacagtgttactgtactttttggtgtttggggatttttctagttgcctttttatgattgacttttagcttaattccattgtagtcagaaaatattctctggatggatttcagtttttttgaaatttgtggtgacttattttatgatctaatacatggtctatgttggtaaaatatcccatgtaatcctatgaagaatacatgttctgtagtttgggagtatcttatttttatatatcagaagtctagtttgttaattgtgttcatatttgtatacatttgttgatattttatgtgcttctgttagttactaagacattttgttttcatttattactgaaggggggcatctttttacatctttctgttttttttttttttttgagatggagtctcgctctgtcgcccaggctggagtgcagtggcgggatctcggctcactgcaagctccgccacccgggttcacgccattctcctgcctcagcctcccaagtagctgggactacaggcgcccgccactacgcccggctaatttttttgtatttttagtagagatggggtttcaccgttttagccaggatggtctcaatctcctgacctcgtgatccgcccgcctcagcctcccaaagtgctgggattacaggcgtgagccaccgcgcccggccctttttacgtttttctatgacatttttcttttataaattacatttgtatcatttacctgtttttctgttgagttgtttgcctctctctcagactctattggagctctttattatggatatgaaattttataagtatattaaattataaatacattatgttacaaatattttctttaaaaattctattgcccgaggcgggcggatcacgaggtcaggagatcgagaccatcctggctaacacggtgaaaccccgtctctactaaaaatacaaaaaattagccgggcgttgtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaatctattgcaaaaatacaaatactttaatattaagtaattttcatattattatgccaatctttgtctttatagctgctgggttttattatagaggttagttgtttcagattcttaactttctaattcctaatttttttatttttttattattattatttttgagacaggatcttactctgtcacctatgctggaatgcagtggcacaaatgtggctcactgaagccttaacctccaggctcaggcagtcctcctgcctcagactccagagtagctgaagactgtaggcatgtgccaccatgcccagctagtttttatttttttgtagaggtgagggtcttgccatgttgcccaggtttgtctcaaaatcctgggctcaagcaattcacacacatcagcctcccaaagtgctgcaattacaggcatgcaccaccatgcctggcccctaaattctcgtagtctgtttttatgtgtagatatttattccacacaaatttattatttttttctttttttgcagggtgtcaggtagggatgtaacctgaccatggaattaactaagttattttttaaaaattaaatcatttaaatatgcttgtctgaaaaacaattttatagcaccagtcatgagaataattgaggtgaaaataaaatatgtccctttctgaattcaattacaatgtattttgctttatgtttttcttttttaaattatttttattttaaaatgtttgatagaatttttttctaagacttttttgtacacaattttagagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaaggtaagggtgttatcaaactgaattaaatctttcagtgattctttttaccttatagacatgttacacattttttatgtcagctgattttaatcggttatctacagcattcatggagacagcattttttattatatctgtgactaccttttttttttttacaagcctgtactttttccagtatgttactaatatatcattcacctgattcatgagggagaaagatatcaaggaatgaagcaacatgaatgtgtccttaatataagatgacctaaattaccaggtgaaattagtttttagaagtattttgtttaaaatagataatttggtttattctttctggattctttaaaaattatatggctatttaaaaattcaagctttaaaaaacgtattgcaatttttaagaataatttcttcaaagctctatttttttatatatgtttgaaattgagttaaactcaaatttaagtgtgctttcttacaatgcctctgaaaccctagattaattatatccctggaattcagtcctaggcacctccatgttctctagctattcctccacattacctcccctatcctcatctcatcctttaaggtagaatggctttcttttctggctttcttaaaagaggtaactcagctggctttctgtcatggaaatcaagcttgatagtgcatttttgttgtttaaatgtgtcatcagaatccgtctggcagtgagcacactttaaatctaaaaatgatcacttaaaaaaaaaaagttaacataatgtcagtaactgctgtctctggccactcaggaatacatcatgtttgcatttatgctttttccattagaaaatatttagttcattttaaagtatatttaagtttagttttaaagaatatcttgactaaaattaagctccttgacccctgtttactctgtattagagtataataattaaaagtatgacctgaagctttatctttaattgtattttctggctttttcatacattttgcttgtctaatcgtatatgagctttttaatagaaaaggacagtgaaaatttttcttattccttacatccttcaattatattaaaattgaataatattcagttatagtccgtctcacaaaattgctatgaaagtatattttactcttgagtaaagcaaattgtacagaagttaattctgtaaaattacattttgaataaggagttgcatgagtaccacataagttctttgcagtgttttcccctcactacttttcactgcttctttgtaaataaccaaataattctatagacctacatatgttccagagtacatgttattgagctaagacactcaatattgagccactgagtagctgttcagcacttgaaatgtggctagtccaaattgagatgtgctgtgtgaagtacacattggatttttggattttgaagacttggcttgaaaaaagaatgtaaaatatctcatcttttattattgatttcatgttgaaatgattagttttttcagtagccgcattacaaaagtaaaaagaaacaggtaaaattaactttagaaatgtattttatttaatctactgtagccaaaaatttaagttctgtatgtggctcacattatatttctattggattacactgctgtgtacagtatgtttaaagagaatggtgacatgaattgtgttatgagtaatgagaaaaaatcattttaaactcaccattatctggccaggtaatactaactttttatttaaagaatttacagtgttgccattcattgaagatacaggttatatgatttttactatagattttatatatgttttggaggatctgtgaagtaattaacattttgattactgaagccagttatgtaggctttacaaaggtagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaatcatacctgtggtgtaatattttaggaatatttagaaacatttagaaaatcagaagctgccttttttggaaaagttttgcattccagtgtaagattcctgaatataatcaattcattgatacctataacttcaaacctggtcaaagcaaacctacttatgatagagaatatttaactgtaatttgtgacttgtgctgtttgacccatcaattcctacctgacccaaaggcaatctgaaatgagacagctgcatcactcatctgtaccatgttcaaaatttcctgtcaaattaatggaaaaacaggttataaatgcaactaatacataatatgtcctcagtatgtcttcactgtgtgaaagatttaaaatttagcaacagtaaaggaacttgaagtttacaactctcaggggtaagattttaaaaatacatgttaatgttatttactggcttaagatacttggaagatctattccaataagttgcatcaccatttttgttttcagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataatatgttttaatgtaaattctttctggtccacgtaaaggaaattatttattctgtagtattataactatgttagatgagggcaatctacaatacttagggatatgttaagtcagtaattcataaacttcttatacaattttgccccccaatgtctgacctttatctggatataaaaaacactctcagtagcttcataaattaaaatgcttctgaaatgaacttttttaaagccctgtgttatcagtgtagtagtgtgtcttagattaaaatccaaaatcctattttaatattttaagaatatttctgaagaaattcgaaataacccttgttagctgtattttgtgcttagtttagaaaaaccattgcccaaacttagtatttctgtttaataagtataaatgatacagaagcctttggccttaaattcataactgttgaacattcatggaaaaccctgcaattagaattgattgaagaagaattcctgagaaaatgttttcattcttgtgacagttatttttctattagttttatatttgttctttacaattaggcatttttctcaactagcatatcataagttagcatcatacttaattctgaacattttagactaatcctgagtctttaagaattacataaaatatttagttttaactatttgatctgaaaaaaatcaagtaaaaatcctgataacctgagtgcatctctgcttgcgcttaggtgatttctgtcaccatgaatgactctagcttgtccaatttcaccagctctaccaaacaccgacccagggatgttggccactgacagggctggatgacatctctcatttctttcactgtctgcagatgaccttgcttccgtttttactaataaaatcaaggatatcatcctaagtttgtaccttcacctcagcaattcctctatccttggacttacctccagtatgtgaggaggagagtttcctgaactccagggttagcccccgtcctctctcgttctcatgcacacagcttcgacacctgctttctgagaggctctccttctctgtaggatttcctgtgaataggtcctcctccatcctggaaaaaaattacttgaacctgcactttcttctctattaaattacttctttaccttcttcctttgtaacaacagttttgatctcctgagatctggttttgttttccatccttccattatattgcagtgttgcggttcactaaacttcttaccataggctcattttctatggccctgcaaccaaactgattacactttcaatgaacttttttcttcccttccatgacattagttgtcctgtaagctcctattatcccttttctttcctttgttaaccactctttcctcctcccacctggcagcaggcttagttttgaccatttgtggctctttctgtacatactgtctaagaagaagtgattcaatgccttacctctgattgacatttgtgaagcaattctttccctgagagagcagcatagcatagccaaactaaacacacagactctggagtcagactactaggtataaatcctggctttgccacaaataagatgtcattgagaaggtttcttactttctcttagcctaagat

SEQ ID NO: 17417 - DNA, 77772 bp, Human
  misc_feature (1)...(77772): n = A,T,C or G
cccagtcctacataaaaaattggattctaccaacgaactgaatgagcctgagaacagattccttcccagaacctccaaataagagcccagccggcaggctgtttgattttggcctcgtgagagagacccacagcggagaaaccagcagagccaatggggattcctaacctacagaactgagacaatcaattttttgtactgaccaatgaatttgcagtaatttgttacagtggcaatacgaaacacatgctgctgaataaagtttcaggtaagagtggctgaggctgaagtgtcaaggtcacgggcagtaaaaataaatgccagagatttaacgaacgctgaggactagtaggttcccatccatccagtctctatgctctttcacagttatttgtctcagcataaatagctctctttatgttggggaaaaggcttatggcatgcctgtataaactggccataaaaatatgagacaataagttgtggaaagccacaagaggcctctgaggaggaaagccttcttattgtcatgatgttcccatgctctgggcgagacctactgtcttacctataaacactgtgttcaaggagaaagacactcctttgaatcactacaatgtggtcagacatgcaggctcctagttaagcacgctcccactggttattctccgacaagttaaagataacgctgtttgagcacaaaggagattcatttaaaccgccactgctatagatgacatgtatgatgcactgtctccctttcaccctttcgccccgaacgtccgcttcttagatctaagtgattgtactcaatagtgtggagaccagagctcccaggctttggcagcctccattttgcaattggccccctggcccccaatctttatgcactcttaacctgtctcgtctcattccttcgtcgccaccggactttgagtaccctacgggtggtgttgaggctggtccccaacacttttacacctacagctttacctgctaaactcctaggtattacgcaatatccagctagtccttcactgtctctttgaagccttccagacaccaccccaatcaattatcccatcttctgtactaaggacacacatttctatgcgcccactcaaaaaactatgaaacacctaacaacctccctaggacatcgcagaggaactagtacccttaggactttttcattgacccgaggttctatgaatgcttttttatctaatcatatccgtccactatcaaaacactcttaccttgcacgactatttccctcctgggagttgtaagggggcaatgtgggctagttttcgggatgacggttctgagaaccacgtcgagctcacgctgcgcctctggctgcgatcccgccccggagctggtgaggaaggccagcaactccgaattgccacgggcgagactttgggagaaatcctcccaaagcgaatccagatctgcggcggggaagtcgccctcccttccttcagcatggccggggtgcccggagtccctcaggggcactgaggcggcttccctctgtgcctcctcttgctggcactggccctgggcctcctcaagttcgcaacatgccgtgccctgctcgggtcctgatagcgacctgggacccgggccccctccgggggaaccctggccgggtcccggaccccgctccttctgctccgagcctgcgctagtcccggggccgcgggcctccgcgcagggcagggcggcgctccagcgggcctccaggcgggcgccgcaaagccgtttgtttgccacctgcggcctctccagccacacttcgaccgcagcccagaagccctgtgggagaagcgcgcctgggtagctgatcccggtacggcccacctcagccatggcagccagcaggtgtacagccctggcagcggcgcgccgagatgacgcagcccggtggcgcggcgcgttgacgtcatggaggcggggtgctgggaccggaaatgagaatggcgccgctggagatcctttcctgcttttggtttccctggcaggggttgaactgtggagtgtgtgggtgaggaatttgacctgtgttttattcccttttgagagaattctgggcgtggtatagttacagaatcaaacatcagccagccagcgggtgtggaacgcattgtcctcagtactgattaccgataaaagtcagggagcctaagtttgtgaacgtaaaagatgagtcctcttatgaaagctaacttttctccacttgggttctggtttgcttttagtgctggcattacagccagtgccttcctaagtctgagtgcagccatggctgtttcataagaatgatgtaacgttgtcccatgagggatgaaagtcatctgtcacctactgtagcaggacaagccacagacaaaactcctcagacaccggattaaagaaggaagaggtttattcggccgggagcatcggcagacttgcgtcttaagagctgagctccccaaaaaagaaattcttggcctgtttaaaggcttacgactttaaggggtccacgtgaaagggtcgtgataaattgagcaagcatgggaaacgtgactgggggctacatgaatcagctaacagaacagaaagttttgcaatgcttttttcatacaatgtctggaatttacagataacacaagtagtttaggtcgggggttgatgttattattattattttttttaactcctagggccacgtggtggtgccaaggttgtctggctatttatctgacttttgtttctttctaactttttgctttctctcttttcctcctgtcttatgaactaggcaaggtggcagggaggagggcagcaggagtagtagtggtctccttatcccttcctttgagaattttcacaaattagtgggagttctcgcttttatttttactttgagtctctttgggagacagagtgatagtgttttatgtaatacacttgcagtgagggttttaaattctcttatagctggaaactatcttttaaataaagacctaggatcaaacctgtgttaaaccagtacaggcacatgtgccaactttgtcatgtcctaagcaggttagtttttttactgggtcttaaaagcttttttcctagcaagcaacacagtatttcttaataataggagtttttaagagccaaatgcttgaacttggcatctgcttggggaaagagttaaagtaatcttgaggcattaaatcttttgcttctcaaggccattggtctctcatgttagcctttttataaacataacatgaagaaacgtctaggctgctggcaatgttttcagccagctgagcaaataggttgtttgtttgttttgctaaaggaggaggctcttgtaacttctggtttatgtgtttaaagaatgacttaaagactcggaattgttgctgggctggacgggtctgggtttcctgactaagtagtatgtgtacaatggggacaccttatataggtgtttcttctagcatggttatggggggtaacaataacaaaacaatatacagcatatttgtatccagcaaggacaaaagaggtccttacctgggaaaaagattgaatacagtgacagaacaataggaaaacagtattacaggaaaactattagtcttaagatttttaactacgtttacttgcttgacaagtcctcaagcttcggccatgcgtagactattcagctgccagtgcgtgactagagccgggcttgttgtttcttcaagcttcagccgtgtgtagactggtcagcctccggagtgaccagagcagggctgtcgtcctcagcaacagcttggtctcgtctccgaatcagccgggtaggaagatctgtgtcctgctggctggtctacttgtcctgagctgccagtgttagctgactgtgatggatctaagacacaacacctgcaacttttaacagcagtgggagtggaaaagattacagtataaggcccatcctatatgggtcctagaaaaattagattttactttttaacttaaacagagtcactagatttaaaggggtgtcaggcttataggcatttttatgtatttaattataaacactttgtatggctatttctaaaatctgcatttgctttcttaaggttaattcctttagttcttggaggtcacctttaatttgacctgtgatttgggggtggccgaccgaacaaaatcttatagggtaaatacctagtttgtttggtgagggtgcagctgacttgaaggaggaccataggcaaaagcctgattttatcttaaatgaatttcctggcaatatttttttcagtagctgctcgagtgtccagttcatgcactccactttttcttgaactttgcagccaataggctgtgtgtaacttccattttatttttaacagtcttgttaaatcctgccctatttcagctacaaatgctggcctattgtctgactttaaagttagaggcagtctaaacctggggataatgtcttttaacaatactttagtcacttcttgtactttttctgtcctggtggggaaaactttaacttaccctggaaaggtgcaaacaagcactagcatgtaccgatagcctccagcatgaggcagttctgtaaagtctataagcaagttttcacaaggtatggctctttctcctgtttaagtttcttagaggaggggttctttttctttcccccctttgtaactctatctagtggcttagccatcagtgagaaattggaatccagatatggcagaatcctgctgcttttaacttctaatgtgacaatgggctcctgggagcctaataagaaggtgcctagtctgccctagtctttacattctttagctcctgccagcctgatcagatcagtatttggttcctccaaggtgcggcagcccttggccaatggcctctttgtcttgcagccttggccatttcttttattgccttctgaacattcacccttctagtgtcctttcttttttcatctcacacattaatgtctctctagccttggccggctctcgaatccttgcctaacttgacttcttccacgtctacatccgtgtccacgtcctctcgcattgctaatctctctttttataagagctgttgctaacagattggcctttttccttaagtctttgtttttctttttccttcctgagttctcctgcttctatggccacctggcggggccaggcagtggcacaggccctgcccccgcgcactgctgtctctcccattttcttctgattctcttttttacacttactgtgagtctttctttttgttttgctcttctcttggcaccggtctctagcctcctctttttttctagatagagctgagccggggagaggaatttaacccttggcgtgcctagctgccgcacttgttgcttttgctctttcctgttttgttccttggtcacagctaacatacgccttggtggccacttttatagactgggtgatattcatgcctgtagcttctgcttgatgttaccctgggcttgctttacaaacgaagtattcactatatatatatttatatatatatttacatatattttttttacatatatatgtaaatatatatatttacgtgtatatatttctatatatttacatatatttgtatatatatatttatatatattttttcgaatatatatatatgctgattttttttttttttttgagatggagtctcgctctgttgccaaggctggagtgcagtggtgtgatctcggctcactgcaaactccacctcccaggttcacacaattctcctgcctcagcctcccgagtagctgggactacagctacccgccaccacgcccagctaatttttttgtgtttttttttttttagtagagacagggtttcaccatgttagccaggatggtctcgatctcctgacctcttgatctgcccacctcggccttccaaagggctgggattataggcgtgagccaccagcctcagggttaaataggatgtaaagccagaatgctttacagagtctcttataaaactgacttaggctcttgtcagctccttgaagcacttctgaaatcttttttatattaattgctttttttctactacctcttagcctctgcagaagtgcctcttagtactgctgcaaatgctgaagctgagttgcattctctgggtcttttttcccctttttcctagatcttaacaggcccttttttaaatataattctccatgcagttggagggttaaacaggcatactgagagtcagtgtaaatgtttagtcttaccttcactgagttctaaggcctgaattaaagcaatgagctcagcttaacgacagtgtccagggttatcactgcatatcctgcacatctctctccttgtgggttgatgaagctgctcccgtccatgtatagctcccagtctactgatgcccaaggctggtctcggaggtcaggtctgctagagtaaacttgagtccaacacctctacacagttaatgctcgacagggctctagctgctgggaacaaggtggcgggttcagggtgtttccagtttagtagatcaatggttaaaaagggctgatagatgaaagtctgttgccccaccccctggatgtgggcttggtcattataatagacaggtcctcgtgtctccctgagaggcatttgcatagctccagcaagaccagatctgagagggcccacttgactatcttgacttccttccttggcctcttgaggctccgatcttccccttcaaggtgagacctggggcgtgttagctccttaatctcgtttctcagggggctgttggcctcggtaaaggggggtaggctgggccatatggagaaagaatttctgttatctctggcggctcctgcaaaactggcttctcttgctctttctgggactccccttttcaactctgtgtctgctggtgcagctgttcttactttcacttttggcttttttgcaataagctgttaaacagggctaaatttatgctggtttttgtctatattatatttaaccatgaatcaatataaaggaattgatctaggtccactggctgtcctccaacccctgtcaccaccttaaatacatggccaattgttccctgtctgtagttccttcggtgggccatccaacaccaaaagagggcaattcttttttttttttcttttttttgagacggagtctcgctctgttgcccaggctggagtgcagtggcacaatctccactcactgcaagctccgcctgccaggttcatgcaattctcctgcctcagcctcttgagtagctgggactacaggtgcccgccagcacgcctggctaattttttgtttttgtatttttagtagagatggggtttcaccatattagtcaggatggtctcaatctcctgacctcgtgatctgcccgcctcggcctcccaaagtgctgggattataggcgtgagccaccgcgcccagcaaaagagggcaattctaattcacatagagttcttaacctctgggggcttaacctctgtaatcccctgcaaaacctttcttaaggttctgtaacatgcattttaatagagtaagttttgatgattagatgactttccttttatttttcttcttgaaatttttttttaacacagtttctagcggagtgggcttactttgtgtttgacctatttttctcttgagacaaaacaacattcacactacaagaaggaaagggtaaaaggttactcactcgtctaattcacactaaaggaaaatcaaaactaaaaccaaagtgtcattaaaggcacacctgtttgtcaaggaatttaagccaagtcaaaatcagaaccaaagccaaagtgccaataaaggcacgcctgtttatcaagtaattcaagtcaagtcaaaaacaaaaaccaaagtatcaagcatttcaagtcaagtcaaaaacaaaaaccaaagtgccggtacaggcacgccatgggtgatcaggccacgcttccactcaaatggagtgtgcaagttccaaagaccagtcttaccaagtttcaaatgtccagacttaaagtgctagttccttcccagtgttcagccactgcgttgatcctccacgggggcttgccatgcaccgctctgacgaggcattccacgggggcaaatgcctacccgggagcactctcaggatctgcatcgcgcaagctggctggagccccccacagggatgctctacagggcaggcataagctgcctaaggggctggcttgaacgtcccttaatcacctcgcttctcagtcagggaaccaagaaatgtagcaggacgagctgcagacaaaactcctcagacaccggattaaagaagaaagaggtttattcggccggaagcactggcagacttgtggcttaagagcggagccccccgaaaaagaaattcttggcctgtttaaaggcttacaactttaaggggtccatgtgaaagggtcgtgataaatcgagcaagtgtgggaaacgtgactgggggctacatggatcagctaacagaacagaaagttttgcaatgctttttcatacaatgtctggaatttaaagataacacaagtagtttaggtcaggggttgatgttattattattattattattattttaactcctagggccacgtggtggtgccaaggttgtctggctatttatcttacttttgtttctttctaactttttgctttctctctttcctcctgtcttatgaactaggcaagtttgggggtaggagggcagcagtagtagtggtctccttccttactacatgtccccaggaggaacagagaaggttggatactgccaatttagcccaacattatcagcagctggtctgcagaatctctagtaaaatccaaaaacctccaatattcttaattacttttgtacattaatccctccattgggattttgccattccctaaaggatctctgtcggagtaagaaaagtgaaaactaactcaaatcatgtgatttattagagataaaagcacagaccaaatgttggtagaattaagtaaaaggcaaatgagacgtatcctcccagacacactggctcaccctagcccattcagtgtttgatcacatacagtaattgatttttatgctatcttagttttccagggcttccataacaaattaccgtaagtttggtggcttaaaacaacacgcatttattctctcatagttctaaaggctctgagaatccattcatctctcctagtttgtagtggttgccagcaatcattggcattccttgacctgtgcctccagcacttcaatctctgcctccgtggttacgtggtgttcttgtttctccagatctcttttcttcttctaataagggcaacattcatattggattagggccaaccctaatccagtataatctcatagtgaataactgctgaatgaaacagtcactgagattagggagcgtgtcaggagaatggtgcagatggcagaactatctcagactgtttccctttggggaagcaggccccagccagaggctgctgggtccagggagcagggagaaagctggagatatccaggcttaggtcaaggatctgacccactgcctggggctggaaatagtgtctacatagcactgtcctgtaggactttctgtgataatggcaatgttctatgtctgcactgtccaataccgtagttacttttggctactgacccacacttgagtgcagctagtgcaactagggaactgatttaaattagatttatgggaaattgaatgtatttaactgctgcacatttaagtagccacatgaggctaggggctactgttgaacaatgcagcactagagacactcacctgggacccttaaagcccctccattctgagttgtcagcgtctaagtgctggaagctgggtggaactcgagaagcagcagtggaggctccaaccggaagtccctggctgctctgagcgccctgagtggcagccctgttgtgctgatcagaatgatggctccagccacttcacagcagcccccattaccttccagggcctcagccagaaactcatctgatgccaagaccttaacagcatagaaacccgttaaattcaatatgttgggtttataattaaaaaaaaaaatcaggccgggcgcggtggctcacgcctgtaatcccagcacattgggaggccgaggtgggtggatcacaaggtcaggagatcgagactatcctggctaacacagtgaaaacctgtctctactaaaaatacaaaaaattagccgggcgtggtggtgggcgcctgtagtcccagctactcgggaggctaaggcaggagaatggcttgaacccgggaggcagagcttgcagtgagccgagatggcaccactgcactccagtctgggcaacagagcgagactccatctcgaaaaaaaaaattcattggctcaagccagtaacatttgccatagggacagccatttgtttgtgcatcttgtacaaaaccacatttatgttccacaactctttcccaacaccgttttcagctgcctaccacttaatgtgatgtgactaggggaagtgaggtggctgctgggtggtggtgacgactgtggctgagctgtgatggatcattcttggtgccgaatcatcagaacccattcccttcccaaggacctggtgacttcttccagccactcttctgggaatgcagaaccagccaaggaggtggtggtgggaaagacagaagggataaatggagacaaatgaccggagggtgggaggcaactttagctttaacaatgtgtgcacataacaacaatggccaatgacagtcaatagcaccaaggtctaaaactgagcagggaatcggtgtgccgaagggagcagaagtgggacagaagtcaagataaacaagagagggggtgggtgaggccctatggcagtgctcccgtgggtcattgtccactgagttactgatgacactcaccccacccctactgttcacactaggggtccacgtgcagctcctggtggtttcacccagaaatagctaacaaacatgtataaagccaaattcccttatttttttccccaaatttgctcccttggtgtcagtcccagtggcatctccatccacccaggtcccaaatacaacagagtgtagcacgaccccttcctctcttcctacctccccaccaccctgactcacagagaggcccgtgttccctgtcagatgcaggtcagcagtgtcctcaggcccaggaggggagcacggtggatggagagtgctacagcgtgagcaggcaaatgccagaaggtggccccgaggtgaagccacggtcaaagctgagaactacagtctgacctgcagatgccaatctgggaaactaaatggagagagtgaagtcagggggccaaaacttgctacaggccagccctgacaagccagagggtagaggaagacaagtgtgaaaagaggagggtgaaaagggacaggcagagaagggaggggagcctgaggacctggccaaggctggaaacctgtgctttgttttctccatgtcattttgtgatgatgccctaacttaaatagaaccaacaataaaaagccactcagctccctctccaccctccagctccaccaagatggccttatctcaggcccttgtcttttacctgtactggccaccagatgccctgagctcttcccctttagcctgccttccaatgtctacctagaaatggcttccctctccctctcactcctgcaatggacccaaatcatttcccagtgggaagatatttttatttttattttttgagatggagtttcactcttgtcacccaggctggagtgcaatggtgctaccttggctcactgcaacctctacctcctgcgttcaggcgattctcttgcctcagcctcccaagtagctgggattacaggcgcccgccaccatgcccagctaatttttgtatttttagtagagatggggtttcaccatgttggccaggctggtctcaaactcctgacctcaagtgatctgcccacctcgacctcccaaagtgctaagattataggtgtgagccaccacacccagccgaaagatgtttttctaatgtcagtaacacatgtgaacccaattgattagtagttgtaattttggcagaaattgtgacctaaaggaggtgtgagttctgcaataaatggttattttattactctcaacagtatctccaaacatttgaaaaacagtggtgtgtattttttattagaccatgattgctttgtcttcaggcaatccttgttgctcctggggattcagggacctttgcaaaaacacaatagacccctggctgggaaggctagtctagactaaggatcacttccgactgcttagcagggtacctgccaggcccgaaatgatctttcagtcccttccttctgcttttgcaatcggacgctcccactgatacccataattatatgtctgtttaaataacagtaataactgtgaagaaaaatgttgccatggaatcaaggagaaggtatttcagagtagaacagaagtagacagaatttccaaacatgacctgagtatccccacccagatgtcctaccaacatcttaaacttgatacacatttaaaattgtacttctctttctcctccccataactgagctgcactgcccatcttttagttccctataaatgcaaacctttggatttagttttccttgtgcttttttcacttttttttttttaatgcagagtctcactatgttgcccaggctagactcaaactcctgggctcaagtgattctcccgcctcagcctcacgagtagttgggactgcagatgagagaaccatggcgcacaacgcctggctcttccttgttctttacatggcaaattgctaagtctagttgattctgttgtaatgcccaaccttgtttttactaaccctgtttttagactctcccttttcctttaatcacctagccttgtttccacctgaattaactctcccttcgctaagagagccagacagactccatcttcgctctttcactggcagccccttcctcaaggacttaacttgtgcaagctgactcccagcacatccaagaatacaattaactgataagatactgtggcgagcaatatccgcaattcccaggaattcgtctgattgataacgcccaaagccccgcgtctatcaccttgtaatagtcttaaagcccctgcacctggaactgtttactttcctgtaaccatttatccttttaacttttttgcctactttatttctgtaaaattgttttaactagactcccctcccctttctaaaccaaagtataaaagaaaatctagtcccttcttcggggccgagagaactttaagcgttagctgtctcttggccgctggctaaataaatgcactcttaattcgtctcaaagagtggcgttttctctaactcgctcaggtacaacactgtctctgtaaatttcataagaagtgtgtgtgtcttagtttggatctccccaaacagaccttgagacgaggctttgggtgcaggtaattgaaaatggagctgatctcggagtgcacgagtgaggaagtggaaagtgtgagacaaagaaaaacaagtaaagggtgggtgattgagctggttgctgctctggtcaatgagggcccacttccactaggggctctctgagaaactctgcagaaccacggttctcaaacttcagcaagctcttgggcatgccgggtcttactatgttgcccaggctggtctcaaactcctggcctcaagcgatcctcctgcctcggcctccgaaagcgctgggattacaggcatgagccaccacctagagcctgctgattaatttgaaaatgcccggccccagactgggggtcctgatccagtagccttggagtgggccccaagaagggccgcggtgtgaactgcatctcagaactacggcgctccgagagggcagcgactcgccagagtcggtcagccaggccttgcctaaaagcagagaaggcaagagtgcccgggagcgcctggcgaagcttcgtggcttccagcccgcccgggtggcagcggcgtccgcgtttccagggcaacgagggtggcgcggttcgatgacgtcagggcgcccgcggctccgccccgcccatgggacggacggaggccgagaggcgtggcgggggagcagtggggccaggccagagacagctgcgctgtgcgggcagctagtcccagtactccgagtcggtcgcgggccgacaggcatcccctgagcgcctgctgggtgagttggacggtgcagagcagcgaggaccggggagcccgaaggtggaggctgcgttagcgccaggggcgcggacgcgacggggcgggagcgggggcactgaaagtgccaggcccgggggtgtgggggctgtgcggattcgcgggcgggggggccagggttacccagagcaggggccaggagggccggtggcccacgtgctgggcattcggaggactttacacattgaactaggcagctgttcacgaaagggaagtgatccacatcgcagagaagactggaggcagctgttgccagaatagtgatcttgaagccccacttccttgccagaaactgctccaagcgtctcatgtgaatgacagaagcctagacggtagaccctgggcactaggcaggcgtcactgtatttggatgacagtagcctcagacagtagaccctgggcactaggcagacatcaccatatttggaatgcagcagcctagacagtagaccctgggcactagccaggtgtcgccgtatttggaatgcagcagcccagacagtagaccttgtctagacactgggccctagcaaggcattgttactggccggtctttgctcccagggtggtggcaggccggtcccaatggcagcaaggctcttgctctctgacctggggttcttggcctcatggattccaaggaatggaaccttgggccatgcggtgagtgttatagctctattagaagctgtgggtcacggaagagaactgtggaacccagcgactagtgttcacctcaattaggatgaacccaggcacttagctgtgcaggaacaatggcgagtctctagcccgggagcagcaaccggtgcctcgctggatcagaagcgcagtggacaccctgctggatctggaggggggtggaagtcagcggggcgtctgcgacagcagccatcagcagtggtggatggcaagcaaaagctcagctcaaaccggaacaaacatggaccagaaaagtgtgcagttgcaagatttaatatcgtgaaaacagagctcccatgcaacgggaggggacccaaagagggttgcccgattcggcttgaatgcctgggtttatatcctgatcattgtccctccccctgtgctctcaggcgacagatgatctgattatttctttaccacctgtttttagcctcattggtattttagtgagctctctttactacctgattggtctggtgtgagctgagttacaagccccatgtttaaaggtgggtgtggtcaccttccccagctaggcttaggaattcttagtcggcctaggaagtccagctagtcctgtctcttagtaccccctctcaacaggaaaacccaagtgctgttggggaggttggccgatgaccgctgtaactgcttcctgctgaattggggcgtagtagaggtcatgcagttgagatttcctcgggagtggtgccttcgatgtcatcaacattggagcatgggctagcaggccagtccaggggtccacggtagatcttagtcatggactgcatctggggctccatttgaagaacatttgtagtttcacagctttgattctggaagagacaaacttaacaaggaggttaaagatacagggattgaaatgtgtggcccgaagtgcaggggcatatgggtgtggatggtgaaagtggggtttcctttagaaaaactcctatacaatggggcatcaatatttctgggaagccgcattctccatagaagctcttggtaaggggagctactggtagtatagcggcatggagggggtgaggtgatagtgaaaggggggtaagacaacagtaaagagaaaaatatgacggggggggccatggagctctacgattccagttactttcctcgcagttgtcgcttgaagagcaggtgcagatcctctagaggttcacaggaatagctagcgttgtctcctgaatttttgggttcctttggcggtatccagggtttgatgtgtctaagactccactccagacactttaactgcactcagggtagataaaatgactgggtagggtccttcccagtatgtatctaggggtggggacttagagggaagggacttgactaataccatgttaccagggtggaattcctttccctcctctcgggtacaggttccctgtaatgttttaagaacttgttgatatttggctaaggaggtgatgtctgcaactaaattggccgtctctcggtcaagcacaaggtcattggttaggaagggctgtccatacagcatttcgtatgggctaagtcctgctttttggggggagttttgtattcttaataaggctatgggcaacagagcaggccatgcgaggtgggtttcctgagttagcttttttagatgttgtttgagtgtttcgttcattttctcgaccttccctgaggattgtggcctccaggcgcagtgtaagtgatattgtatgcctaagtaacgtctgcgatactcgctgggttactgcagccttgaaagcggggccattgtcactctgtaagtctcagggaagtccgaatctgggaattatttcatgaattagtgcctttattacgtcttcggccttttctgtcctacaaggaaaggcctcctcccaaccagtgaaagtatctatccagactagtagatactgaaatccctgagatttgggcatgtgggtaaaatctagttgccagtcttctcctgggtaatggcctgttctttgttctcctgaaggagcttggcgataaggcaggggattatttctttgccacacttcataggccctgactatctgcttgatagttttgaaaagtcctgatccagttaataatgatttggccgtctgataggtgctatcaatgcctaagtgaaaggtctgatgaagggttttaagtaatttcaattggttagctgcaggcaaaagtatttttccttcttcggtggctagccatcctgaggggaagaaactatgtcctcgtgaggttccccatcctatttcttttgagtactggggcttggtttcctacaggggattaccccatactaggggtccttctataagcatttctaatggagggtcccaccttgcggctcttttggcttcagtatctgcttcgcggttcccttctatttccctttcctttcctttctgatcaccccggcagtgtaagactgccacctctttaggtttctgtacagccaattgtaatctcctaatggcttcctgagatttgataggtgttccctcggaagttaggaattccctttctctccatattgctgcatgggcatggaggactaggtaagcattcttagagtctgtgtatatatttaccctttttccttctcctaattttagtgcctgagtgagggctattagttctgccagctgagcgctagttcctggagtgaggggattactttcaagtattccattatcactgaccactgcataccctgcttttcgaagtcgtttttctacaaaggaacttccgtcagtatacaagttgaggtcgggatcagtcaaggaaacctctagaaggtcccctcgagcggcgtaggtttgagcaatcacctgttgacagttatgttttatcttttcttcattgtctggaagaaatgtggctggattaagagttgcacgagtgcgcagtcgcagcactggcccttcaagtaatagagcctgatatttaagcaaacggttgtctgacagccgtaagtctcctttagcagtgagtatgccgtccacatcatgagacatccacacagtaagatctcttccctgtatcattttaactgcttcagatactaagactgctactgctgccattacccataaacaatgaggccaaccctttgccactacatcagtttccttactcaggtatgccatgggttgcaacctggtccctcggacctgtgtaaggaatcctagagctattcctgttttttctgtgacacataaagaaaagtcttgcccctttggcaagcttaacactagggcttggattagggccttctttagggcctggaaagccacttctgcttcaggtgtccttcttactaaatgggtattcactttctgagtttccttaattagtgtgtataatggcctggctatttcactgtacctgggaatccatattcggcagaagcctgttatgccaaggaaccctcttaattgctttatggttttgggataaggataagccagtataggctggatgcattcctcactgagggccctggtgtgtctggataattttagccctaagtatttaacctgctgtgagcagagctgagcctttggtctggaaaccttgtagccacaggtggccatgaagtttaagagcacttgggtggcttgatggcacaaggtttctgaatgggtggctaaaagtaaatcatccgcataccgaaggacaagagtgcccaagtatgagaactggctcaagtctcgggctaatgcctggccaaatagatgggggctgtccatgaacccttggggtaaaacagtccaggtgtgttgagacattagattcaaaggatcttcaaaggcaagcaagaattgagagtcaggatgtacagggatgcagtaaaaggcatccttaaggtccaggactgtaaaccactctgcttcctctggtatttgggaaagcagagtgagtataagattaggtacagctgggtatagaggaacaacagcctcattgataatcctgagatcttgcactaacctccactgtccattgggtttctgtactcctaaaattggagtattgcaggggctattgcatggttttactaggccttgggcttttaggtccttaacaatcttttggagtccttgttgggcctcgggtctaagagggtactgcctttggtggggaaaggaggcggaatcctttagtttaacttgaacgggacgggcattcttccctcatccatattgtccttctgttgcccagacttcaggattaattccttcctcaagtaggggacagcaaacggtgttccttctcccatgttcaggtgtataatggcccctgcttttgctagaatgtatctccctaacaagggtgtgggggtttcaggcataattagaaaggcaagtgaaaagaatgaagttccccagtcacaacttagtggctgggagaagtatctagtgactgcctatcctaggacccctcgggtagtgacagatctggaggacggttgtccaggaccagagactaagactgagaaggccatgccagtgttcaggagacagttaaccttctggcccccaatggtcaagcatacctggggcatgggctggcgcttgccccgggcaccctcagtcctgctgctggcttatctggttagtggcttctgactgaaaggaccttcatcccctggggcagtgggccttccagtgattcccttgacatgaggggcatggatgaggggcagcttatttctattcagacaatcttttttaaagtgtccttgtagaccacactggaagcaagccctatcaggcatttgatttgcccagcgtttcccttttccagagcctccaaagtaagatgctctcctcccccaatttctacccagcttacctcccctgctgcgatacaatctccaagccttggctccttggccagggccttagaactgatgacccagtactttaacaactggagctatgcctacaacaacacaatagatcaggatgaaagcgaattgagtaaattaaagggaggtgcatattcctatagtggcaaatgggggcaagaagtgaacttctgcttgcctgagggcccgtttgtcctgttctgcctgctcctcctgatctctattgtgaaaaaaaccgaggttgccaagttcattagagtttctatgttttgctctgggcctaaggtggacttttgaagtttttttcctaatgtttgcattacactgtttaactgacaacaaagtggtattggagtgttatagggtcatagagaagatcttcaattatcaattataggttttaaatttaccctggcttttaaaggaatagggtacactgtttttttcttaactacttatatatctctctctttctttctctctttgactgtctctctctttctctttgactttctgcctttcttcccccctctctctttctttctctctcttctctctctctttcctttctctctctgtttctctttccctctcattctctctcttgatagatggattttgggaacacagcggaagaatgttcgctcgttgcccccatttgcctctataggaatatgcgcctccctttaatttactcaattcgctttcttcctgatctattctgttgtcgtagacacagttccagttgttaaagtactgggtcatcaattctaaggccctggccaaggagtctaggcttagagattgtattgcagtgggggaggtaagctgggtagaaattgggggaggagagcatcttacacaatgggagagcaatcctcctagccatttacaaacttggggccctggcaagggtggtaggtcccacataacttcccatgtcgagagctgtatatctaaattgggagggacaccagggacaagactccctgggttcataccctaggtgcttaaggacacagcgtagagcttccttagatccctttggagatacaacttgctctaatacttgggagaggaagtgagtctgaagcattagtacctaggaggcagggatcagaggaagtagattcagaggtaaggagaattttggggctacactttcaagaaagtcatggttaggacccaggaggtatgggccagaaggagagataggggtgcacgcatgggcaactgttgagtagagacttctggctgcgccataatcttgaccggccaatgccgggaatttgggacgacagctttctgcctctagtcagccctcagcttccccaagaaaactgtaaaagtggaagctggttccaggcagaccaatgctcccaacccaaaagggttggggattgttagaaagccttttcccagaaagcctcacacctgagtcttaagtccggtggccacattaatcatttttaaccagccaacaggtgcccagtattttcctccaattctaaggaagggtaggacagaatagcaagtgaaagtggttcaatattactcaccgctttggagaatccccatacgagcccagcaaatgttaccgatgagtgtttgctcccagagctcccaagatggtggtgggccgcttccaaaatggcagcaaacctcttgctctctgacctggggttcttggcctcacggattccaaggaatggaaccttgggccatgcggtgagtgttatagctctattagaagccgtgggtcatggaagagaactgtggaacccagggactagtgttcagctcaattaggacgaacccaggcacttagccatgcaggaacaatggtgagcctctagcccgattgggagcagcaatgggtgcctcactggatcagaagctcagtggacaccctgctggatccggaggggtggaagtcagtggtgggtctgcgatggcgatgatcagcagtggtggacagcaagtgatagctcagctcgagctggaacaaacatggaccagaagagtgtgcagttgcaagatttaatagagtgaaaacagagctcccattcaacgggggggtacccaaagggcgttgcctgatctggctcgaatgcctgggtttatatcctgatcattgtgcctccccctgtgctctcaggggataggtgatttaattatttctttacctcctgtttttagcctaattggtattttagtgagctctctttactacctgattggtctggtgtgagctgagttacaagccccatgtttaaaggtgggtgtggtcaccttccccagctaggcttaggaattcttagtcagccttggaaatccagctagtcctgtctctcagcatcactgtattatcacccccaaggtgcacagatcttaggaaggtcacccagctagaaagctgtaacattgagatttgaacccagacagtctggcttcacaatccttatctctaacagttgtaccataatgcagtaaggttggtgacttcaagtggcatgggcccataggtacttgttaggatctggggatttggagccagctgtgcttgataatagttgtatgaccatggtcaatgtctctaagaagctccagtttcctcacctggaaaaggagactactgatagtacttgggcttggtgggcacagttgaggtctatgtagctgcttaacacagtcacctgcacacagcaccagctcagtaactggaggttgttatgagggttttatcaggctggagagaaatgagaagattccgtaaggtgttagagatgcactgtggacttggtaatgtactgaggttatggcgcatggagaggggaattccaacatgacactggggtttgtaattccagtaatccttgggtgactggcagtgtggaactggggtgcaggaggcgaagctgggtcagggctgagaggctgaattcagtgttgaacactcagtatgggcatctccagaacatgagaggtggggaattgccgttgactgccaaatgagctcacgagtctggaggtgtgaatcggggagccttgcacacattgaggacgtgatgttttcggttctcttgcgtacatacctcagagtggaattgctgagtcatgtggtcactccatgtttaatcacttgtggaactgccacactgttctccagaatggctgggtcactttacattttcactggaagggcatgagagtctgatttctccacatcctctcaatacttgtgattatttttctgtttcttttttctttttttctttttttttttgagacagagtttcactctgtcacccaggctggagtgcagtggcgcaatctaggctactgcaatctctgcctcccgggtttaagtaattctctgcctcagcctcccaagtagctgggactataggcacctgccaccatgcccggctaatttttttgtatttttagtagagatgaggtttcaccatgttggccaggctggtcttgaattcctgacctcatgatccacctgtctgggcctcccaaagtgctgggattacaggcatgagccactgcgcctggcctatttatctggttctttaagagataaggtcttgctgtatcacccaggctggtctcaaactcctgggctcaagctgtcctcctgccttagcctccccagagtagctgggaccacaggcacgtgccactatagccggcatttagtatctttttgctcattgccatcctagtggatgtgaagtggtctctcattgggtttttggtttgcattttcctggtggctaatgatgttgaccatatttttctgtgtttttgttgttgttgttgtttgtttgttttgttttctttgagaccgagtttcattcttgttgcccaggctagagtgcaatggcacaatctcagctcactgcagcctctgcctcccggttcaaccgattctcctgcctcagcctcctgagcatctgggattacaggcatgcgccaccatgcccagctaatttttgtattttcagtagcgatggggtttcaccgtgttggccaggctggtctcaaactcctgacctcaggtgatccgcccgtctcggcctcccaaagggattacaggtgtgagcgtgcctggcctttcctgtattttttggccatttgtctgtctttggagaaatgtctatttgaaccctttgcccattttttaattggttttttgtcattttattattgagtcttaagaatttttttttttttttttttttgagatggagtctcgctctgtcacccaggctggaatgcagtggtgcaatcttggttcactgcaacttctgtctcccaggttcaagcgattctcctgcctcagcctcctgagtagctgggattacagccatgtgccaccatgcctggcacatataatcttttttatatgttgctggattcagtttataaaatttcattcaggatttttgcatctgtattacaagagatgtttatttctagttctcttgtgatgtctttgtctggttttggtgtcaaagtaatactggcctcatagaatgagttgggaagtattatcttctcttctgtttttgggaagagcttgaataattgatcttctttaaatgtttggcagaattcacaatggaacccctggtttttcttcgtggacagtttattgattgctaattcaatctcttcagtcattatagatctgttcagattttcagtttttcataaggcagttttgttagctgtgtcttcccaggaatatgaccacttcatatcatttgttggcataccatggttcacaatattcccttataatcctttttatttctttagggtcagtggtgatgtcccgtctttgattcctgatgaggaatttgtgttttctcctttttatttggccagtctagctgaaagtttgccaattgtgtcagtctttgcaaggaaccaacttgatcgtttattgatttttctctatttttctgttctctgtttcattcacagttgctctatcttttattattttcttccttctgctttaagaaggaaggaaataatttaagtttactttgtgtttcttttccagtgtcttaaggtggtacttgaaaggcatgactctgaggttagacattgctgggcttggagcccttctccccacttctcagcggagggggtttgggaaacacagcctctctgagcttccgtttctccatctttcatggggggcagtagtacttggctcacagctgttggagggtgaaataagataagactatagaaggcaggattcctgccgccgcccaccaacaggtgctcagacctgcggctcccacctccctgcacagaggggagtcagcatcctgagcggccagactcaggctccagcaccgcaggctgtttcagctcaaaggactcaaaagttcctctttcctctaggccttaaacagtgaaggtgggcggcccacgcccaggactcagacagacttgggttcaccagccattcccttcaatgccttcatcagccaagccacttggaaaaggacccagtctatccagaaaattccagaatggttatttggtcaagagagctgagttttgggaggcctgctgtgttagcgggaagccaggtgtctatatgtcgaggagaagccagtgcagaagcctgtgatcagaggttctgtgctggaggccctgtgtccaggtggaccggcggtgggtggagacgtgaggtaccattgtgtgtggccagagtggaccagctggcactggctggattccagagggaatgcttcctgaccctgggtttagtgagccttggggatgagtctggatgtccggggtgctcccaagagggcagggtactctcaggcaaggctgtgtgacagaaaacaagactctgacaaaccctctgccctgtgtgcctggtgacccccaggctgtgcctggctctcttctgtgtccttggcatctgtgttcaggagtggacgagggaattcttctcgccttttcttctgggaaaatgatgctagccattcacagagtgattctcttttgccatccttttggatttcaagtttacttttctctgatttgtaaggtgttgcgggctctcctgttggtgggggtagtttgaacccatagatgggagagcatggattcaggttgcatgttttgtgcaggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaaggtgaggcgtgcggttgtgcgcagcttgtcttttttcccagtggggtcttagttcgttagcagaatgggatttctggctctcacagctcctcctctgccgggcgaggctcatcccaggcagcgcggcctctctcctctctgcaccccaggacaggcctcagggaattgatgaggagtctggaaatgaacacggattgttgatgtttcttaagcctccagtcctctagtccattgggaatgatagtcatatctctgtctgggtgtctccgggtcagactgtgtcccatgaagcctgtggcctggaggtcaactatataagggcacatggagagtccatcttttactccaaataagccttacccatctcctgcatttccagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtgagcatgcggcctaggggagagggaaacggctttcatgctgcgctgagccttgagggatgcctgtcccagggccaaccaagaggcagagaaacaccagtttgtccagctatatttgcaaattttaaaaattatcttttttttaatgtttttaaaaaaatttcagtcccccttttcatttttttattttcaagcccatccaccatcatgtatttgtaaatttgcacccataagtccttgaataaaatacaatgtggtgaagcttcaagtcccatcagaagaggagctgttgggactttttttttttttacctcatacaaaaaaagagacaaatgattaaaaaaaaaataaaaaaattaaaaaagtaggccaaagggagaaacctgtgtttttccttcctttgtaacataccagcagagctgagcttgggcaaaatggctttgcccttagccttgcctgcattgtttgatgggctggtgggctctgctctccttacagctctccctgctgtcctcagacccccaggactccttgcaggcatcttaattcccaggtgatttctgtgtgccttatacaaggtgctcggcacagagatgtaggtcttaccactcacatgaactcagggacccggggcagctgtgtgtcaggagaccctggccttgggcatccaggctgctggctaacctctcagcacttgttctccaccttggggaaagtgcagtgtggcagggaaccagcgtgggcatggtgttgagtgccgttgtctgttgtgatgttccggaagagcagtactcttcttacctgccccctgttgataggacgatgttatactttcaggtttttggatcagcagtttacagttctggttctgaaagacatctcacatatattcaaaagatcttcaggatggaggtaagttctggttcatggtaaattgtgagcctggttctcttgcttgatctctgtagagatttgtgaaaagagaagattgtagaagggggtgcccagggggcttatgctcttcttgtttcctagtgttctcaggcttctcaccaaatagctagcactgttctttagcaaacacaggcacattgacttcctagcaccaggtgaattgtcactgaggccttccactgtcttttcctgatgagcagttcctgccaccttgctgacgtggagcagctgcggtcagcttggtttaggctgctgtggttgccagctgagtgtggcagcatgactcagtcaagtcactagttgggtagatggaaatttggggctttgatatgtggtttcatctttaaaggaaagatggcagtgaggtccttctgggaatgtgcacaaagaacttttcttgctttccatcattttgtgctttgacatttagatttttggatgttttgctctgaccgaattaagccacggcagtaataccaaggccattcgcacaactgcccactacgatcctgccactgaggtaggtattaccttcccccgggtccctgagtttggagcatatgagacgtcatgagtgcaaatgccgttgcccagaataagaaaaaaaaaacattaaagcaagaggcctgtccacatacacttgtgtagaaatacccactgagattcatcacactgaaaagtggggcccaggagatcaggcattggaggacaaagcctgtgcccaccatgaactttatggggaattgatcgtggtttggatttgtgtgtaatttgagtgcagtgaagaagccctcattctgtaaaatttattgccttgtttacctggctgcctatgcgtagtggattcataaaccgttctcatggcccgtggtttctacggtgggccccatggagacaacatgctccctgccctctgccctttgtggctgtccctctgcgaagagcctgccttgtccatttccgccaccgcagtctgactcctcgggtccttgccatcctcttgacctctctggtacctgcattgtggctgctgcctgggagttctggtgtggtgcagtgagacgggccacagatggatgccctggggctgtcagtgctgtggaggggcacggggtgcagtgagacgggccacagatggatgccctggggctgtcagtgctgtggaggggtggaggggtggagggagatgggccacagatggatgccttggggctgtcagtgctgtggaggggcgcagaggtgcagtgagacgggacacggatgccctggggctgtcagtgcatggaggggtgcatggagggttgcggggtggagggagatgggccacagatggatgccctggggctgtcagtgctgtggaggggcgcaggggttcagtgagacgggccacagatggatgccctggggctgtcagtgctgtggaggggcacaggggtggagggagatgggccacagatggatgccctggggctgtcggtgctgtggaggggcgcaggggtgcagtgagacgggacacggatgccctggggctgtcagtgctgtggaggggtgcggggtggagggagatgggccacagatggatgccctggggctgtcagtactatggaggggtgcaggggtggagggagatgggccacagatggatgccgtggggctgtcagtgctgtggaggggcgcaggggtgcagtgagatgggccacagatggatgccctggggctgtcagtgctgaggaggggtgcggggtggagggagataggccacagatggatgccctggggctgtcagtgctgtggaggggtgcaggggtgcagtgagacaggccacagatggatgccctggggctgtcagtgctgtggaggggtgcgggttggagggagatgggccacagatggatgccctggggctctcagtgctgtggaggggcacaggggtggagggagatgggccacagatggatgccctagggctatcagtgctgtggaggggcgcagggcagcgagggaggatggggagggtcctcacccaccctgttctgttccctggccctgcctccctgccaccacatgactctccttggcctccgcttgtccctgaggcctaggtctccctgccagtctttcctcacccgccttccaccctcccccattggcagtggtcagggaggactgttgtgtggcaggaagtgaagctctgcacctgcggatgtgctcaaccagtcatccatccatcattctttcatccatccattcattcttccatctgtccattcattcttccatccatccattcatccttccatccatccattcattctctcatccatccattcattcttccatccatccattcattcttccatccatccattcattcttccatccatccattcattctttcatccatccattcattccacagcctgggctgtgtggactgtgcctggggtactgcatggaagagcccaggaatgaactcaagcggacccgtagcccagcagggataagaggtggtcctcgcacagggtgcccctgctgtggggccttgggagtggggccaaggctccttctcagagtggggctaggagaaagtagggcatgaggttcttttcagaattttcttttaagccataagatatctttatctgaacccaggtctttctggccccatggctgcttctcctcctgctgtcctctttgcctgtggcctgcagtgccaggaggtggggccctttctgacaggcagatggacaacagcacccaggtagccttggggtggggcatcagaggaccacttcccatttccacctccttctttttggcatttgatccctaagtggaggtcagagtgtggcatcagatccgtagagttggggtgcccaggatccaggctgggctgctggctgagcatttatttggacagcaggcattgctgggtacctgttgtgtgtgaggcacagctttccaagactgggctggaagtggcgagcacagcagacaggtctctgctgtcctgaagttgtgggctggggggagacacagacaccaacagaaagaagtgagatgtgctgggcaccatggaggccctccagagagcaaagctggtatgccggggcgcagggaggcagccagacagtcgagacagtgggaaagatctgtgtggagcagtgcaggccccgaggagccggcttgggccggtgttgcagtgcacacctgcactgcggagaatgagtgacaggtggaggtatcagaactgccgcgtgctgaagaatgaatggggagggcctggctgagactgggagccctccttaccctcgcaggcgaagagctggtggtcccctgagagaagagaacagaaggcatggctggcagccaccccacctcctacttctcctcagtgaaacttcaggatctataggatgattgttcactactctgtttacagaatcccactggttagacaggaggaagccctccccggcacgttattttgtagcctcccaccctgcaggggctggaaccagaaccaaaacttagccacgacagcccctagcagtgactggcaagctccgcgtggaggatcagtgtctcccgaggcggcccagggcagctctgtgggccacctgcgggctgtctgcctgaaggcgctcatctttgtccccttgcggatcccggccacattatgcagcactgctggtccgcatcctccctcccagccttactcgaagggctcccagcagacgcccctggggcaggcccagccccagcggcccagctcctgcctgttcccacgtgctcttcgcttctgacccatgcagcaccctcagtgttccttggggatctgtccacaccccttctagccaaacaccgaacgctgtgatgccacagcccatctgctagttcacgcatgcgttccttccttccttccttctgatgttctgagcggctgccttgtgctcggggcatttgggatataactgtcaatcacggagctgtggatgggagagacagcaagggggcagcagtgtgttgtgaattagaggtcctaaagaactgagtggactgcacggcattcccacagccctgcccacagggcacagacagccccgcccacagtgcacagacagctccgcccacagtgtatccacagtgtttctacctaaggggcgtggttagggactgaagactatatgataatgaaaactccctggaagcgtttgccagcctgcggagtattttgcatctgaaggttctttaagtcataaggcccaggaataggctgtgtttaaaaaataggcctgcctgtgccatacaagaactaaaatgtgcgattagtttcaactcttgcctcagagattttgaacgtagaaaatggaatctgtctaaaaggaaaacaccaattctgcatgtgctttagttgctaattataactaacctaaattttcccttgtgcaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcaggtaggacgctggggtggccctcagtgggggcagtgtttacccccaggaagcactggtaatgtctggagtcatttttgtcataacaagggtggggcatgcttctggcatctggtgagtggaccagggacactgcccaggaccccagtgcatcccatagccccgcccacagtgcaaacagccccgcccacagtgcattccacagccctgcccacaatgcagatagccccgtccacagtgcatcccacaaccctgcccacagtgcacagacagccgcgcccacagtgcacagacagctccgcccacagtgtattcctacagccccgcccacagtgtatcctacagccccaccagcagcgcacagacagctctgcccacagtgcagacagtcctgcccacagtgcacagacagctccacccacagtacagatagccctgcccacggtgcacagacaggcctgcccaaagtgtatcccacagccccgcccacggtgtatcctacagccctacccgcagcacacagacagctctgcccacagtgcagacagtcctgcccacagtgcacagacagccctgcccacagtgcacagacagccctgcccacagtgcacagacagccccacccacagtacagatagccctgcccacagtgcacagacaggcccgcccaaagtgtatcccacagccctccccacagtgtatcctacaggcccacccgcagtgcacagacagctccacccacagtgcagacagtcctgcccacagtgcagacagccccgcctatggtatatcccacagccccttccagggtgcataggcagccccacccacagtgtatcccgcagcccctcccacggtgcagacagccctgcccacagtgcacagacagccccacccttgccttagaaagaaacatccagcccaatgtcccccagtgacacagctgagagggcctggccaaggctcctggccacaggagctgcaggcctctgagaccatctggttgatttgatgcacaaagtttttcaatttcgatgaagtccagttttacgtttttttcttttgttgctcatgttcttatttttcagttgacctgacgtttgagctgttgcagaccagagagatttttttcattgtaaggttacaggacaaaaccaaagtgtttttcctactgtcatgcagccatcacaacgcttctgacattagatgtgtgtgggtttctccccaccagcaggcagctctgcagcagaaagcagctgggcgtcctctaatttaactccatactgatgctgttcacctggggtgagcctcagtaccgcccccaccccnnnnnnnnnnnnnnnnnnnncccccccagtgagggctcagtcccacaagaagctccccaaccctttggatgccaatggcaagtccaggttgtggcctgtgcctctgatcaatcccctaattgtaccttggtcttcatcctgaagctatttaggggtctgcaaccatctcatgagcacacaaaagactgtcaccactgcagagagtccagggttttaggagtcgtgtgctgggaagcagggacaaggccaaatatgtatttatcacagcatcatagttacctgaggccagtgtgccttgtttctgtgattatagatttctacctggagtggacttcttgcgggagttgcctggactagaattcagcagctttcggcgtgtctgattttggggacatagagccgcagtgttttagacttgtttatgttgtgctaaaaacactccgcaggattgtgtcgcccctctcgccactgcaccaagtgctcagggcacctgagtccacctcccagagccacggcctcctgcctgataaggagggatggaaacagtggtcttggggttatttggacaggattgtgatctgcgccccagacctgagctggtgggcggaggggcaggcatcttttgcaggtttctttctttttttctttttttttttttttgtgagacagtgtctgaatctttactgggccttgctgaaagattttagaaaaggagaggatgtttacatttgggttttagccctttttgagtgtttctttattttaaagttcagtgaagttagatggtgaattgacagacataaacagaagccagctagcaggtcatgcacatagctaaattccccgtagcaccacctccatgtgtctctaaagcagcttttccactttggcactgttgacagtttgggctgggtagtactcactggggcgccctgtatgcccagggctgggctgagcacttctggcgtctggccattctgtgccatagcttcctgcagttaacacaaccagaatctctccagacaccacccgtgtcccctggtggggaaggggaaggtggcacgtctcatggttgggaatccctgctgtaacagtgcccaaggatgaagctccacgtccttccgtcgagttcccacagtgcgcagccattagctggctggacctgtatcttggggagcggtgattgaccagaatattcatagccgtttctcccactacacctatttgcacagccattttgtcactttactaaaatctagcagggagtcctgtgtctaaaacgtgaatatgaaattcccgacgtcctcccggcagcaccggcccccgtgttagtctctcatggctgccacagcaaagcaccacaaagcagggcgctcgaaacagcataacgtattctcccaactctggaggccggggtctgaaattgaggaatctttagggcggcattccctttaaaggctctaggggaggatccttcctatctctttcagctcctggtggccccaggcctgtggccccatgtgggcggcaagccacccaggtgccgaggcaagagactgaggacacgagctgttccagtgtaataaaatataaaataagaataccagatatagatcttagatatgattatatatgaatatcaataatcattagtttgtagcaattactctttatcccaatattataataatcctcgctctataatcataacctaggaaaaaccaggccatacagagataggagctgaggggacatagtgaggagtgaccagaagacaagagtacgagccttctgttatgcccagacagggccaccagagggctccttggtctagcagtgatgccagcatctgggaagacgcccgttgccaagcagaccgtggtctagcggtagcataagtgtcaaggaaaaacacctgctacttagcagactgggaaagggagtctccctttccctgggggagtttagagaagactctactcctccacctcttgtagagggcctgacatttgtcaggcttgcccgcagttatccggaggactaaccgtctccctgtgatgccgtgcttcagtggtcacgctcctagtccaccttcatgttccatcctgtacacctggctctgccttctagatagcagtagcaaattagtgaaagtactaaaagtctctaataagcagaaataatggcgtaagctgtctttctctctgtctcctctctctctctctgcctcagctgccaggcagggaagggccccctgtccagtggacatgtgacccatgtggtcttacctatcattggagatggctcactctccttatcctgcctttgtcttgtatccaataagtatcagtgcagcctggccttcggggccactaccggtctccgtgtcttggtggtagtggtcccccggacccagccgtcttttcttttatctctttgtcttgtgtctttatctctatgctctcttgtctccacacacggggagaaacccactgaccctgtggggctgatccctacagccccagcgctgtactctgtgcctccgtctccacatggccccctcttccccacacccactcctcttctgattctcataggacacttgccgtgggatttagggcccacctgggtgatttgggatgaccttatcttgatgctcttaaattcattatatctgcaggaccctatttccaaataagcttccattcccaggtcctggggttaggacttggatgtatcatttctggaggatggtttaacccacagccgcccagcgttgagcccatggcccaccctgtgggtttctgaacacatttgttttgatttttgtgtgattgtaacagttgctgtttgctgctttctgtggctttgtatagatccgggacccgaagacccttcttcccatgcctggagtgatggttggcgacataggaaaaaaactcgggcagaacggtctggataatgggtgagtgacagaggctgctgagccctgagcttcctgccaaggcccaggctgcgttgtcgctcatgtctgagatctcactggccccatggatgccatgccctgccctcttagactcaaatgcggtggggacctacgcctagcccccgtgcatgcactggccacgtcctgcttgaactccactttgggaggccaacttgatcagagacctcagcaaaccagcttcaccttggcaggcggctccacactctcagatcagacccagacctctgtgtacagctggtggggcccctgcctggggggctgcctcctctgtgtgaggtcctcctcagcatcctgagcctcccccggctcggcctctgcacacatccatgctgatctcgagggacccatatctgcagtttctgcctccagagtaggcttgctcctttccgggtaatcccagtgtcacagcacttagaaagagaattccgctggcttatttgtttaatcagcccacatatatctatttagcagcacacatgtgacaccgggttggtgtggccaaggcctggctgaagggttggatggggcgtgcagaggggaggggcctagaaagactaatgaatgcttgatggccacatggaggcctgggtggccggggagaagtggccagtgattttggaatgtgcagcgtttcaggtggaggaagcagtgggaagtgtcaggcccaggcctgtgctgggatgcaggcggggtagggaggccaggccgcaagggccttgagggtctttgagggattggattttggagctccaggtcattagcagcatgacttttggaatgagacagatgtgcagccggccctttgtgtcaccttgaccagctttcttggcatttcctcatctgtaaagtaggtgacaagagaggtccctgtgccagggccctgccaggccctgcctgagcaggccgggcttgaacttcctggccactggcccatttggtgcctccctcactgcgaatgctggactccacacgctgtctcccccgagagcctgatccagcagggtgtagacccctctgtgcccacgagatgatttataacttgggggtagtgggacaaggtatgaccatgcctgagcctgatagcctgaaagatgtctcaggagtgtttctagatatgcgtgtttcatatagtgtttcatagcgaggctggtggagaggagaggagcctgccttacaggagttggaaataactggttatcatgaccaggttgtctccagagggagaagatgggccagtgggcatctgagcgctcagcgatggagaaacctccttctgcctgtctcttctgagaagtcagggtgatgggcagggagtgtcttaaatctctgcttggccctttaaaacaggcagggccccagactgtactaaagaggaaaatcttgattgatttttatacagtgtcaacttgagaagaaagtaaaaggacattgttaaaaagcaaattcttgtgatttcaggcaaaaaaaaaaaaaaaaagcaaaacaagacacatatgcacagccctcctaactccacctgtcctgcagagttctgggttctcactggcttatactaaaataatacaaggaacctgctagttaatgttggagctggcagggaggagagcgccaccccgacctgcggctgtcagttctcttgaatgactactttcgcagggtgcctgggaggcgcttggcatggacggtgcccgtgtagcaggtatggagggtcgctgttcaggcccttcgccctcagggcagcgggaagccccagccatctggaggatgtaatgcggcttggtctgtttgagaaggatggctctggcctcagggtgagaagctctgaagcgctgtgcaggaaatggggtgtaggaagcactgtgttgttctggagaatctgcatccttttattagacccggctgatccctttcagggctctgcagccacaggcactgttacccatctactgaagtgtcctatgtgtgcacgtaaggcccgacaggcatctccacccgggcatatggcggtggtgaattgtcacatccagtgggtggcctcgggtgtgagcaaggctcttcttcactgctcattcagtttcatgaatgagaggctttgacattattttgggacattgcagagaaaccctgcacttggttcccccctaataaacgtatttctagagattgaatccacacctcttactgggataatattcaaaggagcattagatcaaaccattaatgattaatacatcacactgatatggtaaagcctcttgtaagactcagaaatacggtctcctataggatcgccactaacacaataacgaccgccctttgacgctggttcagagctgctccaccaagccaggtcactgagcccccagagcctttccaccgtgtctctctgcagggtgacagggatgcagtgggattcgtccatctttgatccctgagcctttgaaggcctaggttgggctgggatgggagccagccggggtgatgcaggcggcctgctctccgcccctttccagaaatgcacatttcccatccagggctggagggtctgggcagggcacccagcagggggcgcagtgataccagtgttccctccgggtttcccagccagtttctgcctggatgtctgtcttttccaagatcagcattataatttagtgatttttgttaccaatgttgaaatcatttatcttgaaaaaagtggttacaatttgtaggttagattttgtcactttacaagaactcctgagtatgtgggatgactgcctacaaatccaaggtaaacgtaaattgtgtggattaattttagccaaatagctctaaaagcaaaatcataaagatcttctcaagtgatagtttcagccagactcttaaggtgggctgcaccttaagggtctttcttcgtgcgtttgccctgagctgaggcggtggctgggaggatgcctgccgaactcaacggcctgctctggcggcttggctgggctgggcttggggggcccttccaggccccaaaggaggaaggaagctgctgcaataagaagcaggatgtccagggcgcggggtgtgtgctgaggtctgggcgcttctgggattggagtgagggtttctgtgccacactcaggcctcccgtgccacgtgcatgtccagtgacacacacacacaactcctgtgctgtgcacacacacacctgtgacacacgcacacgtctcccgctggagacactggatctggcttgtatttgagttggccacatgtgaccaccactgtaatagcttttgtggaacagaagggatcccctgagaattcgtggaagtttgctttcctttgaaactcacgggaatgtttttgcaagtataaatatattctgtgtggtgagaatgggggaataatttccactccttaaaaagggcgctgactgtgaccggatcatactggaaaaggcattccttggctttcaagtaacaggctggagcacgctggggccattggcaccgaggcaaggtttttctcacgaggtggggtgttctgagtgtgcggctgtggcatgggggaagctgctaccaaactgggcagctgggcctagggctttggaggagctggcccccccgctgcccttcacttcctgcaggtgggcaggggcctggcaaagcagccgagagctcttccctcaccaggtcacccaggtttccctaaggagctccagccccgtccccacccggccccagggccttgctcctcctggtagtgtggaaactgtcgctgtgtctttccctcaggctgtcctgggagtcaggatcatggcctggcccttgtgcctcagaggatgtcgtctgccccacctgacttgttcataccatgccacttacgtgcccgtcccttaagtctggcaggccccatgcacggtggccccctcatggaggggggtgagccccgggagactgctgagaggcagctagctcacccaggaaccaggaacgttgatggttgagggatcccaccctggggtccgcctcatacccttcccagggtggggcatagaattcccaggtgggccgagggctgcctggtgtcaacagtgactgcatggagggcatgaggccaggagagaacctggtggacggggcaccacaggcaggcaggaccacctcatggcaaggcggtgatgctgttagaggggcagatggggcaccacaggcaggtgggaccacctcatggcaaggtggcgatgcaattagaggggcagatggaggtcagcttggggggatcctccacattggcctccgccattccgaaggcctttgggaaacggcccagctcccacagggaggatgggctgaagaggcagagttaggaaagagccaatatggttgctgcaggaaatcagcccaggagagctgagtagggatggaggtgctgggtcctaggtggggatggaggggagaaagtgaatcgggccagcacagcagagctggcagcccaggaccgggtgacaatgggggtgtgggggcatcctgagcaggactcaaggaagagcccacgcaggaaacgggtgcctctggttcccttccagcatgtgagattattctttatagatgagtcttctgtggtttagtaaaagactattctgtaggcaggggtccccaaccccgtggtactagtctgtggcctgttaggaactaggccacccagcaggaggtgagcatcgggtgagccagcaaagcttcctctgtgtttatagccactccccattgctcacatgactgcctgagctccgcctcctgtcagatcggtggcggcattagattcttataggagcgtgaatcctactgtgaactgcgcatgtgagggatctaaggcgagcgctccttatgagaatctaatacctgatgatctgtcactgcctcccatcacccccagatgggaccatctagttgcaggaaaacaagctcaggctcccactgattttgcaattttgcattatggctaattgtataatcatttcattatgtgttaccatgtaataataatagaaataaagtgcacaataaatataatgtgcttgaatcatcccgaaaccactcccacctccccctcattcgtggaaaaattgtcttccataaaaccggtccctggtgccaaaaaggttgcggactgctgccctaaggcattgcaagtgatcttaggaatcagacaagttgctataggaactattgatattttgaagtttgttttggggggtttttgcacagtttatgtaatattcttaacctagcatagccttattccctagactgttgtgtaataggttttcctgaccagacaaccataacaggtatctttggttattaatacatcatgatccataacaatgtgtgtgtaatcctatgctcagctgttcaaaagaagtgaatttccttgccgagggagcaccaatgccatcacaccagttattttgtttgactgaagagttttaaacctcattttgccaatattattacactgtgggttctggtttaagattgaaatatgagaatcagagattccaatctttggaaacacagttcccgtcttttctgttgaatatctggagttctgtacttggagtacaacttaccatatacacaatgcttttattattattattattattattattattattgaggtggagtcttgctctgtcaccaaggctggagtgcagtggcgtgatcttggctcactgcaacttccgccgcccgggttcaaacaattctcctgtctcagcctcctgagtagctgggactacaggcacatgccaccactcctggctaatttttttttgtatttttagtagagacggggtttcaccatattggtcaggctggtttcgaactcctgacctgaggtgatccacccacctcggcctcccaaagtgctgggattacaggcgtaagccaccacacccagcctattttttaacctacatttttttcttttttagaaacagggtctcactgtgttgcccaggctggtctcaaactcctgggctcaagcaatcctcctgcctcagtcttccaaagagttgggattctgggcgtgagccactgttcctgactagactacttttttgaatagaaagttggttgaatgttcctgtctacttgccctctgccattttctttgtcctcggggattgcatcagcttttaggctgcccttggagaagagaagagcctcagggcaggacccctgtttaacagaagccctgctgcttccccacagtttcgccatgttccacaaggtcagagttcctcgccagagccttctgaaccggatgggagacgtcacccccgagggcacctatgtcagcccctttaaggtacaggcatggggggccgttcgtgtgccgtgcttcccaggtgccttcctctgcagggcctggctctgtgctcctccctgcacctggaaaggagacccctccacgtaggccaggtgtcgctggggcatacttctcctggctcgggttctggtgctcccactagaaggggactcttggggcagccacagcaccaggtgctggtgtccagggggtgagtccgggccttacaatgcccactccccatcgggggctgcgattagaggactgctcgcttccagtgatgcttccctgaggatttgaaggagacgggtctcctggcgaaccgtccacaaagggggacgacaaacagagttccccggtgtccagaactcacgcctggcttaagttcacggagagcagaagagagaccgtggtcctggggagcgatggcccaggtcatagctgatgaccctcaggaatcatgagctcacagcaggtgggccaccccgagcatgcacccttggaataacagtccccagcagcatgcagcatctgacatcaggaagcacggatggaaaaggagcatgatggggatgcccagagacacacagggtgcgcagagtgggaacagcaacacgagaccaggagctgctcacaaacagagatgttaatccaacatcaattaaaaataaatgattggaagaacaggcacagcatttgggataactatctcaggaggatgaattagggattggaagcttgtcctctagaaggcagaaggagaggattaaagaaaatgaaggctgggtgcagtggctcacgcccgtaaccctagcactgtgggaggccaaagtgggcagatcgcttgagcccaggagttccagaccagcctgggcaatatggcaaaaccccgtctctactaaaaatgcaaaaattagccgggcatggtagcgtgtgcctgtggtccgttacttggtgggaggtgggaggatcactagagcccaggaagtcaggctgcagtgagctatgattgcatcactgcactccagcgtgggcaacagagcgagaccctgtctcaaaagagaaagaaagaaagaaatgaagtttagagaaataaaggagagaaatgtctctaaatgagaggggaagaaggcttttggttgaagggactcttggaggaccaaagaggaaaagtaaggaagcacctatgcacgtacccagacacacggtagagaaattgaggaatttctaagagaaaattctagaatcttccagatctgactccagtggaataaaaaacacttgaacttcagatttctcaaacatgacagtgaatgcatgaagacagtggaatcatattttatacccttaaaggaaaatcactttaaatatatatttatatatattttttgaggtggagtgttgctctgtcacccaggctgcagtgcaacagcacgatctcagctcactgcaacctctcctctgcctcccgggttcaagtgattctcctgcatcagcctcctgagtagctgggactacaggcacccgccgccaggcctggctaatttgcgtacttttagtagagacggtgtttcaccatgttggccaggctggtcttgaactcctgacctcaggtgatctgcccacctcagcctcccaaagcattgggattacaggcgtgagccgccgcacccggcttaaatacatttttaaacacaacgagactgtgattcctatgtgagagtgtgattaatacgctcagacacacaattaccatgctgccttggaagaaggacctagatggtcagaggagtggcccgatggggcagcacggggcagggcaggaaggacggtcagatcacgtggcaagggctgtagattagatgtgcccaccgcagcctggacaggccttagcaacagcctctgctgacgccgctgatgcgtgcgaggagatagtggacggaagattccagctagacgcacgtaaaggaactgcctgttcacaggcacacaaggatcaagaggtgtccgtgaaaccccctggaatggctgcctgtaatggactccgcccctgccctctggcagtacaggccacatctgattcttgccaaggttaaaggtgggccttggaatctccaggcagatggtttgcaagtccccacagtgggagcaccctcacccagcgctgtcataccattccctctgctaggactgtaccttctccaggcagctgggtgtcccctccccggcacccccattccatccacggttcatcagtgacatctctacccgcctgccgcaccgtcctgtgtcttgggcgccctggggatggggcctgggcaggtgggcacaggtctactttggatgaacaaacgagggcaccttcgcctctgagccactctgcccaaggtggccgcgcagccgggcttgagcttatcatctgtgtccctcccgtaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcaggtatgaggttttcaagcatcctttcactgtctctctattttatatgcaaattcacttcttttacatagttgccgtttggttactgggagttgatcaaagctcttaaggcaattaacaggatgattagttagcgggagtgcggcatctcaggccgcaaggcttccagcaaatggtttttaatttaaaaagagtagatacgaagtagccaaaaaaggaagatggaaagaagcaagtcttttttttttttttttttttttcccagacggagccttgctctgtcaccaaggctggagtgcagtgggcatgatcttggctcactgcaacctccgcctcccaggttcaagtgattctcgtgtctcagcctcccgagtagctgggattatgggcatgcaccaccatgcccggctaatttttgtattgttagtagagacagggttctgctgttttggccaggccggtctcgaactcctgacctccagtgatccacctgcctcagcctcccaaagtgctgggattatgggcatgagtcactgtgcccggccagaaagaagcaaggatggggcggctctgggaggtgggtgtgtgcacggccgcacgttcaggtgaggccgccacagcttggcgggtagtggccttgcatgccctgtgcacactctttgacactttcatcccatccctaagaaatgattcctggcaggtgatctggaagaagcagcagctgagcgtgcagccctgttcactgtgatggcatttagaacagtggcgtgggcacagagcgttggccctacacgtccccagagatggggcagctgttgacatgcacagatgcagcccaggcagcagcgtggaaaagcacagacattgttacatggaagggggatgaactgtcacagcgaacgtgccctgtgctctgggtttggtcttcacagctaagagggttgggcttagtcccactttacaggtgagagaactgaggatcaaataagaaatccagttaaagtgcacaggctaactcaggcccaggtcccaggccaagctgtgcatgaataaaggtagatttgggtgaaacttccaggaaattgtaacagaattgcagttgtttctttccacatcctttgaccagggctatgagcctgtttagtaagtgttgccattcatgcctgtgtggcacccatcccctcccgtgtgtggtcacagcactctgggtgccaagggcagctcggcggtcaagagagcgcactggggccaccatgcctggccttaccaccaaggtccacccccagctggctgtgtgcccccaggcaaggtccttagcctttctgtgctcttgctttatcatttgtaagttagaactgatgataaaacttcttcctaggatcagtgtgaggattaacaaagttagggcatggaggcagctggcgccatgtctgctcagcactcttgacacgttagaccatggtggtgatggcggtttcctcaggatcctctcaggcttgtcctgccatgtacccagccacccacccacccatccatgcatccccccacctgtccacgcatccccccacctgtccacgcatccacccacccatccatctacccatctacggattcatccatccacccacccacacatccacctacccaccacccaccatccatgcatccatccacccacccacccacccccccatccaacaataggtggaccctatcctgtttcagacaaagtgaaaaagacatgcactcagcctttcgaggggctgccagctctgtgtgggcctcagctttcccatctgtcccagggtgacggcctcatcctcacaggctcatgctgtcagccagtcagtccgtgtgccggggagttggcccctagcagtgctgccttcttaattcacagatagactggcactttgttctgtagtgactttgatgggacagctgtgaatagcggccatttagcgaattgcgtttgagcttgtctgtcaagggctatgggtgaaagccgaactggctgagttgagagcgtgtcagggtgaaggctttctgatgtgccgggaagacatgtgaagaccttcagcgctagtgggtgtgtggccctgacggcctctccctgcactggctttcatggtccctgggatgggctgcccttcatgggaaccacgatgtgttcacgcaggtgtcttgtctgttctagcaatggcgcttgcttccatatctggcagctgtctacgccttagaccatttctccaagtcgctcttcctggacctggtggagctccagcgaggacttgcatcgggagaccgcagcgccagacaggtgaggtggtgtctgcttcctcagcagcatcgtttaaatctcacacggttggagcagcatagattcaaccttcatttcaaagcaaaatcagtcctttgatttgcgaggacagagcattcctccagttgttcccacccactcggagctcttggcctctgccgcgattgaacgggctgggcacgcgtccacacccctgcctctcaaggatgtgctgacacgactcccggttccagtctgtgagttcagctgttggtctccttttgagaacatgacggttttgcaaaatccacgttacccgcccctcagtggatttcatggttctgagccttttgtaaacagctgcacaaaggtctgaatcccactgactggatttgagttgacagtcagaggatttgtgccagaaacgagcgtgcaaatcccgagatcagcctcggcataaagagacatcgggaacggatttctttgtagatgattatgaactgattttccattgtccctcctgctgcctcctgagcaagagtgaaatgtgaatcaaaagaaataaccgtgtttgaaagcagaggagaaacgccacagattgctgttatgtacaacatcagaaaaagcctgtatctaattagcatatcttgaaatattatcggtgtccacattcacggcagatgatggcgaagggatgacctgcaggattgatggcagagcaaaccccaggcctggaggcctgaggagggagcgcttctgaccactaaaggggttaagcctgtgttttccctggagcgtgagtcagtggagcttttgccagctgacacttgcattgttctcctgtgaataatgttgtaaagggtgaccaggctgattctttctgaaactcagtggtttaacccaggcagaggagggcctcagctcagccccttatgtgaagttgaaaacactcataaaatgggtcactggacttagcatgcgtgtgtgtgtgtgtgtgtgtgtgcgtgtgtgtgtgtgtgtgtgtgcgtgtgtgtgtcttcctcttaattgtttttcctttttaattgtctttcttttttaaaattaaaaattcttcttttactctgaatcagtctcttaagtttttgtttgtttgtttgtttgtttgtttttgagacggagtctcgctctgttgcccaggctggagtgcagtggtgcgatcttggctcactgcaatttctgcctcctgggttcaagcaattctcttgcctcagcctcccagactagctgggactacaggtgcccgccaccacacctggctaattttttttatttttcagtagagacagggtgtcaccatgttgcccaggctgttctcagactcctgagctcaactgatctgcccgcctcggcctctcaaagtgctggcattataggcgtgagccactgtgcctggcccagcctcttaagttttcatcattagatatcaagcagaagcaaaggagtcttctttcttttttttttccccttaaaaaaaagcctgcagcacctgctattcccaggcggtctcccatccaaatactaaccacgcccgaccctgcttagcttcacgagatcaggctcattcagggtagtttggccatggacagcaaaggagtctcaataaaacatgttaggcctgagggaggcacggtgagcccccacacagagcagaccatcagttaccgaggcgcttgcagccttctgggaatggactggtcccggcccttccctgtcctgggagcgagcactgtctgcggtgctgagtctggttccctggcctttcttcatggtttccctgcaaacaattgcaaccttccatggtgtgtcattcactttgacgtttgtgaactttatataaagtgggccatgacgcacattcttctgcagtttgcttctgggacccgtgttagggccctgagagctatttgctgtgtagagctgtgttttcattgttgtgaaatggtatgagcataccacagtgtatccatacttggataaagacccttttttatttctaattacaattaggtttcctcttctgtcattttcgggatgtcttgtattagactagaggtgatatggtggtttgatgctattgctgacttatgactttttggtgtctaaagtctcttttcacctgttcttgttggattccctcacccaaaggcagagcttggacgtgagatccacgccctggcatcggccagcaagcccctggcctcgtggaccacccagcaaggaattcaggaatgccgggaggcgtgtggaggacacggctatctggccagtaggttttggagaagcgcatggtggtttcctgtccttagccctgctgtttgactctagaccaggggtcggcagactgcggcctgaggaccaaatccagcctgccacctgtttttgcaaataaagttttattggaacacagccagccacccccgttcatttgcacatttcctgcagctgttttcgcactgcaagggcagagatgagtaatcgcagctgtgacagagaccatgtggcttacagagctgaaaatatttactctctggtccattgcagaacaagtttgccaacccctgccctagatagatcccactgctttcagatgcctgatgcttcttggccaaaatataggcagagagcagctgatctgctcatttgaattttaactatttggttaacagcttggtagtaaactagcaccatgttttgtttgaatagaaaattcttacacttagataaagagttagttatatcggcattgatgatgactgaggcagctgttatatggttaagagcggaggccaccagcttgcctgggattgagtcctggctccatctaacagcctggtaactgtgggcaggttgcttaacctcactgtgctcagttttcttatttttaaagtgggggtgataatagtgtacccacaacataggttcttgccagaattaagtgaattaccacgtatgaagtgtaagcatggtatctggcatgtagtgcgtgcccaatgacttttttatttgctaatgctgttattattagaattatcatcagcattatttacagcttacctgcaaaacttcccgtgtgctaatcttaaataattaactggcaaaaactggttgctcaaagaaggccatgtacacactcaaaacagccacagcatcagcaaaactctcttgccctccaggagcacttggtccttgccaagtttgtgagagtttttgtgatgctctatctagaactacacacacactttcagcgatcatccgcccaccactgcagttctaactcgcacctgttccagcatgggctgttagcaacgtggcccctcactcccaccacaatctgtctttgtcacttactgacatgcgggtagccatggctgtacacaagttactcatttgcatgctttgtcctctgcgcaatgcccttagtagtttttgtctttgtaactcatcgggattctataaatagttgaataaggaaattgaatcttgcagtactgcagacaacaaagacgatggaatcaagattaatacatatacatatacatatacatatacatatacacatacatatacatatacacatacatatacatatgctgggattgagaccaatatgaccgaggctccatctaggtttagaaaatcaattgcaaatgtttctgctgaggcctctcccagctcttgttcagtggccaacctgttacgtggcaggaagctcgtggcatgatttgacagtaagtcaggagaaaatcaggtgttctaggtgatcacaaggctaatcacaagcgtgttggcagtatggctgcaataggactcctttcatgctctcaggatccatcagtcacagtacgtgagtgtgagaagtcagctccactcccttcctgctaggcccatcccagcctcacattcagagaacactttccatcacagtaggcaggctcaagtgtgtgagggtctggaaagcaagcctgacaacatatgtgaaggcatccagctaactgataggaaagacaaaaaacagttatcttgaaatttcctgtgttaaaagaagagttcattcagttatggacggaagaagggtagccctgggggcatcagctcgctgagatggctccctcctatcagcgaccccatgccagggggggctctgcagggcttgctgacagcagtgaggagctggaggtgggatatgaagcacaggtggcagttctttgtgtctggtcaagctgagttcagggcttttttttttttggtcagagtcttgccctgtcccggaggctggagtacagtggcatgaccatggcttacttttgcctcaaatgcctgggctcttaagcaatcctcccacctcagcctcctgggtagctgggactaaaggtgcgtgccactatgcccagctaattttttttttcattttttatagagatagggtctcactatgttgcccaggctggtctcaaactcatggctttttttttttttttttttttgttgagacagggtcttgctctgtcacccgggctggagtgcagttgcgcaatctcggctcactgcaacctccgcctcccaggctcaagcgattctcctgcctcagcctcccgagtagctgagattacaggcacacaccaccacacctggctatttttgtatttttagtagaggtgggtttcaccatgttggtcaggctggtcttgaacacctggcttcaagtgatccacccgcctcggccccccaaagtgctgccattacaggtgtgagccaccgcacccagcctcttaaggctttttaaattctcacatagtgacaggctgcttctcaaatatgcgtcttaaatgatggtactattgtggctttgttgcagtgaaccggttgggtgtccttagagatgacaacgatcccaactgcacatacgaaggtgacaacaacatcctgctgcagcagacaagcaactatttgctgggtctcctggcacaccaggtccacggtgaggctctgctgcacactggtgggggcgctggaacccaactggggcaggggtgggttctcctggcctcactgattcagctgttctgtgaatgcatcctaggtttgcagaaggaaagaaatgttattagatagtgccgaccaactccccaaggcatgggcaaaggctggggtggggagggtccttgagacccagaccctcgcctgtgggtctgtggccgtcgggtcctctggacactctctgtgctttggggtgcccccagcttggggttcccaatggtttgggttcccgtcttccaccaaagtcactggaatgtgtgtcctagatggagcttgcttccgcagtccgctgaagtcagtggactttctggacgcctatcccggcatccttgaccagaagtttgaggtctccagtgttgccgactgcttggactctgcaggtaaacacacaggtggagggctcccctggcctcctgattttctgtcattcccaccaggaaacgcaccgtgcctcggtgaggggacccttggcagttccagccggggcagcagtggtggtgggaggccccgcatgcagcttgtcctgggctggctcatggactatctctttgtgcctgacgccgagttaggcgctgactccacagatgaattgaaggatgcccacttgccaccttataccttgcctcttgccttcccctcccataggataaagggcgtgagaggccacctggcctggtctctgtccactaagcagcctctgccccctgccctggtgcctgggctgctgctgtccctgggccctcccagccacctcacctgtcagtcttccccactcccaggccctgctggctccccaaacagcagatgccccttcccgccctggcgcacctcccgcacctccttcactcggcccctgtggcacaggctcatctcctgtgggtgcggtggtcggggtggggcgtcctcccagggccccgcacagagctggccacggacagcctcctgcaggtgtgtcatgggagctgctgcaggctccgcctcacccacacggggtctgtggctcagagaggtgggagcgagagctgggaatgaggcgcctggccgtgctggcagcatcgaaagcaaagcagcttccctgtagactgcgctggatcctgacaggggatccctctccggagagcagctgctctcgcgttcctgggttaattctgcacgtgctcgttatgtgctcactctgcagttctggggctggcggccagcatgatggagaacctgtgcctgccctcatgggactttacagtctagaccagcagacacagaaacatcccaaggcctcagtcttagggcagcaggaattctgcaaagcagtgatcctggctggtgaggtggagcgtggctggtgaccaccttgcaggggccttggcctttgaattgaggtcagtgaaaggcgggggcagccatggggacccccgatggacgggtgtgtcaggaggcggaggcagcagggcccagcccatgccgagctcatctcgatgtgagcatgcatctcgttcccctgctgtgaatgacgggaggtgagcgcaagaggcctggtggaaaggggtgtgctgtttgttttgatgattcatatttttaaaaatgttcctcatgggaaaaggccactctggctgctctgtggaaatggaggtgagaggcggctgggacaggtgagggggtctgccctgcgcccccacacagaagcacccagccgagctctgcgtgtcctacagggcactcctgaaggctcccttggtgccagctgcctgagcgcagggaggggcggagcgaggattcaaacccaagcctgtgggaccgcaaagctcgggatctctcgttactgctcctggatgcttcttgcccagtggtctgggtgcgatttgacagaagagcagggctggagctgcccccacctccatgccacccgtgtccctgtcaaatgccttcctcccaccacagcccccgtctgtaaagccgcgtatcacagagaacagctcaaagccgcagcaacgcctccatctcgccatcgcctcactcagcagtatttagtgaatgtcttcactttgccaccaaagcacctatttgtgcagaagagaagggccgagaggggtcccgatgccctgtcccggcgggccaggtagaaactgactgctcccgtgacacccgagacgtggaagagtagcccaccttcctgagtgagagagacgtcagctcccgccaggctgccggggttgatcccggtccctcctcctgctggccgtggaacctacaccaagtccctcagccttcctgcctcggtttcctcatctgcagcacggggacggggatggtacccccttcataaggtgtttgtaccgtggactgagttcatgcacgtaaagcacttagtgcagcacttggcgccacatcagtgctcagctcagcagccacagagtttggacaggaaccgccctcgaggtgccacacgttcaactgggcagatagagcggggacttggagatggaggatgctcttggctttgcattcaggagaccagaatgtgaggcttccctggggttctgggaggcccctggatcctcgggaggagggagcactggcctccctcatgcaggggacaggcacacatggaggacgcgttccagccatcaggaccgacgccgtggatgtgatagcagcccccgagcgtgtgtccttgtccgtctccagccctacaggctacttccttgttcacacggcaaagaacaggacaacagccgtggccgaagccggtgtggagcctgggccggtccggcttcccggcgccttcccctgcccgcaccgtcagcatcgtcatcaggaagcgtctgcatcactgcttgctttctcgtggtcactgcgctgggttacagcttctgacggtaactaaccgtgcagatcttagcctgcctttttgggtgccagtgggaaacggggacacgtttgatgacctatttctgatgtttgcaagtcactttctttttttttttttttttgagacggagtctcgctctgtcgcccaggctggagtgcagtggtatgatctcggctcactgcaagctccacctcccaggttctcgccattctcctgcctcagcctccggagtagctgggactacaggagcccacaaccacacccggctaattttttgtatgtttagtagagacggagtttcaccgtgttaggcaggatggtctcgatatcctgacctcgtgatccgcccaccttggcctcccgaagtgctgggatcacaggcatgagccaccacgcccggccgcaagtcactttctaagcttcccaaatgttgccacagaaagaactagaaaatgacctaatcattgtggtaacttcaacccaaccaatacctttttcctaaaaccatcactccttatattaataaaatcaaaacataaatgggacagccagcttctccatgtgcccatcacgctctgctcttccctccccttcccctgagactgaaagcaaaagcaattttacagtctctccatcatcaggaaagacaccaaagtcatctgcttttctgcaactgctctaatatttacaagatgcaacaaagtgaaaacgttttccggagtaacaaaggcaaatggctttcacttgttcaaagtggtatgggagagagaccgccattatccctcacgccgcagggaagcttgtgggttctgccagccccatcgtctcaagggcatttggtcacagatcccaggtctcagggctgactgcagcctgcgtcatgtggatctttggtaaaagctgtttaagtgatgtggggccctcaggctctgcaggactggagagacacaggccccttccggggttgcgcttgcctgtgaggaagggtggaggatttgccaagccaatggcgggtccttcaggggttcgattctgacttgggtaggggaggctgggttttctgttgagttcctctgatttttgcacaggcatttttgcactgagctgagtgtcacagccctgtgccttgggggcctgtgctgttgcttcctgcagtgggccctgttgtttagctggctcgtatgcattcatagtaagcagttgcagtgttcactactcggacacgtgtgtatttgtggactgcaaggtcatgggatgtgggccagaggtgacatagggtcatgtgtgagcagtggggtcacatggggtgagtggtgaggtcacgtggagtgcacagtgaggtcatgtgaggtgagcagtgaggtcacaggtgagcggtggagtcacgtgggggagcggtgaggtcacgtggagtgcatggtgaggtcatgtgaggtgggcagtggggtcatatgaggtgagcagtggggttcgtggtgcagacagtgctcccagagggtgggagcacaggctattgggtcagcactgccccccgctgtgaccttgagctaggctttaatctctctgagcctgttttccttctgcgagacagtggggagggaatgcggtcaccccatgccacctggcaggggccaggccatggtgccctcggtggggggctgctgcgtgtggggggccacagtcctgaacacttccttggaaacaacagatgcaggtgaggtctgccttggtgggtcagggaatgtctcccacaaaactggcacctgagggtgtctcagagggtccgtgcgttgtgcttttggggagcaccggccattcaggagcaccagagcggcgggcatggtcagacccgggcctgtgatctggctgaggagttggggccgctgtccaggccttgctttccagggcttgcctgggtcagaatccgagttaggagtgctctgatgctgacgcagaggggactggacccagagacgggagaggaaaccgagacccgaaaggcaggcagtgcatgcgaagagctcaccatggggtcaaggacagagccccagctggggagggggcagatcgaggggcagtcattgggtgcacagggcggctgggggcaccttcgagagtccttctggtgtgaggcacatggaaaggccgtggtgacccaggattctgggagagtcttgaggacagaggttgttgacgctgggtgtgtcctcaggccgccagcagccgcattccgagcaagagaattcactgcccgtcagtgcccgttttcctgcctagtttgtttcagcgatactttttcacttccacattaactctgaaaatgacacacacaacacccacctttcattgtttgctttcatgtgctttttggggatcttctcccctgcacatgaacacatcagactgacatgatttattttttcacgaaaaaccaagaaccaaaagtagagtgtaaggaaaaaacacagtgcaaacataactcatttctcaagcgtccctctcacttgaagcccacagcacagtctaactggccatcgacgtgaagcctcatggattaattctggttgcagagacagattggaaaactcgggtaactgccgtgaagtgtccaccgcagagggacacctcctggggcagtgtttgggaatggccaggacaggctgggagggaagcccagccatggctgatgcgtggtgggacacgggggcctctggtgtggtcagaaggaatttgcacaagtggtttctggccggaccgtttccttggttttgttgctgtgtaaataagtcgtgggaagcacaactgtacggcgtctacctttccttgctgttcgtgaccatctgccctgctggggagagcttgggatgttgcagagcctttaggaacaggcggtggtcacaagggcctcccctcagcattggttgcaaaatggacctgagttttccagtaaagtcctgaagggtagcatgtgaggctcaaggatgacccctgggcagcctgccagcagcagagagccacggcctgggcactgaagacagcagacagtgactctcttggtgcagaggcagaaaccccaagtcaggatggggcagggctacccgcctccctctcgtggtgggggggcttttcccgcccaggctcctggcagctccaggagttcttggctgtgggtgcatcatgccagcctttgcctcctctgtgactttgctgtctctgcatcttgtaaggacacgtgtcattggatttagaatccatcctagtccaggagtccctgatgacctcacctgaatacctcaacttcatgacatcttcaaagaccctcttcccaacaaaggtcacattcacagctgtgggggtcagttggggccaccattcagcgccccatgcctggcaggacttggcgaggggagccttggctccctgaagatgcctgcatggaggaagcctccgcccaaccctgcctgtgccctgcctgcggggtcagcagcacccgtctttccatcccactccctctggggagctgagacctccggcaagccgcctgacgtgtgagcctgggaaacggcctgctctggtttgtgacgggcttctcagttatgccgtgagggtgaacagatgtaacagccgaaagcagtcgggtgtgctgtggcaggaactgcaacgttgggtattttctttttttttttttttttttttgagacggagtctcgctctgtcgcccaggctggagtgcagtggcgcgatctcggctcactgcaactccgcctcccgggttcacgccattctcctgcctcagcctcccgagtagctgggactacaggcgcctgccactgcgcccggctaattttttgtatttttagtagagacggggtttcaccgtgttagccaggatggtctcgatctcctgacctcgtgatccgcccgcctctgcctcccaaagtgctgggattacaggtgtgagccactgcgcccagcaacgttgggtattttcttcccagtgacctgggctgtgtgacatagaaggaaatcccaagccccactgagttcagcctttgggctcagactcagtgtggctgatccccattctcctgcctgggatctctgagcaagaccggctgccaggcagaaggcccctgcagcctggaggtgcctcgtgtctgggcgccaggccctctgtgcctgggcagggggtgggtgtgagcgtggcctccacatgtgggtggtctgcacccctccctcacatgctcgccatgtacctgggtccctgggcccgtgtcctcatcagtggggtagtagcagtacagcctggtggggtctcaggaccatgcctggtccatacggagtactgtgggaggccagctctggctgtgctgtggggggccccgcagatgtgggcaccactgccaggggaaggggaggacgaaggggggtctccagctgtcctgcctgacaccccaccccggggcctccctgtctgcaacatctgctccctcctgcccttttgagctttgtggaaggggccacgcagggggtgaggccttaggttcccccctcccccaccatgtcagtccccagttccacagctccagcatgcggtgaggtccaagggccaggcagggggaggcgaacggaagcaccccttcctctcgccactgggcgccaccgccggccagttgtcctgctgcccatgcagtcctggctgatgctgtggaggcagcaccacgcttcacacagaccgagcctggtgcgtgcgagaacgtgcagccgtcccactcgggggcccactctagcggcggcaccgtgttcctgtggcctccaggctgctggaacagtgtagaactcaggacagccctgggctgagccaggaagtgcctccagccaggggggccctgggcaggtgccctccctgtgcttcagtttccctacctataaaatcagacccaccccatacacttggttgtcaatgaagacaacctggtacctgcaggatgctggcagtgccttgtccctgggggtgagttgtgacaaatgctgtgttctctattgttactttttctccttctgtttgtcattccgaagtcgccctggcagcatacaagtggctggtttgctacctgctccgagagacttatcaaaaattaaaccaagagaaaagatcaggaagcagtgactttgaagcaaggaacaaatgccaggtaagtatttgttttcaaaattcccttttgtattatttgctcttaattccccggccgttgtgtccctgggagtttgaacatcctggcaattcaggccccagaccccgagctcccgtgaccttgggcagatgacttgatgactttgctgcttgctcagctcctctgtaacacagggatggcagcacctgtcttgctgggctggggaggtcatggatgttacatttaccgtgcctgacggttcccagcccgtaaaccagagcggtgaagctctgggttgtgagagccttggatgcacagagtggcggagacaccattgcgggcactcagagcactccctcctgactcgtgggagtgatgccagcgccctgcttggttttccacaagttgctctcgccttcccgaggggctggggtggcaatggtgagtgggtcatcgttggccttggaaagcgctttggttctcacacttggacagggctgtctctcatgttccaggaagccacagggaaaaaatagcctgttataaaacaccttgtcatgccaggaaccttccagccctgtcccagccatctgccctagagcagagcccagcccccaccctgtctagggggcagccggtgggggcagtagggctcccggatgtgtctgtgggtgccatgagcactcttggctggagtgcgccagccctaaccatagctgtggggagactcaggccatgagtgttgtgcagggaggccgtggatacggagagagctgctgtcaccccttctccctagcgtcggttcatgaggttatgggtcaccttcagtaatgaagctgctatggggacccaggtccacatctgcctgtctctgggaaggcccagcacctcacagcctgctgctggggggcagccccgcccctcaggccagctcctctaggaacctgctagacacacctgccctgggatgaggagagaaggcaggaaggatgggctcctgtcaagctcaaagaaacccagattgggccaggtgcagtggctcacacctgtaatcccagcactttgggaggctgagacgggtggattacaaggtcaggagatcaagaccatcctggctaatacagtgaaacctggtgtatcctaaaaatacaaaaaattggccaggcatggtgtcatgcgcctgtagtcccagctacttggcaggctgaggcaggagagtcgcttgaacctggaaggtggaggttgcagagagccgagatcgcaccactgcactccagcttgggtgacagagcaagactccatctcaaaaaaaaaaaaaaaaaaggaacccatattgaatttataactgaaaagaaatgaagtcagcaggtggccagggtctgtaaaacttgtagtttagggccatggtgaccaaagcgtgaagtgacccttccagaacaggccgccttgtttacccaccttgggtgatacacagcaggttgggtcattcagaaaccagtggatgcctgtcagcttccactgctccctcctctgcaggccacatccttgcgttaaggtggaataggctgctgcactggctcatgtctgtaatgccagcactttaggaggctgaggcaggaagatcgcttgagcccaggaggttgaggctgcagtaggccgtgatcacatcactgcactccagcacgggcaacagagcaagaccctgtctcagaaaagaaagaaaacatttttttaatggaatagagattctccaaagagttatgaaacaagaaccccagagatggggggcacaaaaggacccccttcctaacaacacctgtgtctcttagaactgcccggtaggtccttagcacccccttccagccccgatctatgctggggacctggcatgtgtgaccccacaacaccccgagtgtgtggctcagctgctgagaaacccctcctcacctgtagcttttccttcgagaacttggtagcagaatttcacggagggctgcggcagaggccaggaggggtcctgggttctgatccggctgagacggtgaccctgggctgagctgtggagctgacagacacccacagacaccagccccaaggccttggagggaaaacagttgccagggcagggcttcgtgttccagacctgccccgggtcgcggagcttttaagagcaggggacatttgtgatagctgagagcccttggggccctgggctgaatgctaagggggcccaggggagacgcagccccttcccctgcaatacggcataccaagaaagcctcagcctagaccagccttttcaggaagatgggaaccggaagctgttaaaaaaaccatcggatttggctgcataaaggttcagcatttctgcattgcaaaagacgctctaaacaaaatcggaagacacacagcagcctgtggaagcccacgtaacatgtcgccgacggagaacacccccaggaaggaaggaattccttcagatagatgccagcctggtcggaaaccagccccagcagccactgacctggagccagggccaggagctgcaggtcaaagccacacttccacaggcatcaggctgggcttgggcagcagcaccgttcatggagagggtgatggctgtgtcctttgggaaggttactgaccatttttgttaaaaatgtgcttactctttgacctggtggagaaaatctattaacttttaaacattttctggctcctgccagtaactgctatccaccatttacccactgtaagcctggcatgcacagaaaggtctttaaaaatgcatttctctcattttttggctgagtgacacctttacatgttcaacagccagtagatacaaaagatgggtggtggcgtccctcctccctacctctagcctgggagtaaaaagatgggcgatggcgtccccgcagcctgcctccagcctgggagtaaaaagatgggcggtggcgtccctgcagcctgcttccagcctgggagtaaaaagatgggtggtggcgtccccgcagcctgcctccagcctgggaccaacccctgccacaagggctcgaggtttccttcagggatttgcacatcagaaggcggacaaggacgaggacatttgttctccctgagccacacgctggattctgtacctgggtcatttcacgttgtctactttgggagtgaaggaagttgaggccaagagaaatgcccaaggtcccccagctcgcccgtgccggggccaggattgcacccgggccagctgtcacagagtccaaccctttccccaggctgcatggctgcagtctgaatttggacagtttggggtttgtttttttgcctgaagtatgcattgcctcttaaaatgtacttcaccaaccagagtgtaccagactgggaccctctcctctctcctgtgctgaaggtttacggacagctgaccttagctgcatcgagcctgagaagtgcctgtcacagtcctagctggggacagtttggcagctctggaggggcagctgaggtggtccagaagatccccctagagcagagcccagccccgccctgtctagggggcagctggtgggggcagtggggctcccggatgtgtctgggtgccgtgagcactctcggctggagtgcgccagccctaaccgtagctgtggggacactttgtccgtgggggagggactgcacctgaggcattactgtccccccgggtcgccagagtccataccgcatgggatgcttcctgggccccagcccaccttggttaatgctgtggtcagctctgctggttgccatggcagacactgtttagggagcccatccccagagcctgtgtcccccccggtgactgctggccttacgtggacctttcctggaagaacagcgcagtatcatgcaggcaaatcctggggactgagatgccgttgagtacagtagagctgccatcgcaggcgcttcctgtgagagagccgccctgaccccagcagcaccacgcaggagacaacgctgaggcttggagccatgacgccttttgctcacgcgcagagctgcagagccgagtgacgctgtgtttcaaaactcactggcactcgcgatgcattatttgacagcagcaaggttccaggaggggctgtctttctggcccccgcagcatgtctggcctgtgccatcgctgtatcaagctgtgtcactttcatggaaaaacactgaagcagtgccgctctaacacagcaactgtgcaggcgacggggagagtggtgcggggcacagggctcactcagattcggttcaaggacggcctctctgtgcctgggccctgctgggattggcctcatctctgggttcgcagaggacccatggcgagaggagaggccctcgtggtgtgggagcacgttttggggtgtgggcaggattcaatggaattatcgtgttctcgtggacacaggagcagcctacgggggtgcagatgccgtcacccgcttgtttcatggaaggtggaaggaggaagggctgaggcctggagctgcagcaccacacctggcagctcccccacaggcctgtattatcagcctcctgccagaggcctcaggtgggagcctgagggctgccccacctcactcggcagggctctgggaaatttgggtgctagtcctacctagctggggtctgtcaggcagtccctactgccccagagcaagtccagatcctgccaccagccctcactcaccaaaaccaaggcccagagctatagcgcatgtgagatcagaagagggcaggaagccccaaggccccatgctggcatgctccatgctcagacagcagggagcaggacgggccttcctggcaccgacaggacggcccacccaggagtgtgcggggcccagcgggggtcttgggacaggaccagtcagcctggcatgaagcacagcgggaaaggcgcttctcccggtttctgttttcccgaggctcctgatcccagcagggccctggaggacactggctttgtgactggagaccctgctgccgtgtgcttcaccctgctgtgttctgggaagatttggggcagcgtcatagcagcgtcataggccaggcatgcagccgggtcctcctgcagcagtcagtcccccatacaccatatttcatcacttggctggatttttttttttttaattttaaaagtagcacctgctcatcctaacaagtcaagcaatgcgtgtgttgttttcctaatttaaaaaatctggtaagatgataaatgggagacagggaaagaaaggctaataagtgaagttgatgattatcagcaaatgtttttgatattcattaaaaaagaaaaataacagatgctggcgaggctgtagagaaaagtgacacagatacacggttggtgggaacgcagattcgttcagccaccgtggagggcagcttggcaatttctcagagagctaagagttgcccttccccttgacccagtgatcccattactgggtatacaccccaaagaaaagcaatcatcctgccagccagatacatgtacctgtatgtccatcgcagcgctattcacaatagcaaaaatgtgaaatcaacgcaggtgcccatcagcggtggactggataaagaaaatggggtacatagacaccatgggataccgtgcagccatcactacgaacagtcatgtcttttgcagcaacatggatgcagctgcacgccattatcctcagcagactaatgcagcaacagaaaatcaaatgctgcatgttcacatgtacaagtgggagctaaacatggggcactcatggacataaagatgggagcggcagagcctgcgggggccttacggcagggggagagggagagaagcctgctttggaggctttggaggacggggtggcagatctttggagaagtgaagtcaattctgagctcagggaggagcctgacaagccccttctccagctcctctgtgtcttcccgtgtggaagaagccaggtcctgggcccttgggggcctcctggtgggcgcccactctgtagccgcagagcatcccgaggccggctccaggctccgtatgcagtgctggtgccaaccccagtcccagacgggagctgagctgagactgaggccttggagggcgtcggtggagccagagcagtcccagctccatcttcataggcctcttccattgtgttctggaaacatgtctcgtgctgcgccgcatctgtgctctgcctcaccttatgttactgtcctaggacatgcacgggaacgcagacccgcgttcgtgtttcctgagaacttcctcccccgggaatctgggcggggctgggaccctcacggtcctcacggtgccgtcctgtgttccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggtgaggcttctgactgcgggcttgctgtcctccccagagtcagggcccccgtgttgtatctaggaagctgcttcctgcaccatcgtcctccttccacgggactcactgagcacggcggatggcgctgtggacagatgagaagcccagttccataatgagaagcatatggggcagagcagcgtcagggtggtgccgagaaacccaatttttctttcacttggggttcggttcagagaacacttccagaaggccccctcatgccaggcagcctgccgggctctgcagagagcagaagcccacccactaggtcccataaggcacagacagacacgagccaggagtgcctagacttgggaatactggaaggcttcctggaggagggggtgctggggctgattcctggaggattggtgggaataggctaaaccaaagtttgtcaactttttgttcgtctttgccccccaggaagctttttaggtggtttttcccaatggctggcacccatgcatctttggtactaggatacactgcatatccattcatgtcctgtgtctctgggcttgtgaagaataagatcctccccaccccaagagccagcgtttaccccctggagggtggtgctgaccccgtggaggccttgacagtgctcaggtgcaccaaggaagggacacaagtgtctgccagagagggcgggcacagggcaggagccccactgctgcctgagaaaaaccctaagtgatgagacacagttctctccagcggaaatcacagcaaacgcagatcccaccacagatgtgctcccgaacgcacaaggccacagccttggacctcttagggccctgccagaaaccacagcggctggaggtgacaccaaggaccaagtccccctgcggcctctgagtccctgcaggtgcccaccgcccccaactcccctgggtggtcccaggcaccccctcgcccctgcgccccctgccatgcacccctgcttcactctgcccaggagccccttcctcactttctcccgaggaaggaacccgcccagcctccctgaaccccagcaggtatgagcccagcggccacctgtcacctctgagcctgggaccttgcctccctcgctgccgcgggccagagaccatcaatgcctgagtgggaaaagggtctcagaactcggcccctgagcagcacattccttgggtcacatctgggctggggacagcaatgacactgatgtgttcacccaaaacaggcctcctatatggccgatttggaaagtgcactcagggcatgttggtattgggggtggttttggactggacccagcccccatgtgaccgaggctgtgcttgcaggaggatacttctctggtgagcaggcgggagaagtgttggagagcgccgtcctggctttgtgttcccaggtgagccgtgggtgctgtcgcgttctctacatccatgttacacaaccgcccagagcgacacgcatccccttagcatcacccagaccgacacgcaccgccttagtatcacccagactgacacgcacccccttagcgtcacccagagcctacacgcacccccttacccagaccgacacgcacccccttagcatcacccagagctgacacacaccgccttagcgtcacccatgagccgacacacaccgcctttgcaacccaaacattcacgtgtgttcggtgtttagtaaaaactgtaggattacaagaaaatatggctacatcagaaatttttgcaaaagaaacctgtcggggcgtctccagatctgcacacacccaggccctctcacacaccttttgcagctactttgagaattctctgagcattcgggggactcagcctccaatttaaatttgtttcctggcagtttccttgtttattatattcttttacctatgtcacccaggaaatcagagggccccaaccccacattctgatccggcatctctcttccatccggggacagaagctgcagtgctgtgctgtttagcacggcagccgctgggttgggggaaggcggctgtgtgagtgagggtctccgatttcctttcattgcactgattttgaggagccacttgtgctggtgctggtgctgctgcggtgggcagggccactgtgtccgtggagacgtcattccacttttgctgctaggaactggactgagtgctgctgcattttagcacaatgtctcaggtgactgcagacgtggcctttcatctcccctgtcactgctttcacacttgatctgggaccagtggaacgtccctgtgactggctctgagcctctctcgggattcgttgtataaagcccttccctgagcctgcggttccggagaggggcgtgtctgattgtggcgcacgtatgtggccacatttactcgtcttaacatcgaactggccacagggaggggttttccttggctcctccaagagccaaattttacccccttggggcagtgttgaccccatggaggccttcagagtatgcaggtgcaccaaggaaagcacgggggtctcctcgccagagaggggggcatagcggggaggtgttgttgataaaaagtgtccgggtgtggtggctcattcctgtaatcccagcactttgggaggccaaggcaggaggatcactggaggccaggagttcgagaccagcctgggcaacgtagtgagacttcatctctacaaaaaataattttaaaaaattagccaggcttggtggcacatgcctgtagtcccagctgctcaagaggctgaggtagggtggcttgagcccaggtgttcgaggctgcagtgagccgtaattgcaccatcacactccagcctggacaacagagcaagaccccgtctcaaaaaaatgaaagccacaactgatttcccagtgaggctatggccaaggctggatgaccgttgtgtgccactctgtgtgtgcccatccataccactgtcttggggaggccaaggtcagccaggtggagaagttgccagcgatccactagaccagggccagcaaactcagtccaatcctgccgttcacctgagtgtcgtctgtgggtgcctttgtgcttccacggcacagtaggcagttgccagagaccgtggcccgcaaagccggtaacatctcccacctggacccttacggaacacgtttgtcgggctcagcgcctgtgctctgccgagagcttctctccgggagcagtggcatttgtctgcggcctctgtgctgaggcacgtggaccaggaccaggtggccacgccctgcagagcgcggcgctgaagcgcagaggtgcactcagttcctccattgtggcctttcttactctgtactgactgattgcctttgatccatatcattagcggtgtctcccattcctgggttctatgcagtgtagccacggcatttcatcatattttaaggataatttttgttttgcatcttaagaaaattcttgagagtccactcatataaatttcatgtgtcatattgaagaataatttgtccagtggaatgggagagtaataaaaccaccgccaaccgaggaggcttcatatgcttatggcttttccaagtgctcataaatgccttctctattacatgttttctgaacatattttcctttactggaacagcagttgcccagataagccaaggcttagaaacgagcctctgaatgcagttgctaattcacgagcttcagggtcgtcacttttaagggccttttctaccttgttgggaagaaacaagccctagaagtcctgagtgaaaagcagcatggtgagaacattccagtgcacagcaagggcctcgaatccaggccggtgaagagatcacgcatgggcagcagagccgcacgtgccgctcaggtgacccgttgctagtgggtcctggcaaccacacacggggctgttatgctttggtcaccatggaaattcccgggaggtgccaagtgtctgggctttgttttccaacagctgaaagacgatgcagttgccctggtagacgtgatcgctcctcctgactttgttctggactcaccgattggcagagccgacggcgaggtaaagggaggacagggcctcacgggagtgccccaagggttgatgggcatttctgcggagctgagatgctcctgtgggtcaggggtctggtgtcttctggaaagtggtcacacatggaggagcttcttggggagggcccgggacaagtcaggactgtctcactctggtgcttccccatgctggctctgtggttgcaggggacttgcccatcccctgcctgccttttcctcccgagatggggtggtggcactgcccgcctgcacaggcagaggttggaggtccacacactgtgacctctgccctcctcccactccccccggcctccccggtcccaggtcttacccccatctgaccatgctcctggccctgcaggcctcttcccccatccctgtcctggaatccccaggcccctctgtcccctctgaccatccatggttgtcaccggggttactctcccctgccccgctttcccccaaccgcctccctgtggctcctcagctctcctcctgccccccatgttccataatgattccttcatagcagatggggtcaggccgcccccctgagggagcctccaccagcctcctcgactgcctgccacgccccagccccacgcagccactgaatccttccaaggcccttcaccccacgctcccctcctgcccaccagatctagccttactggcctccccgtctgtcgcgccaggcccatgcccaccccagggccttgtgcctgctgctcgggctgcctggagtgccttccattctttcagtataagctgactattgctgccttggagaggccttctctggcctccagctgaggcagtgcccccaggcactgtagtgctgcccttgctggcctcatcactgaccttgtgtctccctcccacctgatgatgccctcgaggagcgatgctcacaggtccactgggtgccttccagcaccccactgcttatggggctgtgtctgtcttctgctagagggactcggcgtgtcaatgctcatgtcccgtgcctgaggtcccctggctgtgagtcacagaggggtttgaccccatccctgccccctggccccgcaactgagttatttctgctgaagcacctgctgaagcacctgggtctctgcccaaatggagattgagccttagtgggcaggaccctccctcagtcctcagggaatgctgaagtctgtacatgagcccttaccggcttagccagggagggcccagcgcctggcctcagcgcggcccaggctacacctgggttgggctaggtgtgccaagaggcaggtagtgccaggagccgggtgggcagggcaggaggtgagagttccccgtagtaggagaggcagggatggtcatctctgcagagggcctgctgtcctgcatcggggactgaccactgaccatccccagagcccatacagcccagatgatgactgccgctgagagctgagagccagagaagcccagtgggtttcccagccagggagtggcagagccaggatttgaagagactgtgccctgctgtagggagagaagacttggcgggagccttgggtcctgggggagcgcataggagagggacttgccctacccaccttcctgggagaggcagtctccccaggaggtgggggctcaccaggcagacaggcattcgaagggacactggagccagacccgccatggaggacccccaagcacacgggactgtctgccccgtgcaggagaagccggagcggccttgagcgtctacctgctgcgccttgctctgcagaggcaggcccgtctctgaggcagggaacgaccaaggaaaggagagaccttgcccatgatggaggggccccctggctctgggttccatagttaaaaccagagccagctggaggtgtcgctggcaggatggtttattaaacgtgcattcctggctgagcatggtggctcacacctgttatcctagcactttggaaggctgaggcgggcggatccctttagcccaggagtttgagaccagcctaggcaacatactgaaaccccatccataaaaattacaaaaactgaggtgagaggatcccctgagcttggggaggtcgaggctgtggtgggcagtgatcgcgccactgcactccagcctggccaacagggtgagacctcatctcaaaaaaaaaaaaaaaagtgcattccttccagttgcaaggaactggtgtattaaccaggagctgccaggtgagaaattcactataagcgaacaaacagagctgcaggggagttgagaccatccttaaatcaagcccgctgctccaaactgtgaaacataagctggaacctaggccctgtggagcagcagcctgggtctgtgtctgtggagcccagagtagcagagtggggaggaggggttgctaagtgcatttagcgggtgcaggcagaggggtttcttctcaataaaatgggtcagcgtaagctggatgcaaaatagaccacctccccaggccctggagatggtctgggctgcccctttccaccctgcacgggtgaagtgtctgctcagctgcccttcgcccttcatttgtacaaccttcctccaagacaggagcgtctctccccatcttcccagtgaggccacttaggctgagagcagtgaagtctgcacctcccgtaggggagtgctggcccggggcaggaccagaggagcagggtgtggtggcccaggtccagaaatcagccagtaagggccactcggcgagggcatcctgctgctggtggccacgtgccacctgtgcggcctgtagcggcctggggtgtgagagcagatttcagagcagcagtcgatgcagccttgcagcatcctgcggtggctgcagttactaagaaacagcgtgtccactgccacgatcagttctttttttttttttttgagataggatctcactctgtcacccaggctggggtgcagtggcataatctcggcccactgcagcctcaacctcctgggctcaagtgatcctcccacctcagcctcccaagtagctagaactacaggtgaactcctccatgcccagttaattttttgcttttttttttttttttttttttttttttttgtaaagatggggtttcgccgtgttgcccaggctggtctcaagctcctgagctccagtgatctgccttcctcagcctcccagagtgcagggattacaggaacgagccacctcacccagccaataatttccaaagaagagggcgaggggtgattttcattataaatgtgttttatagtactttataattgaattgtcctaattgttttctactagaaaaaaaaagaaaatattcatataaatttaaaccattttaaaatttctctaaaaagtgacagagaatttcctgtgcttttttgttattgttgttgttgtttgtttgttttgagacggagttttgctcttgttgcccaggctggagtgcagtggtgcaatctcggctcactgaaacctctacctcccaggttcaagtgattctcctgcctcagccttccgagtagctgggattacaggcatgcaccaccacacctggctaattttgaatttttttttagtagagatggggtttctccatgttggtcaggctgatctaaaactcccgacctcaggtgatctgcctacctcggcctcccaaaatgctgggattacgggcgtgagccactgtgcccagccgaatttcctgtgtttttaacaaaaactttgaggagttgcatttgcacactcagccatctaggaatcttttccttcttatttctttgtcttcacttgctgtgtacgtgttgtttgcagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacaccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaacatgtatgatctgtttgtccctgcagagtctacccagcaagtccttgcacacatgtggcctgtccccatggcgctggccacagcctgactgcagcagaccggggccatcagtgcacgcctcccccggtcactcctgctccctgcagggccatgggcttggctgcccttcccagtgttaggttcccggagcagttctgtctttgcatctgggtcctgcttcttaacctctgatcagctcagggcacggaaggccttcgtcttcagtagcagggagttgggtcactctggtgccccctgacccccgtggccacactcgtatcaccacagcccatcaaacagatgtaacccagcatgtctcaggacggtgccgaaccaaataagaccagttcttatttttccaggtagcccagagaacttttgagcgtctgaagggcatggtccagaatgtttttaaaaactgaatttccagcactggaaatcacttctgaagccattttcatgttagaaaagggtcaggacaccacccccccaccacatcccacccgtctggggctccaggggcatctgaggggtaattagtgacttctttgatgatcacctaccgcctgccagcaccttactgagcactcaggattcatcatctcgtgggacgctcagccaaccgcgtggggtgagctgtgccgtttgctgcatctgcagagaggagactggtcccaataggctggacactgccgcaggcagacagcaggaggtggccgagcgggaccagaagccatgggacctccctggtgcctgagtgccccagcacagggctgagacgcaataggtaggtgctggtatccattgtcactcgaacccaggagcatccccacctgaattcatcttactctggtttagaagcttccttgggtttaaacaaactcttcgtgggttacatgtgttttgtctatgatactcttcctgctttcagagagaatgggaatgagagtgctcaggcccttgcgaattagatggagcagttccgagtacaaacccagagaacacgtcagtggtgcctgccagtgtcggaggggctcattccccactgaggctgccacccacaggcctcacgggcccggggtccccagccccactgcctgggggtcccagcccaagagcagttgggcctgcgtgggctgtcaactggggtcatgcagatttccaccaggggtccccctcataggatgcctcaggccgtgtgtgtgtggacggctcctttacctagacctgtagcttttctaagcgagaaggaacaggctcccaagtcctctgatgtgcccgcagctagattctaggtggtg

SEQ ID NO: 17418 - DNA, 30851 bp, Human
caggtggatcatttgaggtcaggagttggaaaccagcctggccaacatggtgaagacctgtctctactaaaaatataaaattggctgggcgcagtggctaacgcctgtaatcccagcactttgggaggccaaggcaggcagatcacgaggtcaggagatcgagaccatcctggctaacatggtgaaaccccgtctttactaaaaatgcaaaaaattagccaggcgtggtggcgggtgcctgtagtcccagctactcaggaggctgaggcaggagaatggcatgaacccgggaggcggagcttgcagtgagccgagattgcgccactgcactccagtctgggagacagagcaagactgcgtctccaaaaaaaaaaaaaaaaaaaaaaatatatatatatatatatatatatatatatatatatatacacacacaaaattagccaggtgtggtagcatacacctgttatcccagctactcaggaggctaaggcaggataattgcttgaacctgggaggcagaggctacagtgagtcaagatggcgccactgcactccagcctgggtgactccatctcaaaaaaaaaagtaacataggtatccataagcagatctggtgtctaataattcaaatgtggcacatttttatgaggaagttatgaacaatttctaaaaactagctattttaaaaagggcccaatgatgatttctacttactcccaaagaaagacagctggtctccccatcccttgagtattatgtatacagtttaaatcactttgttactcagcacaaatcaaaacaaatcactttgttactcagtacaaatcatactctttgacgtatagagtttaaattcagttattctcaaatgtggagcttttcaagatactttaaaagttagacgtaggccaggcgtggtggctcacgcctgtaacccagaacttttggaggccaaggtgggcagatcacaaggtcaggagttcgggatgagcctggccaacatggtgaaaccctgtctgtactaaaaatacaaaaaaattagccagatgtggtggcgcatgcctgtaatcccagctactcaggaggctgaggtaggaggattgcttaaacctgggaagcggaggtgacagtgagctgagatcacgccactgcactccagactgggcgacagactgggcgagactccgtctcaaaaaaaaaaaaaaaaaaaaaaagtggccgggagtggtggttcacgcctgtaatcctagctggttcacacctgtaatcctagctttctttgggaggctgaggcgggtggatcacctgaggtcagagtttgagaccagcctggccaacatggagaaaccctgtctctactaaaaatgcaaaaaattagccaggcatggtggcgggtacctataatcccagcaacttgggaagctaaggcaggagaatcgcttgaaccccagaggcggaggttgtggtgagccgagattgcgccattgcactccagcctgggcaacaagagcaaaactccatctcaaaaaaaaaaaaaaagttagacatatattaggtggtctgtcagctcatctgagttttaagttccatatggaggtagaaaattaggccaggcgcagtggctcactcctgtaatccccgcactttgggaggccaaggcaggtggatcacgaggtcaggagatcgagaccatcctggccaacatggtgaaacatcatctccactaaaatacaagaaggcgcgcctgtagtcccagctactcgggaggctgaggcaagggaatcacttgaacccgggaggcggaggttccagtgagctgagatcgcgctgctgcactccagcctggcaacagagggagactgtctcaaaaaaaacaaaaaaaaagaaaattagttatcttggtgaaagcataagcatagatatttgcttgtatatgtattccagtttaagaaaaattaaggccttgatggatttctaattggttttccttttcttctttccttatagaaaagcagcatctgttatagcaaaatacccacacaaaataaagagtggagctgaagctaagaaattggtaagtttagttagcatgttgatcgaagagttcacacgtgtccaaatttggtgggttcccaccaaaccaaacttgcctgtctgaagcagccttgacccacacaggctgatttcactactcctgatttcttggaataacattcatgctgtttcatacacactttttcaagctcaaaatgttttcatttgggagaagatgggttaaaatttttaaaaatatatgtaattacagttttctttctctctgttacaatatatacatgtactcacgttgaatttcaacttgagtgttggtttttaagaagagtgaccaagtggcactagcatatctggtcccacctatttttctctgatccccaggtgtaggaacctatgtgagttagtgggagtgcgtgttccccagagagatcttactaataagcacatgattaagacccttttgttttatggcatttagccctgttctctgtaatttccacgaagccttgtgtactgtgtcacagtttctagagggtcacatgcctcgttaatttgtaatataataccccttatctgaaatgcttgggaacagattattttggattttggattttttttttgaatatttgtatttggttgaatattcctaacccaaaaatccgaaatccaaaatgctccaatgagcatttccttttgagtgtcatgtcagcactcaaaatgcttcagattttggacattctggaatgtggatttttggattagtgatactcaacctgtaatatcactgagaatatcctgagatggtctatctattgacaatcagattgttgtctcatctaaatcttactaaatgattcaaagttccttaaatttaaggaccatatcttattcatcttttgtgaaagatgtcaaattatcatggcttttttgtttgttggttttgagacagagtctcaccctgttgctcaggctggagtgcagtggcacgatcttgggtcactgcagcctccgcctccagggttcaggtgattctcctgcctcagcctcccgagtagctgggactacaggcatgcgccaccatgcccagctgatttttgtatttttgatagagacagggtttcactgtgttggccaggctggtctcaaactcctgacttcaggtgatccactgccttgagcctcccaaagtgctgggattatagtcgtgagccactgcacccagcctgagatgccttttgagtagtccaggtcctgatagttatcacctccttttgttctttacctattaatgtttcacaaatgtcctctggaatttaagaattaatatttgattatcttttaaccttctcaggagatgagccataattgcccttttttttcttttttctttttttttttttgagacaggattttgctctgtcactcaggctggagtgcagtggtggcataatcacagcttactgctgcagccttgaccctcccagccaagcaatcctcccacctcagcctcctgagtagctgggactacaggcatgctccatcacactcagatattttttttttaatttatttcttttgtagagattggatcttgttatgttgcccaggctagtcttgaactcttgggctcaagtgatcctcctgcctcagcctcccaaagcgctgggattacaagtgtgagccaccatgactggaccataactgccgttatatttttgcccttcagagtcataacattaccataaatcttggacattgtgtgatttagtgacagattgtccacattcaacatgtgccacatcttaaccttgacttcgctactcagtacaaatcatgctctgatatataggctttaaatccttgtggcatagacagttctcagcatcagtatatcctccttaaatagactagccaagtaagttataaatacattagactttaattctgagtttctgtcttggtgaactgacccattgatagtctcaggaactactcctgcttccattcacttcctcttttatccctacagtacttccttttttatgtttattgcaaatagcctgctcatttcttagagaaaaactgaaaagctctgatacacttcatctcaaatctgcgcttatggtatattcctaaaaagaatacaaaggtatccaaaattccttttgcataagactggttgtaaaaatctcatcattattccttttcacaattattgaagaatcacagagttgctatctagcccatttctggaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagaattactcctcagtaattctagaaattattctagattatctaatctattccttcttagtaacggaagtaatagattcttcttagattatctaatctgttacttctcagtaattctagaaatctgaaatttccagaatgagtagtttgtcttttattccttaatgtttggtatagaaagtagcttgggtctgaattgcttgaggtcagtatgttattgagtaaaattattgtagcactatgtgtaaagggaaaaataattaccctttaaaaaaatattgtgatacaggaaatgagcctgagcagtttcctttttctaatctattctgcttcctaaatcttttgttcatttctatctggtaattgctgttttccaaacttgaatatgctttcagtaatttggggacatttattaaacattaaataaattaagaatattgatgagtgaacctaggcctgagaggcagtagagataactggcacacctgttattaagcatgctgaatgtttaactaaaaaggacaggacatttttcaatacacatgaaaaaaagttcaattttactgataccaaagttgcaaattaaacaagacactatatagtgcccatcaaatacatgcagtgtggagaaagatgtgaaaaaaaggaccctcatttactacccatgaaagtgttggttgttacagcctttctgaaggctgctttgtcagaatgtatatatcgtttgacctagcaattccactttgacgtatgtttcctaaggaaggtaatagagatatgtatctactaggattcattaattcataatttttgatcacctgtatgccagtcactagggataaaaaaatgaaaagacaggatctctgctctcccaaaacttagattctagagaagtgctgcccaatacagcaaccacaagccacatttggccattgagttcttgaaacgtggatgttgtgactgaagaatggaattttaaattgtaattaatctaaacttaaattgtcatatgtggctagtgtaccatgttggaatgtgcagttccagagcagcgcttcttagaacaaggtgtctaggccagcagcatcagcgtcccctgagaacttaggcatattcttggccctactccagacatggtgaatgagaaactctagggtgggacttacattctgtgttttaagaagtgcccccatgtgatgctgatgtatgcaggagcttgacaacctctgttctaaaggaagtttatgaatattattatactgtcaaataattggaaacaatctacatgtttacctgtagggtatttgctaattaaattattatgcatttatacaatgatatactgtgtagccataaaacaaaagttaattttaaataagatataattattttctcagagtttcccttttgtcattcatgtaagcattctgtcttcgggagaatttattttcactggggttcaattttctgtgtcctttatttcaaaccttatcacatggtattcatttgtttttcattttctgctttttactttatcttttagtgatttggtaagcattatattcatatgacttttatatttctaattttccatgtagcctggagtaggaacaaaaattgctgaaaagattgatgagtttttagcaactggaaaattacgtaaactggaaaaggtaaaattttaacttgtttacttcattaattatagtatctgcctttatggccactatgtagcgtcattgcagggtgaccaatgtcattcactgtagtgagactcacaggaaatgaggtgagtgaagttgatggctttaactttttgaatgttatttccataaaatgttcacttgttttatgtggcatttaagagactattaacacccgtaatagagttggctcatcgttttcagtactattcagaaaagagattataaactttgactgaaagatcgttatcttttagaatttctttatttctttatttatgtttttgagatggagtcttgctctgtcgcccaggctggagtgcagtggcgcgatctcggctcactgcaagctccgcctcctgggttcatgccattctcctgcctcagcctcctgagtagctgggactacaggcgcccgccaccacacccagctaattttttgcatttttagtagagacggggtttcaccatgttagccagtatggtctcgatctcctgacctcgtgatctgcccgcctcggcctcccaaagtgctgggattacaggcatgagccaccatacccggccatcttttagaatttctatgtttacactcacccaagcatttttatggttttatttcaccccatgatagtaattatatcacttctgatctgttaagaatagaccttttaaaagtattggataacttagagatgagacatcttcagttactctgttattcacctattactccttaggttacttgtgaataattttgtgtgggtcacccaggcaaatgtaaatagctcttcatgtcttttagcagactggtatgtttccaataagatcatttaagtcctcaaagcattcctaaatcattgttagacttttttttttcttaaagattcggcaggatgatacgagttcatccatcaatttcctgactcgagttagtggcattgggtaagaactattttttaagcagacacaatcgtcagttagtttatttttcctgttagccaaagtaaattacatgctgtttctcaaaacctgtacttcaccacctctgtaccttagccatacagttcacccttccatagcttatgatctgaggccgattcttcagatagtgtctctactgtaaggtccccatccaaggcagatgttacctccttcatgaaaccagtttggttacccaggcagaaagaacctctccctcctctgaactccactaccatttcctccgtgtgcatctatttcctgctccagcttggcctcttttgtttctctgagcatgatatttatcatagcacctcatgaatttggaacaagccctcaagctttttttaaattattttttgagacagggttgctatgttgcccatgctggtcttgaactcctgggcttaagtgattcttcctcctcagcatcccgagtagcttggattataggtgcacgcccccttgcccagcttcaagcatttttaaatgaagggattattatcttaaaatttgagctggtaccaaggtgggcttttttgacactggctgaagtaaagattaacattgaaatattaaggctttagtgctctcatctttatggcatggggcattcctttaaatataatgatttgttctttaaatggcagcattttcggtgaaagttattctaaaacatattaaattcttaaacctagtatgttgaaaatgaaaatgactgcttggggactcaaggccattataaaattttcattggaagaattacaaaaattttttttttttttagagatagtgtcttattctgctatctaggctagagtgcagtggtgctattatagctcactgtaaccttgaactcttggggtaaagtgactctcctgccttagtactccttttgagtagctgagactacaggcttgcgcaaccatgtgtggccaatttttgtatcttttgtagagaagaggtctccctatgttgcctaggctggtcttgaactcctggcctcaagccttcctcccacttaagcctcccagagtgctaggattataggtgtgaaccacaaggtgttttagagagcatctattatcctttttttctaggcaagagaactgaaagttgaatatagaacatgagtaaccatggcagagccagatttgaacccatatcttctgactccgagttcagttctgtttcttctatgctgcattgccttcctaacatcagtatcagtttctatatcacaatataatgtgatgatatttgcatagcttactgaatgatacaggtttatttgtcccgaaacactgtggccccagactattgtgcttgtatgtttatatgtgtgtgtatgcatttctttctgttcaccgctcctgctttattatgctgtaaactggtatggtgagaagagagtcaggaaatctggataatggtctagagctagcaccagctagatttgtgaccttagcaaatcacttcatctttctaggtttcagtgtccttccttatgaaataagagagaaatttggttaatcagtaagcttccttctgtccccatcctataagagcatcttcagtcatttctgacattctgatttatttatatgaataaagtgatattttagaaacctaaatcagattttatcattgctttgtgcagtgtcctctaatagctttccattgcactcagaataaaatccaaacctatcaccatggctctaaaagcacagtagagtgtaacacctgcgtactgttccatagcacctcataccgtcacttacatcactctatgcatcctagtttttctcttctcttgaacaggccaagctcatgccagccttagggcccttgcactaattgtttccttttcccgaaacgtttttatctttgatcccctagatagctggttctttagtcattcaaacctcagcttagataccatctcagagaccttctaccactcagtctaaagtaggacccagccattctgtcatattctattttaatttatccatctgattttttcttgtttatgtaactaactattgtctctatctacccacttacattcttattcctgctacattttcagcacccaggaaagtatctgacacataatggccctcagtaaatcttagttcaatgaatgaacagttttcaagtgccatctgtacatgggcactatgacagcagctgcttagacatcctttttatgtctgaattcatagttgtcttcctaatgattgaagcttcaataattcgtacttcggatacagttgaacattaccaaagtagccatgcaacattttagcaggtcttgtttagcttaatagcagctcttcttactattaagacatggttgttacaaggatcccaagtttcacccaatgttgagataatgcttttgtttttgtagtccatctgctgcaaggaagtttgtagatgaaggaattaaaacactagaaggtgagtatgactgtaggtcactaattccagattaaatatggtcctgaaggaccattagtgctctaacaaacttcaacttgaaaaacccattctcaatcagtagatacaaaagataagattttctttttaactctgtagtacagtagatatagggtatagtttatattaccatcataaacatttttaggtttgtaactaactcagagaaaactaagaagaccaagaaccagggccaggcgcggtgcctcatgcctgtagtcccagcactttgggaggcgggtggatcacttgaggtcaggggttcgagaccagtctggccaacatggtgaaaccccatctctactaaaaatacaaaattagccgggtgtggtggcaggcacctgtaatcccagctactcaggaggctgaggcaggagaattgcttgaacccgggaggcagaggttgcattgagccgaggtggtgccactgcactccagcctgggtgacagagtaagactctgtttcaaaaaaaaaaagaagaagaccaagaaccaacctcttgacttaaaagcaatgaaatagttatcgtttgcaaatttttcaaatatctaaattgcctttatttctttttttttttttttgctctgcctcccaggttcatgccattctcctgcctcagcctcccaagtatctgggactacaggctcccaccaccacacccggctaatttttttttgtatttttaatagagacggggtttcactgtgttagccaggatggtctcggtctgaccttgtgatctgcccacctcggcctcccaaagtgctgggattacaggcgtgagccaccgcgcctggccccctttatttctttaataaaattttaggcaataaaatcttagattaaaagctaagttatatattactgaaaaagattctgtaagagatttgtaatggttattaaaggaatttttgctttcaaagaaaagataaaaatagaacctaacaagtaattataaaacgttttccttaaatatagtaatcctttacatgtaatttatctctttatacttttcatgggtgtatgtatacatatggattcattacagcatatccatggcatttgggatttagtatttgtgagtatttgcaagcagcccagtggttaggtaggcaggttttggagactgacctggctttgaatcccacctccactactttattagagtgggatgaccttattgcgtcagtttcacacctacaaaatgggtatttctgcttcgtacaattaaatgcaataatatatgtaaagcacttagcagagtgcttggtacctagtactacttaaaaatggtaaccaactcttatgaggcatgattagtagtattactaagttaagaatttgtgtgagccacattgctagagaatgaactctacatgtgcatctcatacagggtttatgctttgatgcctgtggtatagacagcttatatgagagaattgattggctaaaggggtcaagaatctgtgggtttcttggaggtattgagttgcatctcttgggagtgtcaaggatctactgttgtggtttttatatttcacaattcacacataaggaatacaactgttgatatctataactatatctgtctaacatactcagtatttccacttcttcagttttagtcgtatactttagcgttttctgtgtgcacataaccataggaaatattaagtgctctatatttcataaagatgcttatttttctcgattttatatctccagagggaatgtgtatatttgtggctataagggggcttgtaggaattgcttttgaagcatgcttatcttgctgtttctttaacaaggctcacagctggattcatgcccagtaaagggacacctgaatggaactgagtcacttttagacttaatatgggatgttatgacaattcttaagttaaaaaatgcaggtacagtaataattttcctttcaatggaatttttttttgttttgagacacagtcttgctctgtctgcccagaagtacagtggcgcaatcttggttcactgcaacctccgccacctgggttcaagtgattctcctgcctcagcctcctgagtagctgggattacaggcgcgcaccaccatgcctggctaatttttgaagttttagtggagacagagtttcaccatgttggtcaggctggtctcgaactcctgacctcatgatcctcccacctcagcctcccaaaatgctgggattacagtcatgagccactgtgcccggctcaacaggattttgagcacaatgactgcacaaatctactactcagtgctaatggaatgaaagagtgaaagaacaaataaactatgaataaacctagttaatcagaaaacattcagaagttatggttactactgttgctcttaacaataaattaaaccactatagtcagtaaaatttggtgtgattctggttttttttgttgtcgttgttgtttttcgagacggggtcttgctctgttgcccaggctggattgcagtggcgcaatctcggctcactgcagcttccacctcccaggttcaagcgattctcttgcctcagcctcccaagtagctgggattacaggggcacaccaccatgcctcgctaattttttgcatttttagtagagatggggtttcaccatgttggccaggctggtctcgaactcctgaccttgtgatccgcccgcctcggcctcccaaagtgctgggattacaggtgtgagccaccacgcctggccctgaagagtcacttttatctagctcttcatatctgaaatttttgtctcattgtgttttcagtcatttcaatgtatttgttccccaggtggttctttataaaaagggtcattgagtttagcattttccccccaaaaagcatttaaattaacatgtcaactttatttatcttctatacagatctcagaaaaaatgaagataaattgaaccatcatcagcgaattgggctgaagtaagatggcagattttcttttgacacttgagatataaaagtaaattttttatagacattcttttatacaccagaaggactcttcaaacttagctaaaccacaaccattttcctattcagaagtgctaagatttgtggactcttacagagtatctgcctgtgttcacacaatgctttcacttttgctttctagtttacttgttttgaggatttcccttattcttttgactttagcagggaacttcctcttaaaatacctaggactgagtgtatcaggcagtcagcgggtgtttatttcatgctcacattgtacaaagcactacactaggtctagggtaaagatacagagaggttgagtgtagcttttaagaagtttatagtctacccgagaaggtaggacatgaatatgaaaaactaaatttaaaaaaaggacaaacctcatacctaaataaccatataggaataactactaggcatgtttctatatcagcatcaataattattttgtgtgccagatatagtctgggaaccccttttctaattatttacagttatagtgcataagcactatatgtatctcttctggcattatatagtgttgtgagtgattcagtcctaattaccttttgaattttcctgttgatgctttaccataatattttaaacttatactcccattccaaaatcttgagccagtgagagacctggatggtatggttcttgctctcctggcatttctgtagtaaatggaggtgttctgaagaactggtttgctgagaattggctgtgaataggtgcttcatcatgctgaagcatatgcttagttgctgtttcacactgaatttcctaacagccttattgagatgtaattcatatgtcctgtaattcatccatttaaaatatacaattcagtgacttttagtatattcacagagttgtgcacagtgtaggaaccatcactacagtcagttttaggacatttttgttatctcagaaagaaccctgtacctattactagtcattcccccattgcctccccttacccccacctcagacctaggcagctgctcatctactttctgtctctacggatttgcctattctggacacttaatgtaaatgaagtcatacagtatgtggtcttttgtgactgacttcttccacttagcatattgttgtctgagtttatgttgcaggatagtatttgaaaatataattttgcaggatataagagcggtaaactgtaaccccttgccttgtcagtagacagcagtttactttgaaaataatgccctaacttaaatatatttatttactcttgttacatgaacacatagtttatttacaaataagtttagatggagcctttgaaatattacaaagaatgacacttaaggatttttatccagtttaggaataaacctccccccattcactccacccccaattttgctgttgtcatctcagtgaattcattctagccttgatttgtgagaatgatctgctggtatggcacggacaattgttataaaaggcaatttaatttttaaggagatttaaattttacgaaaatcttttgtctacttattctgtctttatagatattttggggactttgaaaaaagaattcctcgtgaagagatgttacaaatgcaagtaagatgtgtcaaattatattctttgattagaattgagagtgtcacttggtgaaaagccattttgggaatactgacttaatttttcttctattaggatattgtactaaatgaagttaaaaaagtggattctgaatacattgctacagtctgtggcagtttcagaagaggtaacatacttcctaatcttgggttatttttgccctgatgttaaaattgcctaatatatgggaagaatttggattaaaaagatgtaatttgtggtacttcatagactcactaagacctagtagtattagttaagggtatttgtttatagatgggaatatgtaactaggggaaattcatcctgattttattataggatgatattttaatgactagttttaacgacgtttattaaatgactttaagtatattgaaatgctagtaatggttgtctttggccttttggctggatgatagtgaagttgtgggtagttttgttaatttacctttctttttcctttttttttttttttttgagacagagtctcactctctcgccacgctggagtgcagtggcaccatctcggctcactgcaacctccgcctcccgggttcaagtgattctcctgcctcagcctcctgagtagctgggactacaggcgtgtgccaccatgcccagctaatttttgtatttttagtagaaacggggtttcaccatgtttgccaggatggtctcaatctcttggcctcgtgatccacccacctcgacctcccaaagtgctgggattacaggcgtgagccactgtgcccaactgcccaagttttctataagagagctaagaataatgtcttagaagtaccagttcaaaaccaattcttacaacaaccgggttcatcagaagagttctgcttagtgtgtgaatgtgagcaaagtaagaaccatataatcctggtgtcttactggtttaaaatattgaaaagctcatacatgcttaaaaatattaacttttggccaggcgcggtggctcacgcctataatcccagcactttgggaggccgagccgggcggatcacaaggtcaggagatcgagactatcctggctaacacggtgaaaccccatctctactaaaaatacaaaaaattagccaagcgtagtggtgggcacctgtagtcccagctcctcgggcggctgaggcaggagaatggcatgaacctgggaggcggagcttgcagtgagccgagatcaagccgctgcactccagcctgggcgacagagcgagactccatctccaaaaaaaaaagaaattaacttttaaaattggaatagaaaaaccttatttaaaacattttagagtatgttagagtagatagagtagatacctgaactgaatctctggccacctgtggagttttgtctaggaagtaggtgatggcctatcaggaatactctgggtagctgctgtaagaatctagagttggagagagaaaactaaatccatactcactgatcagtagaaagaacattggactggggtcaaaagacctggggtctgaggccaaatctaccactattatgtctctcctgatcttagattccatactcgcaaaatgagagaactgaagttaaccagattttcaagtatgtctgcatcagaaatacctaggacttaaaaaaaaatacatattgttgtacccttctgcaaataagaatctccttaggtgggaactgggattctgtattttcaaaatgtagatttggaagcacagcaagccaaatgcatgctatgttggctatgacagccttcctggatttatttatttctattttaattttacttttttggggtatgttgtatggttatatgctttcacataaaaaggtatactctaagacatctcacttccacagtccctatgcactctttcctactccttctaagtcccattaagaaccacttccctatggattcttgtaacgtttcttcatgaaaatacaactaaatactagtataccatctttatttctttcttctctccctttctttcataaagttacataatatatatacaatactataccttgcttttttcacttacaaataacatcctagagatttttccatatcaatatatagaaaacttccttatttatttattttttgagatagggtccctctctgtcacccaggctggagtgtagtggcgtgatctcggctcactgcaacctccgcctcccgggctgaagtgatcctcccacttcagcctccagagtagctgggaccacaggcacgtgccaccacacccggctaatttttttttttttttttttttttggtagggacatggttttactatgttgcctgggctggtctcaaactcttggctcaagtgatccacccaccttagcctcccacagtgctgatattacaggcatgaaccaccatgcccggccccttattcttttttgtagctgtgtaacattcagttgcatgcatgtatcatacttcatttgtttatccagtccgctattaatggacccttgggttgtttctctttctttgctcatacactttgtttttgttttttttttaataaagtgaaacatttttgttggtaggcggacagtgaaagacatccagcttttaggaggaggaaatgagaacaagagaaggcaatagaattttcttgattaaaatagtttccatggatgtccagtacacattcagtctagtcttctttttttcttttttttttgaggcagagtctcgctttgtcgcccaggctggagtgcagtggtgtgatctcagctcactgcaacttccacttcccaggttcaagcaattctcctgcctcaacctcctgagtagctgaggttacaggcaaacaccaccatgcccggctaatttttgtatttttttttttttttagtagaaaaggggtttcaccatgttggccaggctggtcttgacctcctgacctcaagtgatccgcccaccttggcctcccaaagtgctaggattacacgtgtgagccaccttgcccggcctggccttctttatatttaaatatttggttaaggcactgtggctcatgcttgtaatcccagcactttgggaggctgaagtgggaggatcgcaaagacactgcaagctctttagttaccaaaagggtgtttggcctctgttgtacttatcaaaatgaaagggaggagatagattggattcttttatgctgtataccaggcactatagtggatgcttttacatatgttcttatttacttacacaatagcatatgaagtagtttttagtagtttacatataagaaaactgaggtctagaggaatgaagagtcctcacttgcaacactgaaaaaaaagtaaaatgaaaaaattccatctcagtggagacagaatttcatagaatataggaaaagaaaggtttaaatagctgtatataacttgcctgaagctatgtggttgtagagtatagacctattaattgagttcaaccataagaattgaaatgagttttctttttaaaaaaaaaaaaaagagagtgcctggatctctctgtgttgactgggttggtctcaaactcctgggctcagcgatcctctggcctcagcctctcaaagtgctgggattacaggcatgagccaccgtgcccggctgaaatgagttttctgattaacctttatagagttagagtatattgtttaatttgagatttttacatatagagttgttcataggtgtattttaaagctattttaaaatattgtttttattcattattgagtagttacttaggtgcatttttaatacattaaattaactcgttgtatgcaatgtatatctaatgccaattactgttgtcatcacagattctgctgtctacatcaatacacctgaatagttggacagaaaattgaaatcttttaactaattctaactatgaagcacagtgaaatagaaagttaggctgtaagaagtaaggctcttctgtgtgtcatcagcttggttccatttgcccaattgatacatttacatggacaatctcatatgtgtcttctgtcatcacaggtgcagagtccagtggtgacatggatgttctcctgacccatcccagcttcacttcagaatcaaccaaacaggtgcctcagagtttataatcaatggtgatcagtcttacacaacagtgaatttcactttttaagtgatagttgggtattttcagaataagttttgttttcgccttcctgaaaagtctgaagagctttgtactgattgaattctgcgaaaggcaaatttctcgaaaaggatacctattattcttccatgagttgctgggaggacagtctaacatttgaaagagaaaacattgaatacaatagttttagaacgatttactgtctgtgataaatactttagaaatactataatcagattttcattaaattttatcttaaaaaatgaaatattgagaaaccttctattagaaaacctgtgaaggcaaaacattttttattttagaatatatgcctttggaaggtgaaacagctgactctttgattgcttttttttcccatgagccatttcaagaacaggaaaactctttgatttaaggaaacagataaatacaactgatcattgtttttacaatcgtaataccttaaacagtggtttctaaaaatatgtttcatttgataagatgaattttctattagagggaaaaagtacttgctcagaacattagaaaacatagagatggccgggcacggtggctcatgcctgtaatcacaacactttgggaggccaaggcaggtggatcacgaggtcaggagatcaagaccatcctgcccaacatggtgaaaccccgtctccactaaaaatacaaaattaaccaggcgtggtggtgcgcgcctgtagtcccagctactcgggaggctgaggcaggagaatcgcttgaacccaggaggcaaaggttgcagtgagccgagattgtgccactgcactccagcctggcaacagaacgagactccatctaaaaataaaataaaataaaataaaataaaataaaataaaatagagatttctccataaataattagaaaactcatgttaaaaatgttttcttcccgggctcgattccctgccaaaaaaaaaaaaagttttcttattcaggcatgatgttgttcctggtactctggatgctgaggtgggaggatcacttgagtccaggagttcaaggctatagtttgccatgattgtacctgtgaatagcacagtctccagcctgtgcaatatagcaagactgtgtctctaaaaatattgttaaatattttcttgccattacaaagtaattactctttttcttattccctaattatgattctacagccaaaactgttacatcaggttgtggagcagttacaaaaggttcattttatcacagataccctgtcaaagggtgagacaaagttcatggtaagtacttgttagagttagcacatctaaaaaaaaacttggagactgttcagtagccattctgagtgtgtgacttcatggtagctttgaattacagtcaccaaatagagtatccatgagactttaaagaaaaataatagcaggggccgggcgcggtggctcacgcctgtgatcccagccctttgggaggccgaggcgggtggatcgcctgaggtcgggagctcaagaccatgctgaccaacatggagaaaccccgtctctgctaaaaacacaaaattggccgggcgtggtggcgcatgcctgtaatcctagctactcaggaggatgaggcgggaaaatcacttgaacccaggagacggaggtgcggtgagcatagatcgtgccactgcacttcagcctgggccacaagagagaaactccgccaaaaaaaaaaaaagaaagaaaaataatcagcaggatgcctgattctcatagctactctcagaatattttaggaaagaattttcttttaattctccacttgtaaataacacgtgtcatcagaatagttaattaggcctgggcatggtggtgtagtcccagctctttgggaggccgaggtcagcggattacaaggtcaggtgatcaagaccatcctggccaacacggtgaaactccgtctctactaaaaatacaaaaaattagctgggcgtggtggtgtgcgcctgtagtcccagcttttcgggaggctgaggcgggagaatcacttgaacccgggaggcagaggttgcactgagccgagatcgcaccactgcactccagcctgggtgacagaccgagactctgtctcaaaaaaaaaaaaaaaaaaaaaaaaaaaaagaatgggttaattaggcataatctgctttttgaaaataccagtaatgactttgacacacagtaagtttttccctaaaatagcaaatggttctcatcttctctgattcagaattcttcaataagtaacgtagttagaattgattgaaaaatattaatctatttcaacaccaaagaaagaaaagtcatcagggtctgtgatagaacactcaggggaagaaacgttacatggaatgataatgaggaaagttgattgggggggaattaagacttaataattcaagatgaatggctagtggattaaaagcagattaataaatgattctgtataaacaccaacaggaaggcagatagaaatctagaattacgattctttttttttttttttttgaaaaggagtttcactcttgtcacccgggctggagtgcaggagggcgatctcggctcactgtaacctccacctcccgggttcaagcagttctcctgcctcaccctcccgagtagctggaatttcaggtgcctgccaccacgcccagctaatttttgtatttttagtagagaccaggtttcaccatgttggctgggctggtctcaaactcctgacctcaggtgatccgcctgcctcagcctcccaaagtactgggattgcaggcatgaaccaccgtgcccagcctagaattaagattcttagttcctttttttttgaaacagggtcttgctctgtcacccaggctgtagtgcagtggcgaaacatggctcactgcagcctcaccttccagggttcaagcaatcctcccacctagtagctgggactgcaggtgcgcaccaccatacctggctaatttttgtattttttgtagaggtggggtttcaccatgttgctcagactggtctcgaactcctcagctcaagtgatccaccctccttggcctcccaaagtactgggattacatgtatgagccactgtgcccgggcctcttctttcttaaggtgacatttagtgttctgtcacttatatacatcattcgagtccattttctcaacaccccacttttcccgggtgatatgactgaaaggaaagagactgtgcttttggagagtggatgtgctaaaattagtaagagtctcagtgcatagatttgacaagagttttagccaaaactagaagatagttgagaaagataattaaattgtcatgtcattcagaaagtagagtggtgtttgccagggcctggaaggagggggtaatagggagttcctgtttaaatggcacagagtttcagttggggaagatgaaaacattctggagatggatggcggtgatggttgcacaacagtgtgaatgtacttaatgccacagaatggtacacttaaaaatggttaaaatagtaggcacagtggctcatgtctataatcccagtgacttgggaggctaaggtgggagaatggcttgagcccaggagttcgagggtatagtgagccatgatcgcactactgcactccagcctgggtgacagagcaagaccccatctcaaaaaagaaaaaaaaaatagatggccaatagatggtaaattgtatgttgtgtatatttaacccacacacatacaaaaaatcatgtcattaagttcagcatggtgatattagtgggctgtgaaagtgtattttctaaggtggtcacactttaacaatgcttccaaacgaactttggaaagataaaagtaaaggttctagtcagtcttggaaattaaatctctgatttgttctcttgactctgtcaagttttgaagtcttactctgttcccaaaagtatatacatacatgagatggtattaaaaatagggcttgtgtatgccccatgaacagccttttcaaatttaggtggattttaattcactcaaaatgaatgtgcatgaatcttacatttaagaatattcagtcagataaaatcctaaaaacagtatctgctagacaagttggatgttgtgcacagtagaaaagtatcttgctacgtctgggcatattttggggacctctctggcctaaatcttcctcaagtatcatccctgtgaaagtcactagaaatccttactgggaagtgtgccaactgttttcagagttaatgaccaggaaggtagttccacactaccatggcagaagctgtttttttataatcttaatggtgttctgctgtgctcgaagagagatccagaggaaaaaccaacagaagctataggaatccagctagcaagaatacaaggtaaaagggccaggcatggtggctcacgcctgtaatcccagcactttgggaggctgaggcaggtgaatcacctgaggtcaggagttcaagaccagcctggccaacatggtgaaaccccatctctactaaaaatacaaaaattagctgggcgtggtggcgggcgcctgtagtcccagctactggggaggctgaggtggaaggatcgcttgaaccaggaaggcagtggttgcagtgagctgagattgtgccagtgcattccagccctggcgacagagcaagactccctcccaaaggaaaaaaaaaaaaggaaaaagtataatctagtgggctggatgtaacctgaaaaggaaaggtgggtagccaagtctttgtgatcttgttgatagtgttggacttgggttatcccagtacatgtgccacaggaaagaatactaaggccactcacccatcctaggatagaccctatcttgacttccctgtctttcaatcatacatctggcagcacatctactggtattgccaggaaaggcatcccccagacatatttccagaagaaaacaggctaaaaaacaagaagactgggtctgtttatttgtttttaaagtatagaagattcaggtgacaataagaacaagaaactaaggcctttatgttgcgacataggaatccatctcagtgggtggtttttgacaaagtttggatgttatacctgtggttcatagtccctggaacttaaaaaaataccgtagttgagcatgctgttttgacatttgtaatcattgttaggaagagaagcactcgaggtcaactttcaaatcaattttagagacaggtaagaggtggtttgtatctttcattatagaagaataaatttggatacagaagatagagggtcttattctggctccattactaatactctgtatggcattgggaaggtggatttacttctaaaaggcctgagttttatctttaaaattgatatttgccctacgtcagaagaccgttatgcagatcaaaattaaatagtatatgtggaaactttgaagagtttgtacaaatatttgatgtacaaataagaatttgcacaacttcaaagataatggatcttccaagagttgtacaaagagagctgcacaaatataagatgtcatctgtgtggaaatgggtcagtagaggcaggtgacctggtaagggttagattggggaacaaaagaagggatagaaagagagaggatggtgccatgaaaggagaacagaatgaggagagtgagcacccccagggcagcagttgtattcagtcagttcagcaaatacatacaagcatgtcctccattccaggcactgttctcgaagcttgggatgtatccatgaatttaagtaaaactcatatttgaggactgtgggaagggactgatagttaacaatgaacataataaatatgtgaattatataataggttgggtagtaagtgttattttttaaaaaggaagaacagggtctaggggagaggagagtgcaggaggcagtattaaatagtgtggttggaggcagcctcattgagaacatgagacttagggaatgacatagggagttagctaagccggtatctgagggaagagatagccaggcaggagtccgagcaccaagcctatgggaatgagcatgagcaagatatctaatgaagatgagagctctaggcttctaaaaggaaattggctgcaaaatgaattcaacttaggtagtgaaataaaccattctcattccatatcccctttttttgcaaaacctcttcttgctatcaccacttactagtcttaaaggtatgcctcttcatgtgtttttcaagttatattcaagacacaaattcctttaagctaatagtaatcaaaccttaggaaagccatggttattccagatcatcttgtgcaatcatagtctttagataattgagctatactatattcctgtgaatatagtaacactcagaagaaaaaaagtttcctctgcattcaactattggttttatatacggtgagtgccattcagatttcagtattttgtgcaagtttggccttgggtgattttctgtgaaatatctgcagtaagaattcaagggacaataggagataccatggctaccccgaggaaatgaaagaggttttatttccgacactcagtatgaagctacccaaatgaaatgccaaacaaagctaatccactcaatctaatacagaatttacagtaaaacagagaaattctttaatattagcacttcagaaaaagtgcaggaaataaaattagccttgaggaaaggaacaaagccatgagataaaatcctattactgatgtgacaaacaggaacatcattccctgtggtatctagacatccgcatccgcaaggtaatacctcctggtaattccaggtggaaatgacttctgatccacttgaaggtggaagttgagttggaacttgttagtgcctaagaaggtaggtttcatattttgaaggtaaacatatttcattaatctttcttccataggaacagctaaagaattagtttagattttaatttttctattttgctgagtgaaaaagtatggcttttagtggcatgtgttaacttgaccactcttgaggaccagaagcttgtcacttgtgtatttttcttagaatgtagcatttgatacttttaattggaaatttggtggtgcttatatcttgttttacatatgtatgggttgctgaccagtccagattttttgtccatttttcaggaaagggaaaagataaaacagacttggataacttttgtttggaaattgtagaagtataatgaaaaattacctgtgaaggaagaaagtgatcccctcattttctgatctcatatttttcttattttccgtgtctttctcccttctagtgtctgagagatttcttcaatttcaaactcttttacttctgctacctatcattttaaattttgatttaaacctttccctgagggttttctatagtattctgttcttacttcatggatagagtatcttctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggtattgttcagactttgttgctgacctgttaacttttccaaacttgtctcgttttctccctccctgtttgtatcttggagttcacattcatatctagagcctttttttactcccaagagccatatgttcttgccaaatgcaatgtttagctccaaagtatgtaaagaataatgactgtctacagactccaatttattttctctagatttgcacctcaccatgatgccttccacagctcaaaagtcatttcctgcctgggctaagttagttgtaataggtgataatgcaatttcatttctccacatctctttcagaacaaagttcacagaaacctaaacaaattacaaggttggggtgatttgagcagtctacctcatgatagtcttctcttcaaattattagaccacttaggcttatctttggtattttgttccttattgattttaggagtcctatatttgctaaacttgaaatgcatggtaaaaaaatgtatctactgtccattttttttaggttgatacccaaagatcagtattactgtggtgttctctatttcactgggagtgatattttcaataagaatatgagggctcatgccctagaaaagggtttcacaatcaatgagtacaccatccgtcccttgggagtcactggtgagtgtccatgtgtgtattagagatcatctctcatctggagagaaggttattttcaaagatactttggtttagcaaaccttctaataactatgccagttagtgtagtttctttgtatttttagtccttcaggcaacgagagaggatttaatgcataacatgctcctaggccctcagttgaaggccatcaaggcaagcgttagttccagctttgttaaaatggattaaatccttgcatgctcagtaaaatatcttattcatctaaaagggtttttttttttttttttttttttttgctgttgtttaatgtacctctaggacccctgaaaaactcaagtatcattgttttcagtgccacatactttgcttttagtgccatggtatctttggccccatgcttttaaagtttaaagaataaggattgctgaatctatgcttaatgggttctgttaacatttcacagtatactatgtggtttactgttctctactaggagaatgaatttttgtcattttgtcctcaaagtataaaatactttgtcctcaaagtataaaatacctcatccctggtagactagggcagtgcttctcacaattcagtgtgcataccagcaacatgggggcctcactaaattcagattctaattcctttggcttgcagtggggctcaggattctgcatttctagtaagcttctagatcagaggttaccaatcttttagcttccctgggtcacattggaagaagaataattgtcttgggctacacataaaatacactaacactcacgatagctgatgagctttaaagaaaaaaatcataaaaacatctcatcgtgttttaagacagtttacgaatttgtgttgggccacattcaaagtggagctgggccgcatgcagctggcgggccatggttggataagcttgttctagataatgccagtgctgctagtccaagaaccgagttgcaaaggaactcactagagtatataatacatagtggctccagcagaaaggacaatcatgagtgaggatgacttgagtggccctagctgggatccccaggttccctttgtggcactgatgactcacgagatgaagctccagcacagcctcctgggagaggatagaggtagtcagtgtctttttttttgaaatggagtttcgctcttgttgcccaggctggagtgcaatggcacattctcggctcactgcaacctctgcctcccaggttcaagcgattctcctgcctcaacctcccgagtagctgggattacaggcatgagctaccacgcctggctaattttgtatttttagtagagatggggtttctccatgttggtcaggctggtctcaaactcctgacctcaggtgatctacctgcctcggcctcccaaattgctgggattacaggcgtgagctaccacatccgccggtctttttttttttagtgacttggttaccattttcttttttcttctgaaagcaagtcccacacagctcttaatcttgaaccctctataactaaactataaaactggttcttacaataagtttttctctctgtacttgcaggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacctcatgtactattattggatgatgatgatcttattttcttagcaagtatgtttagtttaaattttcatattgtgttcatgatcatactttactatgggttttgtagagagaaatatgagatgatagcagatctttaatgggaatttttattttctcatattctgctctatgctataaaccacattacccctacttactgatcaaaaattgttaattaaggtacacccagagactagcctctggaagactgttcaatattttctagaaactgggggggggcggggcacggtggttcatgtctgtaatcccagtactttgggaggctggggcaggtgggtcgcctgaggtcagcggttggagaccagcctggccaacatggtgaaaccctgtctctaccaaaaatacaaaaattagctgagggtggtggcatatgcctgtaatcccagctacttaggaggctgaggtgggaaaattgcttgaacccgggaggcggaggttgcagtgaggcaagatcacaccagtgtactctagtctgggcgacagagtgagactccatctcaaaaaaataaactagggaccttcataaatttagttttttgttgggcccatatttgattgtgtcagtccattcttgcattgctctaaaagaatactggagactgggtagtttatgaaggaaaaaggtttaattggctcatggttctgctgactgtataggaagcatggcactggcatctgctaagcttcttgggaggcctcaggaaggttttactcatgctgggagatgaagtgggagcaggcacttcacatggtgaaagcaggagcgagagagagagaggaggtgccacacttttaaacaaccagatcttgtgtcaactaacagaactcactcatcaccaaggggatggtgctgagccattcaggaggaatccgcccccatggtccagtcacctcccaccaggccccacctccaatactggaggtcacatttcaagcatgagatacggaggggataaacgtccaaaccatatcattgaatcttgtaatataaacttataacctgaatagaaaaacaggtgtatgatttatctcttaaatctgtagcacttgcttgaaatccactagaaagagctcccctaagcacaaccacttctatgcacaaaatacagcccttttaaacttcaaacaaacaaaaatttcacttttttgcccgagttctcctctgggcttttaagcacaagtggtcaaaatgtgtaagtaaaaacactccttgaaagccctgcctttcaaatattaaaattatataaatataaaatatacaaagttatcaaatggtaagtaaagctactgaaaacgtgaaaatgctttataacttgcaaaggactatacaaacataagatatcttgaaacttctttattaaccaaattattttgtagtgaaatgccatttcccttctaagaaatgaatggaaataaacaatagagttattaaggaaaaatatagtatttgctgtgataattttcctggtaagatgtaagaattaatttacttttaacttcagatgctatcattttttaccccctaggatactgtcaggcaccaacccttcaccagaaattgtttaaagatttatttggagagagagatgtggctcggttatagtatatgtatttcaaaactcacacagtacactttaaatatatacaatttcaattctttgttgttgttgttgttgttgttgttgttgttgttttgagaccgagtctcgtactgtcacccgggctggagtgcaatggtgcgatcttggctcattgcaacctccgcctcccgggttcaagcaattcttctgcctcagcctcccgagtagctgggattacagacatctgccaccatgcccagctaattttttgtattttttagtagagacagggttttacagtgttggccagtctggtctcaaactcttgacctcgtgatccacccacctctgcctcccaaagt

SEQ ID NO: 17419 - DNA, 13832 bp, Human
  misc_feature (1)...(13832): n = A,T,C or G
ctttgaagcaagcacctggaagaagtgagagaatgaggcacgtggatgtgggccagcagcattccaggcaaagggaaccacagcaaatgcaaaacccctgaggctggattgtgcccgtttcactcaaacagctagaaagagcgctagtatggtggcagtgagtcaggggaagaagaggaagagatgaggtcagagaagtgatgagcctgttctatgccaaggcgaggacttttatctttgtcaaatatttccactcccatcatggcccgggaaatctcactaatgtaaaccttactgaaaatcctaactgctgtgatcaaggctgccataaagggaagcccggaagaggcggggaggctgccttggaacagggtagtgtaaggatgtgccagaaggcctgctggaggttgcagccctttgagctggacttggggatagtgtggttttccaggcagaaggaagtgaaggattaggtcggcctggtagtacttggcacacaacatgcgcccaataaataaaatggaaataaaaccgcggagtgttctacttgtgttgactgacatcaaaacaaaacaaaaaaccctcagagtgaggggaggcacgggaggggctgtgccgggcaagagaggtggcaggaaaatccaacgcacggcgcctatgcaaatactcgtgtgaggcagaaaagaggctccgccccgctcgaagttccaagcatgcgcagtagcggctcctgcgcctctaaagatccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggcctatagcgaaggaggagctcagaacaaaaggtagaccccacccccgccgacggtgaaaacctatgaaacctgggcggaggcgtgcggagtcgggtagagagcgaaatcacgcctcttcagtcagccacgccctttattcttgctcggcctcgccacagagagcaaatcagattggctgggcgacaacctcaaagggcggggctgcacacgttcactacgggaatgaggtagcggtggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtgagtcccctcctttccacttcacccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccggtgagcgcgtccccgaggcgtggaggctgcccctcctccttcagaacccacctcgggcggtgcccaggggtctgggctgcggggctggcaggtgcccccacccccggcgaatttcccagaatgcaccggggcggggggtcatttggggcctccctgaccttggccccgccctgggcctgtcctgggagctggggttgggtagtgctgtgggtgctaatggggacctgggggagtcaaaggaccaaagggtgtggaaatgggtgacaatggggtgaaagacttgggggggttgctgatgggggtcggagcatgtggcagtaagcctcacgccaataagtcgtgtaaggttcaaggccccgtgtgtgcttgtggaaggagggcggggtgcggagcgggtgagggacccgagggtgtataacggggggtagggtgtcgaggaagttctaagacatgctcatagggattatgtccgcagagaggcccggtgtgtgttcatgggggacagggtggcacaggtaccagaacgtgtgttggtggggtcagggctctgaggcctggtgcgtggcgatgaggccctggatggtgttaatactgcgtgtctgtccgtggggcctgcagtgtgtgagaatgcagtgtgtgcttgtggagggcaggtagctgaaggactcgagtgtggtgtgtgcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactgtcagaggcttagtggacgaagggtaaaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtagggctgcggaggggatctagtgtgtaataagggggatcagggctttcatgaagggatctaagtgtgaaccaacaaggattatatctgtggagatatctctgagcagagagcaatagaggacaggaatgtgtgatgatctcggtgtgctaaagtggattacagctagggagggctgaagtgtgtgctaatgggagtcagggctgaatgagacctgtgtgcactaatgagggtcaggccatggtagaacagtgtgtttgtgtgtccctgcggaatagggctgagtaagggttcagggtgcactaatggggaggcaggactgtgtgaggcccggcgtgtgctaatagaaatcaggcctgagtgaagactcagtttgtgctgacagaggggacaggacagtggaaggactggaatgtgtgttaaggatggtcgtagctgtgaaggggcctgagtgtgggtaacactggttagagatctatctgtaaggttcactttatgttaatagcattcagagcagcatgaagaaggtccagtgagtgctaatgtgggtcagctatagagtaccccaagtgcatgttaatagaggtcagaatcatgtagggggaacagtacgttaatgaggggagtcagtactatggagaaggtaacaagcagctaggccagggaggggcccaagaatgtggtggcaagagttacttagaggaggctaagtgtgtgctgacagagttcagggcggtatgttatgtgttagggctttgaatgctgatgggtatatgagataatagcaggtaagatgtagtgaggcctccttgagggtctagcgtgtattaatggggatcaggacatagggtgcgatgaccaagtccttagtggttggtgtgttgagtatccttgagtatgagagtagtctgaggatgggtgtatgtctttggggatcaggaagggtcaggcaggacatgtgccttttttggggtaaggttttatgtccagtttcttgctccctccttttttgaaatctaaaaagctcattcaactgaaatgatatttaaaagtttccttgcgtataaatgttcaattatctctgttcacaggggcatgtctgagacccccatccccctttctgggagtgttatgtgatatacagattttacaccccatcttcctaaaatcccaaaaaactgaactccagagcatgtccagcccttggggtttccagttagaggtcgtggacccatggctcctcctggcttcctccccatcctccattcagccctacttccagtctcccccagcccctcccctactccctgtcacaacatgcaaagcaactgggtatctgtgccatatggggacacaaggttgtctttgggagctggccatgctttaccttccttgccttaggcccagtattcagcctcccaggtcaggatgttttgtggttatcctgggttctccatggatggacctcatcctgtatctgaggtctttctgctagggtggcccctacccctcctggggatagtgagttcagccaggtgggggcgagaactgctgggggaagcacctgatttcaaggtagcagatgacccatttctctcctcaaatccagccccagtctcatcctcgacctcctatctagctctacttcccttgggcccagggccatcttaggccctgctgtgagtccagatggttcctgggtcaggtctttccccctccttgctggcccagagcccaagaggaagcagaagacggctggcctaagccttttggtggccccattcccttcagcaatccatctaggtcatcttcctgtcgatgccagcatccctgggctaccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcggtgaggagatagacagtaaagactaaagaaaccaataagtaggtggtgtcatttctgaggaggtaatgagtgctggggggataactggcaaggtgagggagttcgggatggttgagattttaaatagggttattcacagaggcctcatgaaaaaggtgacctttgagcaatggcccaaagggagaggggagtgagccatttcgaaatttaggggaagggtgttccaggtaccaggaacagccagtgtaaaggccccgaggtgggactctactgggtgtggttgcagaacagcaactaggaatgatggcgggggggtgtgggggtgggggggggccgtgggcaagaggcaataggggcaaatgaggtaaagaaacacctgtgggccacattgaggactggggcgtgtatttggggtgatgaaaaatgtacattcttgagtagaggagaaatgtgacttggcttgtaaaagtctagattggaccctaggggtcctaacctgatcaaacctttctggcagccctgagaagagctggtgtacactgagacccccccgccctccacacaatcccacccagtggttgggtctgggcaggacaccctgacacacgctcccctccccccccccacctgggtagatgaatgggatgatgcagtggttgtcatgacgatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcaggtgggctacgtaggagcagggtcccagtggggctggctgtgtgggtgggcaggtactgacaaagatccccatccatgctgggtttccagaactcctgagtggctctggggtccatagtggttgagtgagcactgacaagttcatgtcagtgccccctgctaggctgtgggctttagggaacccatggtgatcaagcaaatgctaataagagacccatttccatccttgtcccttgctcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccaggtgggtccactggctatcccctctcccatatggccccaggctgcttcccaggtgttgcctcctggtcacattcctcattttcctctaaattttctgccctttctctgccccccatgtgctctcttctcccccttccctcccatcttctctcaacaccgtctgtctatctgtccatctgcgctcctcttcttgcctttctgcccaggccccgtggtgggggacagaaggtgccttgcctgtcacagctgccccaaggctccctctgcccttctgccctctatgatggcctcctcagtcctctggtacctgcctgccctgggcctgccttcccaggacccttggcttcccctgccaccacctagctgccggctctgagctcagcttgcccttggaaggaagggttccactaggtgacttttgcttccccaccccccagttcaacctgccctagatgtacctgagcttccctgggctcaggtacatcaccctctccccgagggactccaggtttcctgtgggggccacgtgcacacatgtgtgatgatggaatatgtttcgtgggggatggggtgtcctgtggttcctgaccccacctggcctgccctacccctctccctgccaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggtgcttgaccccgtctggatggtggaggaactggaaaagggggttggacctggggaggtggagctcatgatcctgtttctctcttgccttacctgctaggacatcaacaagcgcctatcactaccagctgacatccggctgcctgagggctacctggagaagctgaccctcaatagccccatctttgacaagcccctcagccgccgcctccgtcgtgtcagcctagtaagcaccttctgttcccgtcctctcctttttcttctctcccagacccttctcctgagccagctttaacctgcctcatttgtcccacagtctgagattggctttgggaaactggagacctacattaagctggacaaactgggcgaggtgagaggcaaataggaggcccatggtggggatgaaggtcagtgggaactcctggaatctcatagcacctctcctgtcacacttcctcacattccagggtacctatgccaccgtctacaaaggcaaaagcaagctcacagacaaccttgtggcactcaaggagatcagactggaacatgaagagggggcaccctgcaccgccatccgggaaggtacacacccccatcccatctgccccaggcttccccaacccacccctggcgcacacactccataatgagaacaaagactggttctaagaccccccaaaacactctggctttcatgggaatgcctgtcacccacatatccaggtaataatcagggtaaccaggaatctgttcccatttggataaaaggtagatgaattgcaaaccagggtttggttctgagaacacccctgaaagtgctcaccagtttatttactgtaacaatttctagtcagaatatcacatggaatgaatttgaattgcactgaaatttagtgtgcaaattcgatttcacgcgatgctgcaggcctatgtactgagggttggagccaggccccttcccagaaaccaaaaacaggttgtgaaaatctagtgtcacatgagcctggggctgcaatcccaggttcttgctccatactctcctctgagtcttattttccacatctgcaacatggagacacaactttcttctggcatgaggcgggttagagctggtggctccgaggcattaccctgaactgtctagagaaagaaagaaaacctgggcttgtccctttctagtccttgtcctcacctctgtcctgagggtaggaccctgactcttcccctgtcccactcccatgcttcctgcagtgtccctgctcaaggacctcaaacacgccaacatcgttacgctacatgacattatccacacggagaagtccctcacccttgtctttgagtacctggtaaggttgagtggcagtaggtcccagggggaggtgaggagaaggccaggagccataggaagtaaccctcattcctgtaccacctcttctttcctcaggacaaggacctgaagcagtacctggatgactgtgggaacatcatcaacatgcacaacgtgaaagtgggtgtggggcaggaagcaggggcacaagggggcccccactcacccactccaacccacaaatctcccagaaacggacttttccctttggctttttttgctaggagcccttggagggcactgggaccctgtcctcttttgtgtgacaaggctctgggcctagtgtctgtgtttgggaggggagcagtgcctgctgggggtcgggctagtggatagtctttgacctctgcctgccattcctgggtccccagctgttcctgttccagctgctccgtggcctggcctactgccaccggcagaaggtgctacaccgagacctcaagccccagaacctgctcatcaacgagaggggagagctcaagctggctgactttggtaccactggcctcccctttcttattggctccccagcctcctactttcccatgaccacttagtctcacttcccttcagccttgccagattttgcctaggacaccctcagtctcaactgcactctccccgagactttgcccatgactccctcattctagctgtcctttctctgatttccaggcctggcccgagccaagtcaatcccaacaaagacatactccaatgaggtggtgacactgtggtaccggccccctgacatcctgcttgggtccacggactactccactcagattgacatgtggtaaggacaggtggaagtgtggcaggggccatgtggtaaagggggtggcttggtcacaacagccacccagccagctgcctttctattcactgtgccctccctgcccaggggtgtgggctgcatcttctatgagatggccacaggccgtcccctctttccgggctccacggtggaggaacagctacacttcatcttccgtatcttaggtgaggaggcatgggccctaggcgctgtggagacacacggggaggacctgtgaaatgtttgggataactcctcttccctactaggaaccccaactgaggagacgtggccaggcatcctgtccaacgaggagttcaagacatacaactaccccaagtaccgagccgaggcccttttgagccacgcaccccggtgaggctggtgggtgggtgggcgttaggggccagagtgtccaaactcattttaaatcaggtctctttgtccttgtggcagacttgatagcgacggggccgacctcctcaccaagctgttgcaggtgagaccaccttgggtcagccttgggggtatgggattccaagtgtggggaaacagggaccccccccctcaaaccaggggcagggtctgaggtgggcagagagacctacttgttgaagatatcaatactatccccctccccgcacccccactcagtttgagggtcgaaatcggatctccgcagaggatgccatgaaacatccattcttcctcagtctgggggagcggatccacaaacttcctgacagtgagtggagctggggaatggaccggccagcgtggggactgggaaacaggactgctggggccagctggcgggttgtgtaggattctggctgtgccacctctacgtggggggacatcttgttcacgtgtgtgatgggttgtatttgttatgaaaacattttttagttttcagttccttttacctttcatgaaaaatttaaaacatacataaaaatatatgcaatagcactttactttttttaaagtagacatttccttacatgtgctaaaaaatgcacaaatcataagtatactatacaatgaattttcataaatgaaacacatccttgtaactagcacaaaagtcaagaaacagaatgttaaaagctccccacccccagctcccttgcatctccttcagttattcccagccccttcccaaagggtggccactgttttgacctctaacagcaaggataagttttttctgtccttgtactttatagaaatagaatcacatgtgatgttctttttatatctggcttttaaaaactttttaatatggatattttcaaatatatgtatttatatattagtcaaagtaatatgatgagtccctaagtactccagtgagtcatcaattcatggtcaatctggttttatctatattctctctgattattttgaatcacatccaatcccagacatcatagcatttatccttaaataatttcagcatatacctataaaagatttttttaaaacaacaatattattatcaaacctacaaaaaacatttgctcactttccctatcttcccactggattaatatataaagcaaaccccaaacaccacccatcacctagacttaacaggtggtaattgcaataccataattcacttgacaaagttaataatgatttctttgtgtcatgtaatagtctatatttcatcttccctggttgtagctggtttgtgtatggaattgtttgacagataaaggtcaagcctctcagagaaggggcagctttttctaattcttcccatggggtcatatggggctggtcctagatgacctcatgggtcatcccccacttctatgtctcccccatctgtagctacttccatatttgcactaaaggagattcagctacaaaaggaggccagccttcggtcttcgtcgatgcctgactcaggtaggtatagccccttgtcttcctccctgccccacccacctacctgcttacccaccaacagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaagcctgcttgcaaatccctgtaggggtggagggtggccgagctggggtgattattgggaccttggagaattcatacctcatcaccactgtctaggaaaacactgggagtgggccagggacacgtcacgactatgaaaaaggcatctaaggtattgcatatgtaacagtagaacatggagttgaagcaggtagggcaggctgaatggtgttgatgggttgagaagcagaaaggggagttagatttgcccaggaatatgaggaagcctgataagagggtggaggcagggaagtggagagacgatgtttgaaagacactggacggcccaatagaaccatggatgggaagatgaggcaaaggcccagtatggccatctgactaggaaaccatgaagaggagggaatgttcaggacggtagggggtagattttggaccactgagtaggtagagaaatcctttaatacatggatcaaattaagcagtggggccatagatggacctggaaatttcaattattagtgtccaggaagtaacagaaaccatgggcatgggtgagagagtttgcaagaggccagggatcaatgacacaacctggggtttgccctcagatatgaggataattgaaacttattttctttgtcctgtgagttccagccccagtcccaccatcttgggcaaagccaaggattgttttctaagcagaagagggggtgagcagggccaggcaaatactgcaagtaatggcaaccctaattaagtggctgtttactaaagcccagtggtgggggcccatgaacttctaatcactctactgtgtgtgtttgttttttgagacagagtctctgtcgcccaggctggaatgtggcggcacaatcttggctcactgcaacctttgcctcctgggt

SEQ ID NO: 17420 - DNA, 84571 bp, Human
  misc_feature (1)...(84571): n = A,T,C or G
tcttcagaactgtaaactggagggatgacccccaatttatagacaggaaaatgctcaaggaagctaagttacagctcagactgtctgatgccaaagcctaatctcttcccactactaataacgtgcattcagatttctaagtctttctcaccagcttttcacacaattaattaccatggttaatcacaggtattaagcctggagcttaaatgtttcttgttggaactcaatgcataagcaaagcaggaaaaacatccagaagctcaaacaagtgggtgtaattcatataccttccttacttacagatccttgggtaaacaagtgtgggtgtgttagtaactgtcagatttgctgggttagaaattatttagaaaaagggcacacaacctgactctctaggaaataattctagattcagctgccttaaaatttttgttttttaatagtttgtgagttgttcaggcgttattgctctttttcagaaaaaaagactagaaaataattctagatccagcggccttaaaaaattttttttaatagcttgtgaattgttcaggcatttttctcctttttttggtgtcccttctcttccttgctagcatggtttggacgagctcacttgttaaaaaggaataagctggaagagtcaagaggagaggaaactagggaagttgcgagcacctttgcaaaggtgtatatgtatatacatatatatatatgtgtgtaagggaactatatatatgtgtgtatatatatagtagttcttaccatgcctttcactgcctcccttcccctttactgcattatcaggtaaattaaaaagctgctttccccttggtacggcgaaaaccatcatttcaatgtatctacatccttccagtcgctccccctacccccttccctacttttatcggggccttctgtatggagactgcagaaaacccgccagtgttgcgaacacttggcgaagggcaaggagcctcgcccagagatttcacggggctcaggtgagaagcagtaagaagagcctgcaaacgagtgctcccggttccaggtttcctctccagtacggccctcgccttaagcagccaaagagtgactgcacagcgagtcagacaggctcatgggtttggagaccttttcatttccaaggaagaggagagacgtgggcggcccagacttgcccaacgcccacccccgcggccccgggcgcccaacctctcgcggtgctcgatccccgggagccagcgcagggcgcagcgcagaactcccacgggccctccaggcagacacgccctctgcccaccgggtgacgtcggccgcagactctggaagggagcctgagtcagaggaaacgtccttctcagagggactcgggattcttcccatagcatcctgagtttccccgtcccacacgcagcacgcggtaatttacactggtcggcctcgcgaatcgagtgggagtcccacctgccttattccactcaggttttccagcacagcccgaatcgcctaggcacccataaataagtgttgaacgcctggctggacggccgactgactgaatgaatgaatgagtgaacgactacgtttagagtcggtacagcccccctttccagtctccgcaagtgtccggggaccgcccacccggtctcttcgccacccagctgccaggtccctcggctcagggcagacacaaaccttctcggcagggctctccgggcggcagcctcacctgtgcccccatggccccgggagcgggcttccggaacgcgggcgcttgctcctcacctgggcctctccacacgcacccgcggcgggcggggctgcggggtctgggaatggggcgccctgaccccgcccccggggcagcctccgccaatgggcatggccaggcggggcctcagcgccagccgagccctgctgcccggggcttgttgcgaattctcagggcccccgcaggcctgggagcggcctgtgataactggtgtatctggcaggagtagcagctgccccttggcgcgactgctggagccgcgaactagagaaacacagacacgcctcatagagcaacggcgtctctcggagcgtggagcccgccaaggtaactccgggaattgagtggagtggaggctgcactgaggcccccttctggctcctctctggtcgaaaaggctcccccgctagagagagccctgctgcttttggaagccttcaggtgttagttgctttgcaccgaagctgctgactgctggggttctgcgccgattgccaggctcaagtttattttgggggctgctgagcagactttgcccttctgtgctgttatcagcttctgtcgctgtccgtccacgcccgctatatccatccactctccgttctgtctccagcaggcaactccccctaccctgccccattttctgggtcataggggtatttgaaataaacctttaagggaaaagcaatgccaaaactggaaagacttatttccacgaattattaataactaatgtttatgatatccttgttataccatacatatgcaggcacattatgtattaattaaatctcacagcagtctattaacgctcagtttacagatgagggattagaggcaaagagtgaggttaagtaaccaaaccaaggttggaagacctgatagcaggtatttacaaaacaaggagtgggcagggctggcgggtggctcacccctgtaatcacagcactttgggaggttgaggcgagtggctctcttgagtccacaagttcgagactagcctgggcatcatggtgaaaccctgtctctacaaaaattagccagatgtggtggtgtactcctgtagtctcagctactcaggaggctgaggtgggaggacggatgacttgagcccaggaggtggaggctacagtgagacatgatcgaaccactgcactctagtccaggcaacagagtgagaccctgtctcaagaaaaaaaaaggtgaggggtggggtagtgaacaattcgggctcaaaccctcaccagggagaactggggtgcctttgtgctctggcattttaacactgaggaaaatattctcatgtactcaggtagcctttgttctaagtaggcatgaacagtgctattaattttattacctaagagtttcatagcagaggcctcaatcttgtttttcttgttcttaggcggatgagagaagagctaagaacaaattagtcaacataccagtccaaggcacccacttttataatacatatggatgactttgcagagaaggaacaccacggagagtggaataggtgaaagttgaaagcgagggagatttatgccaattttccataacaagccttaaaacttagacttctttttgtttgtttgtttgtttgtttggcttggtttggttttttttgagacggagtctcgctctgtcgcccaggctggagtgcagtggcgcgatctcggctcactgcaagctccgcctcctgggttcacgccattctcctgcctcagcctcccgagtagctgggactacaggcgccccccaccacgcccggctaattttttgtatttttttttttagtagagatggggtttcaccgtgttaaccagcatgctctcaatctcctgacctcgtgatccgcctacctcggcctcccaaagggctgggattacaggcgtgagccacctagcccggcccaaaacttagacttctatttaaacgttttcttcggatttccaacttaaaattttgtctttatcaaaaattagtaatgatggtaaacgtgatctatggtgcttattttttatttaacaaacacttggatagcatttactatgtggcaagcactattctaatctctttgtaaatatttgctttataaatcttcatgaaaatcctgtaaggtagatactactacccccactttacagctgaggaaatggaggcacacaaagattgagtaactggcctatgcacacataaccagtaagtgtggaaccaagatgctaaccaagaaagctgggcttcaagtatgtgctcttaacccatttggtaattggacattaaaaaacaaaacagactttaaaaaatgtatctttattgaatttcagttgcatattaaggtctactttaggtaagaggcattttgttgtagttcttgcttccaattctgaaaataaagagaaaaaattcagaaaaaaaatatttaaactcatttaagaccactgcttttccagtttaaatgttgcctagcagaaatttataatatgtattttccttcattgataatttctagatgactttggggaataccgttatagtaccacacactgtctttaatgacataaagttgggggatatttattcccccgcaaaatcatgttgtttgtttaactaaaagaagagcattaaaaaaatctccaactagcccattctttgattctaggaaaattactcttctgactcaaaaattagaatgcgataataactgagaccctctaaaatgccaacttctgttttattggtctttgtgctaggacacttagacccaggggtgatggtcaaaataaataatgattagtagagccttagggcctcaagggacaaggccacaggtctttcgagcttggggaggtctgggagggttcctggtgtgtcaaggttaacccctgagttgctacattgtagggaggtctgtggtttctggggcaaggaataagatgactagacaagaggggtggtagctggggagtagaaaccacctttgcaaaaattatatcactgagaaaattttaacagtaagctgagtaattcatcctccatcttgcctttcccttaattattcctgggttattgagttgtgaaagaaaatcaatagtggagcccccaaatcactaagctaaagggaaaagtgaagcttggaactgcttagggccaacctgcctcccattctattcaaactcacacctctgctcactgacatatctgatcgcctcctttggagaggctagtcagaaactcaaaataatgcaaccatttgtctcttatctacctatgacctggaaagccccgtccctggttccagtattcctgcctttgctttgagttgtcccgtctttccagacagaaccaatgttcatcttgcatatgttgattgatgtctcatgtgtccctagaatgtataaaacccaactgtgctctgaccaccttgggcacatgtcatcaggacctcctgaggctgtgtcatggggttgtgttatcaaccttggcaaaataaactgtaaattcactgagacctgtctcaaatttttggggttcacattttggtaaccacagagggattctgagtggagatgcccctgacctttggcaaacctcttatcagtgcttggtaccagcatgagctaattttacagctcaaaccaataggacaatttgctgaggtctgagagcaccccctccagagaatccctgatttccccaaatttggtcaagatctaaagtttattttgctgtacaacttctcttttttggagttttacttgcttctatcaagaaagacaaatttcctgtttccatgacgttggagtttggctcacttccaacagggaaaaggagtgtttttttttttgttttgttttgtttttcctgcttcttgaatggtagagagcagtctatagccagagactcgtccctaggtaagtaactgaattggggtttgtcttggttaaagttaagattaacgaccaactggtcttaatttctccttaccattagagcactcagttatcatataaattgtgccattgtttgttttgcctaactgttttttgttgttgttgtctgttttttattgttgttttggtctttttcccattgggtttgatcaactctatccaacttgatcagggtttgatcaactctatccaacttgatcaaatccaaaggaaagttccaaattatggggaagaaggcctgagaagtggctaaattctaaaaaaaaaaaaaaaaaaaaaaagatggtgtggtggggaggaaaatggccagcaaaaggaaaaagaggaaggatttttgattttgactactaaaggggctttgtttacataacaccacgctttttgttaggccaaactgaaagcaatggctgtcctcccacactgctaaggtcccacccgatagctaaggttgtgcctttgttttttttcctaccaaaacagccctgggtttggttcctaaatcaagccctttctggtttgatacttggtacttctgaaatagcagcaatttgtcctagctgaaatatagtaaggactaaactgatttttttatcttgcccaaattcctatctaaggtgtctggggagtcatgccctacaaatcataaattctcatcagaagggttttatttaagccaatatatcatgagttattttccaacttgactctgacatagcattatgagacaaggaagaaaagcaaaattattttaccctaaaacatgtttctttgccatatcttgaagtggccctgcaaagctgttctttgtaggggagaatttgcatctttaaagaatctctgttaacatagctagatctttttcttccagatcctcccaatcctaaagcgattaactaagatctgaataggaaacattttcatctattgtctttaagggccgccactattaagacttcaaaagaactttggtctccacaatctttatcttaatccgaacattccctttctatgaatcccgtgtctttaggcaaactcaaccaattgtcaaccagaaaatgtttaaattcgcctacagcctggaagccccccacacccacctggttttaaattgtcccacctttctggaccaaaccaatatatttcttaaatgtatttaattgatgtcttgtgcctctctaaaacgtgtaaaaccaagcctcaccctgaccaccttgggcacacgttctcaggacctcctgagggctgtgtcatgcgccatgatcagtcatatttggctcagaataaagctcttcaaatattttagagttcaactcttttcactgacaatagtaatgagattttaaaagatttttttaaaaaaggaactcaatggttaaaagtcagcttaattaaaagctaacatccaagatgtgtgtgtgtgtgtgtatgtgtgcatgtgtgtgcatgtgtgcatgtgtgtatttaaaagaccttcatgttttgttttgttttttttctctcccaggaccttgtcttttttttttttagtaatttttttttcttcttagttgactgaattctgtgttcttcattaatatctattgcaactgagagacacgactagctggatttcctaggccgactaaggaatccccaagcctagctgggaaagtgaccgcttccacctttaaacatgggacttgcaacttagctcacacccgaccaatcagatagtaaggagagctcactaaaatgctaattaggcaaaaacaggaggtaaagaaatagccatctgctgcctgagagcacagcaggagggacaatgatcaggatataaacccaggcattcgagccagcaatggcaaccccctttgggtcccctccctttgtacgggagctctgttttcactgtgtttcactctattaaatcttgcaactgcactcttctggtccatgtttgttacagctcgagctgagctttcgcttgccgtccaccactgcccaccactgtcgtttgctgccatcgcagacctgctgctgacttccatccctctggatccggcaaggtgtgtgctgtgctcctgatccagcaaggtgcccattgccagtcccgattgggctaaaggcttgccattgttcctgcacggctaagtgcctgggttcatcctaatcgagctgaacactagtcactgggttctacggttctcttccatgacccacggcttctaatagagctataacactcaccacatggcctaagattccattccttggaataccgtgaggccaagaaccccaggtcagagaacacgaggcttgccaccatcttggaagcgacccaccaccatcttggaagtggctcgccaccatcttgggagctctgtgagcaaggacccctggtaacacaaccgaggcttctctggggtttttaaggaagagtatagtttaggcacttagaaatgtctttgtttttaaagtgcactgtaaaagcatcatgtggtctaaccttaaaataattctctttttgaagacccaggattcagtgtgggctctgcccagagcttagagatccagttaaaaaataaatagtccctatctaaataaaattggtctccttatacaatcctatgatagatttctataattttatgtttgatttggcatccatcatcaatctccctctagcagtaccagactttttctttatataccttatgatgtaaattttgctatttgattttcacctgtgttgtttcatttaatatctaaatttatggctatttagctgacaactgcctagtgttgtgaaacaggttatcaaatatctgaaagtctgagatagaaaaaaaaaggtctttatgaatctataagatgtacttctatcggcatgcctaatatgtctatgtatttgtgtgttgagtacataatgtttcactactgaaaatatataaaagagctctaattaattggcttaaagaaaaatagaagcacttaaatcaaataccttcttaaaaaaaagggaagactagtcgaatgctttttctttttctttttttgagatggagtttcgctcctgtcgcccaggctggagtgcaatggcatgatcttggctgaatacaacctctgtctcttgggtttaagcaattctcctgcctcagcctcccatgtagttggcattacaggcaagcaccaccacacatggctaatttttgtatttttagtagagatggggttttgccatgttggtcagggtggtcttgaattcctgacctcaggtgatctgcccaccttggcctcccaaagtgctgagactatagcatgagccactgtgcgtggctgtccaatgctttttcaagtttacatgatttaagtaaagtcctttttttttttttttttgagacagactctggctctgttgcccaggctggagtgcagtggcatgatatcagctcactgcaacctctgcttcccgggttcaagtgattctcctgcctcagcttcggagtagctgggattacaggtgcacagcaccaccctcagctaatttttcgtatttctggtagagatggggtttcaccatgttagccaggctggtctcgatctcctgacctcatgatccacccacctaggcctcccaaagtgctgggattacaggtgtgagccaccgtgcccagctgtaaaatctttactaaataagctagctttaaaattactgataaagtaatattagaaatgtcttaagcattgccagcatacatttttgtttgcatttattaatcaagcaatttcatacttatccctgccaaatactataaggtgtcaaaatttggcataggggttacaaacctataaacccagcccaagattgctttcataatctttaataaataagacattgctattggtttaatgaaaacagctatattttgaattatttagtaaaattaccataacttctgatattgtggcattaggcagtgtaatccacaggcagcaaggaagtttgtttgggggaaaggactattactgtctttgtttcaaagctaaaatataaattaaattccttctaaagtttgggaataagcaaggacagcttggaggttagaagcaagatggagtcagttaggtcctgtctttttcactgtctcagaattttgcaaaggtgagtttcataactttaattgatgactatcacagttttcataaataatgtaggtaaatgaataaaataaaatagatgtaatggataaatacttgtaggcaaacttgtcataatttagaatataaagttatactaaaatatttcattatttaggtattttccaataaaaatatattgtaggaaaacattctttctagaaaaaagtgtccttttaaaaaaggtggacaatttttttctaattcaaagcttaaaggttgtgtacaaaacaaggtaagaggagccaggaaataagagagatgtaaagaaacttatagaaataaagaggtatattttggtaagaaagcttaaagagaaataattttatatgagaaagaatattacatggtaaatttagacctagaataaaatgactggttgtttaagaaagggatgttcaggacaaaccagaaagtccaagcatgtcatgaatggtctgggtaagtcacaatgaaagaatttatttaaaaaaaaccccaaaacttatatgatcaagttgtctgtagttaaagggaaattacaatggtctttccagagacttggtttgatgtaaaaaaacccaaaaacatttatatagtaaagaattgattagaacaataaaagttccttagggtattgatttactcttaataaattataagagattttatttatatcttaacccaaagttaaacttctattgcatcttgctgtttttggttttctctccccttttaaaaggagtgaaataataatggtttccttcaactcatataagtttttgtttcctcaacttctgtttgttgtggcctgatgctaacaatattcttaaagatctgaaggaaatgttttcttccaacataatgttctgtacactgcagaagggtttttcttttgccttttggtaactggcctaacagattttaggttttataaaaataattcctatgccattattattaagttttgatttgcttaggaaaaaaactgagattaaattttttttttaagttaaggttattacatccatgtatctttctgtatgtgattttaaagtacttgtgacattaagttacagggctttgactcctgggtctaaaaaggacaccaagtcctgctaagtcttaaaacaccgacagcaattaaaacctcatcttcaggccctcttgattggcatcagaatatgccaatcaaaataaactgcattcctgagacacaaggtcagaagttaaagccattcaacgcctcaaattccagggactattgtggaagcggtgggcatgtgggattgtaagggctgattttaagagataaaataagttcaatttctctataaattaaccagtaatgtcaaagacactcttattcaagaccagcatatggacccctgtgtcagattaacaagattttcttgaagcattaaccaactccttaataaaggttataaaggttataaaaggcttatggaagttaaattttatgaccaatattaagattttatagattatttataaaattttgaaaaacaaatttatttggcttcatgctgtttttattagagctaattgtttagaaaattaagtgtcctctcttaaagaattaaggttttcactttttttttttcaaacccttgagttatcactctggttaaatgaatgacttattttacaataacctgtaatcctattttgtgatatcaagtgtaaacctttgatatttgacaaactttccaaaatcaaaattataaattatgtcttttttttggctgggcacatacctgtaattcaagcattttgggaggccaaggagggaggatcgtttgaggtcaagagtttgagaccagcctggccaacatggtgaaactctgtctctaccaaaaaatacaaaaattagctgggcatggtggcacacacctgtaatcacaactactggggaggctgaggcaggagaatcacttgaacccaggagatggaggttgcagtgagctgagatcatgccactgcactccagcctgggtgacagagcgagactctgtctcaaaaaaaaattatgtctttttttgaactaattaatcctttaagatattattaataggttccctaatgtcaaaaaatgacatatttggttatttggtataaaaattatacaggaaacaccatcaaataagaaatggtgtttggttttctttgggctgtatttgtataaaaatgttattggtatgtattctaaaattatgggaaacttctataattctgatacgacttagtgtacattatcagtaataattataattgttatgttaaattattgtgtgcaacagaggtaacaaatttcctcatcaattgtgtctttgactatggctgccctaaaactttttgtcatccacggacaattattgtctttttttggttctctttagaaggtagttttataaaactctaacaggtgctcttgaacacaggtttctgataacattggagattgtgacatcagaatagatgaaaaactttcaggactcatggagagataaaatattcatgaatatcaagcagaataggaattaacttcatggattaaactaatagaagtctgaagtaatctgtttaactttttgcctaaaatggtgctgattcttttgtttttcaaagtcaagaaaatgtttaagctatttacagattctaacaattgagtaagtatactcctatgaataaaatttggagcatatttctttctctgtacctgatttctacagaatttggaaactatttgtgagtattcttaacttacgacaatacagttatttgcataaatgcaataagaatctgttttcatttgtaacaggacacaattggagaaactagttactttaccgaggctctttactgggatggtgtgctttgctttaaggaatcaaacttggcttatggaatcaatacaagccccttgggaaaactggcctcatacttttgtctatacagtccctgtacagggttcctgacctgtggtaagtaaagaatgtcactttctgacaggtccaggagccccaggtttatcttggaacctcaacaggaaaggaatttacccaactcataggtatttgatggtacaaatccatggctgggtttgactttaaaaaagtcttatgtgagatttcttctatggaataaagtaccatcaaagccaatttaaaagcctatgtaaaaaaattatttttgttgcactgtaaacaaataatcaggccaagtataataaagcaagtcagggccgggcgtggtggctcacacctgtaatcccagcactttggaagtccaaggtggatggatcatgagttcaggagttcgagaccagcctggccaagatggagaaaccccatctctactaaaaatacaaaaattagccaggcgtggtggcacatgcctgtaatcccagctactcaggaggccgaggcaggataattgcttgaacctcggaggcggaggttgcagtgagctgagatcacacctctgcactccatcctggcaacaagagcaagactccatctcaaataaataaataaataaataaataaataaataataaaaaagcaaatcagtccaaccacgatttgtctttagtaaaaatgggaaactggagaggaaaaattatgtttcaaaaactatagtacacctgttcttagattccagtcttgcctaatgtttttcaacttttattattttctacagtttggactgagttctaatttttcttggctacaagccttcaaaatattgctttcagtttcttttccttctttacccccacccccactcccccatttatcctaatttggagtcactgaaaactaagctgtgcattcataaagccctgtgaacagaagctagacaacttaaacttcagaagaaaataacaacaacctatttacatacataagccacttactgcctgtctattgatatgtggacttcagagtagtgtggcctatatgcattttccaggattgttcctttgtttgttcttgtttttctcccttcctcctcctattttctctttataggacatgagactttacagcctgctaaaagtgagccttcctaaataacttgggacctacccatctaggaataaaccatcctagccatgagagatcggacaaaacctcagactagagacgcattttcttctaaaatgctttctccaaaggattttttaaaagaaaagtgtagggtccagccccacagggtcggtgggttttctcctcgtgtgcagagatgagagagtgtagaaataaaggcacaagacaaagagattaaaaaaagacagctgggcctgggggaccactaccacaaagacgcggagaccggtagtggccctgaatgccaggctgcgctgatatttattggatacaagacaaaggggcagggtaaggagtgtgagccatctccaatgataggtaaggccacatgggtcacgtgtccactggacagggggccctttcctgcctggcagctgaggcagagagagagaggagaaagagagaaacagcttacattattatttctgcttctcagagacttagtactttcactaatttgctactgctaactaaacggcagagccaggtgtacaagatggaacatgaaggcggactagaagcatgaccactgaagcacagcatcacagagagatggttaggcctctggataactgcgggcgggcctgactaatgtcaggccttccacaagaggtggaggatagagtcttttctaaactcccctggggaaagggagactccctttcctggtctgctaagtagcaggtgtttttccttgacactaatgctaccactagaccacggtccacttggcaaagggcatcttcccagatgctggcattactgctagaccaaggagccctctggtggccctgtctgggcataacagaaggctcacactcttgtcttctggtcacttctcccaatgtctcctcagctcctatctctgtatggcctggtttttcctaggttatgattatagagcgagggttgttataatattggaataaagagtaattgctacaaactaatgattaataatattcatatataatcatatctaagatctatatctggtataactattcttattttatattttattatactggaacagctcgtgtccttggtctcttgcctcggcacctgggtgacttgctgcccacagaaaaggggggaaaatgtgaaaggaaaatatatcttggggctcctaagtcactaagctaaagaaaaaagttaagttggtaactgcttagggccaaactgcctcccattctattcaaagtcagccctctgctcactgggataaatgcatatctgattgcctcctttggagaggttaatcagaaactcaaaataatgcaactatttgtctcttatctacctatgacctgaaagccccctccctgcttccaatcttcctgcttttgctttgagttatcctgcctttccagacagaaccagtgttcaccttacatatgttgattgatgtctcatgtgtccctagaatgtataaaacccagtgatgctctgaccaccttgggcacatgtcgtcaggacctcctgaggctgtgtcatggggttgtgttctcaaccttggcaaaataaattttgtaaattaactgagacatgtctcagattttcagggttcacaggaccaagctaactttgaaagatatttaggctatggtttaaatgataataagtcttatcctaaaactcattcacttttataaagctaatgggaggccatcaggctgtggggaggaggggagcctgagtcctgctaaggtgcagacataaaccattgccagccattattccggaggttataagatatgagcttccccaattactcctgcaaataacatcaatattgtagaacctaacactggccttttgagatatcttttcagggttttttgtttttttttttttttttttttgcatgtctgacacccacggctccacctggaccagccaacccagctcctatggtcccacccagaagcaattcagcccacagaagggcagctttgacgccttactatttcatctccaccccagtcaatcaacagcaagcacctattacctggccaccccctcccttcccccaaactgcctttgaaaaacccctgacctaagacctttggaggagatcatttgagtacaaactccatttcccatgtggcatgactagtcttgtatctattaaactttctctactacagtgttgtggtctgtctttacagagtggggcttgaggctttttgcaaaaatgttgctgtccagcctagtactgtacctagcttatacttggtaatctttttctcaatcagtctagttaggaggttttcaattttatgaatctttataagaactagctcttacctttattgattttccttacctatttttaaattttaattgatatctactcttatttttattacctccttccttctacttggagtttaatttgctatcctttttccagtttctaaggtgaaagtttagactttgattttaaacctttattctctttcactacaaatgtttaaagctaacatttgcctccaaatactgctttagctccatcccacaaattttgatatattgtgtttattaataatgtttattatcatttagttcaaaatattttaaagttttctttgcaatttcttctttgacccatgggttatgaaggaatgtgttccttgatttccagataactgcagcttttccagatatccttctgttattggttatcagtttaatcctcttttggacacagagcatattctgaacaataatagttctttgaaatgtgttgagatttggtttatggcccagcatatgatctgtcttggtggatgttccaagttaaatagaaaagaatgtgtattctgcagttgctgggtgtagtgttttagaaatgtcaattgggttaagttgcttgctctaaatgtagtttattgccaatttttaaatttgtttaacttggtcattagatacaaacacaagtaggattattatgtctccttaattaatagacaattttatcattattaaatgtccctgtttattctggtaatactttctgatttggaatttactttgtctgatattaatatagctaaatcagctgtgttattagcatttttttaaacagagtcttgctctgtcacccaggctggagtgcagtggtgcaattttggctcactgcaacctccacctcccagattcaagtgattctcttacctcagcctcccaaatagctgggattacaggtgcatgccaccacacctggctaatttttgtatgtttagtagagatggggtttcaacatgttggtgaacaggctggtctcgaactcctgacctcaagagatccacctgctttggcctttcaaagtgctgggattacaggcctgagccaccgtgcccagcctattaacatttattattatgacatgccttttttttccctttacatctaacctatctgtgtctttttatttaaagcttatttctcataaatgacatttagttgcattttacttttgtaaccaatctgaaaatctttgcttttaattagccttttagtctgagtacatattttataaaaattgatgtggttagattcaaggctaaagattggtacctttgatatttcctataatgtagatttgctggcaataagttctcccagtttttgtttgtttgaaaaagatgtattttgcctttattttcaaaagctattttccctaggtacaaaagtataaattaacagtatttctttactttcagcacattaaaaatactactttgttatattctaagcttacattgtttctcatttacaagtctgtgattatccttcccaccccccccttcccccactgtatgtaatgtgcctactttctccctctggctgtttaatttttttaaaaaatcacttattattgctgggcacggtggctcacacctgtgttcacagcactttgggaggctgaggtgggcagatcacctgaggtcgggagttcaagaccagcctaaccaatctggagaagccccgtatctactaaaaatacaaaattaactggggtggtggcacatgcctgtaatcccacctacttgggaggctgaggcatgagaatcgcttgaaactgggaggcggaggttgcggtgagccgagatcatgccattgcactccagcctgggcaacaagagcgaaactctgtctcaaaaaaaaaaaacacttattgttagtaattgggcttttatttgctttgaagtgattttatttgtttttattctgcttggggttcattgaaattcttgaatatgtaattttatacttttcatcaaatttggaaaattattggacattatttcttcaaatatttgtttttacctccttgcttctagggtaccaattacacatgttgatctaattaatatggttccatgagttactaagattccaatgttttatctctttttgctttattttggcagcttcaattgctatgtcttcacattcactgattttatcatctacattttctattctactgaacagacatctaataaatttttaatttcagatattttaatttctagaagttctgttattttttcctgtgttttaaatttgtttgttgattatataaatgatttattttgaattcttgagcatatttataatacatattttaatgtccttgtttgctaatccattattattattattagttttgaaatgaaatctctctctgtcaccaggctggagagtgcaggagcatgatcttggctcactacaacctctgcctcctgggttcaagtgattctcctacctcagcctcctgggtagccgggactacaggcgagtgccaccacacctggctaatttttgaagttttagtagagacgggatttcaccattttggccaggctggtttcaaactcctgacctcaggtgatccacctgcctcggcctcccaaagtgctgtgattacaggtgtgagctactgttcccagacatatgccatgatttctgtcacttctgggtatgcagctattgactgatttttttcctgattatgggtcacattttcctgcttctttatgtgtctagtaatttctgattgaatgccagacattattagtccatattgtgaagtgtttggattttattgcctccttaaaagaggggaaggaatttgaattatttgcaaattagtttgatcctttatgagcttcttttaagacttatatggcagattgaaagtatcatagctctcttttttctgcagggaatatgttccaagacccccagggggtgcctgaaaccatggacagtaccaaattttatatacactatgtatttttgcctatgataaaattcaatttataaattaggcatggaaagagattaacacctgataataaaattgaacaattataacaatatactttaagaaaagttatgtgaatgtggtctctctctctttctctcaaaatatcttatactatattcaccttttttgtgatgatatgagatgatacaatgcctatgtgatgagacgaaggaggtgaatgacttggcattgtgaaatagcatcaggctactattgaccttctgataatatgtcaaacttatgaattgtttatttttggaattttgcattaaatattttaagaccatgctcaaccacaagtaaataaagttgttgaaagtaaaaccacaaataagggggtactgtatcctttaacctagagttaggttagccctgctattgaagtgtggcttttcatgtaagcatttaaattttttatttatttatttatttttgagatagagtctcgctctgttgcccaactggagtgcagcagtgtgatctctgctcactgcaacttccacctctgaggttcaagcgattctcttgcctcagcctcctgagtagctgggactgcaggcatgtgccaccttgcccagctaatttttttgtatttttagtagagacgggttttcaccatgttggtcaggctggtctcgaactcttgacctcaaatgatctgcccatctcagcctaccaaagtgctgggattaaaggcatgagccactgtgccaagtccatgtaagcattattaatgcctgaggtcttcactgaatctctccagtctacaggtagtaacttgaatatctccaaggtctgtgtgagttttgggattatttaactgttaataccttggaagttattctttgtccagtctgtggaattttcatttatgcatgtccagattagcattccacaaagactggaaaagacctctctgcagatttctggttctttctctacattgcttcctcttctctagtactttgctctgaaaattctggctacttcaatctccaaggtcatatttctgactccttagctaaacaagactgctgggctgtgcttggtttatttttctcatgtcacagattaaaaatggtctttggacagggttcaactcatttttcccccatttctctaatgccatacttctgttgttgttttgtgcattttgtccagtttgaagtcaagctactttttcatgagcaaaaacttagactacagtatacagatgttcctttacttatgatggttcatcttatgatttttctactttatggtgggtgtattggggtattaaatgccttttcaacttatgattatttcaatttatgataggtttattgggacataatcacattttaagtcaagaagcatctattgttgatttgtgggagcccactgcaatgtttgaatataatatttaaaattcatgatttatttgtgaagctgtctcattttataaattgtgttgagacaatgcaaagtttgtacaagtaggaattgataaaaattactgcaatctataatgactcaaagcgttgtgaaacagcactaccaccaaataatgtaaaatcttgattatcacaatatatttagtatttttctgagaaggcagaaaagtaaattatatataatacataataacttacatttatgtatatctctattttattactaatatgagtacccctgacccatcaacagacctaaccagacatgtacaataataattaaatccagttgtctttgacattttgctaggttttaatcatattaaaatcattgctttatagatttttaatattttggttatgaaggtttgtttttcaaggtgaggacaaaaactcattttaacagctcattagtttgattttaaatatttagtaatgtagtacatagatatccatttgttttcttgccccagttctgttaatgttaggggtaggcctgtggaagaagtggcagcagcaacaaaagttaggaggcttatatcacatagataatttgtcatgtctgagaaagctaaattgaaagccagttttggggaagggtaataagcaacaatatttccactatggactctgcaaaagtcttcaggtatatttaaggcacaacattatataggttagcgtgatttcatatttacctaagtttttgttttttttcagacagaatctcactctgttgcccaggctggagtcaagtggcacaatcttggctcactgcaacctccacctcctgggttcaagtgattctcctgcctcagcctcctgagtagctgggggactacagatgtgtgccaagcccagctaattttttaaattttcgtagggatgcaggtttcaccatgttggccaggctgatctcaaactcctgacctcaggtgatccactcacctcggcctcccaaagtgctaggattacaggcatgagtctctgtgcccagcccctaaaagacttaaaatcttaaaattttcaggtacaaccatactctcttccccaataattttttttccttactctggatttctttgagccctttgtatttgattatgttatttaaccagaaacttaatacaattacaatgaattatttaataataagctccaggaactatctcacaggaaaataataataatcttaatatttactgtaattaaggactcaatttgtgccaggcctggtgtgaagagttttatgtcaatcatttctatttaccataccttgattagaagaatctattcccattatgctaataaaaaatggcaacaacaaggttcagggcagttaaataattttcccaaggctacagtgctgtcagaaattagcaaaccaggatgcaaatctaaattagcaaaccaggatgcaaaatctaaaccaggatgcaaatctcaagtccactaaatttccaatattccaaggagctatcaacatcagttgcaagtctctgaggccaccccaatcatgctgagggctggaggacttactccctaagaggagggatcatggtggatgggaggcaggactagattgcagctctgactcagatagacagagcagtgtgtggaggctcgtgtcatgaatttttgcaccagaatgactgtaggaataaatcaggaaacctgggagtacccagagacctctctgaaggaagtggattgctccttcaggacccaggaaacactccaaatactgtactggtatccccagatgagagacccacagatggtttatgtaacaggactctgtgcagacaacccctagtaccagcccagagcctggtagacttgctgggtggctagatccagaagagagataataatcactacagcttggctctcaggaagctacatccataggaaaagggtgagagtactacatcaagggaacaccctgtggggcaaaagaatctgaacaacagccttcagccctagacctttcctttgatagagccaacccaaatgagaaggaaccagaaaaccaactctggtaatataaaaaaacaatgttctttaacaccccccaaaaatcacactagctcaccagcaatggatccaagctgagaagaacccctgatttacctgaaaatgaattcagggggttagttattaagctaatcagggagacaccacagaaagatgaagcccaatttaaggaaataaaaaaaaaatgatacaagaagtgaagggagaaataatgaaatagcaagaataaaaagcaatcaaaacttcaggaaacaatggacacacttagagcaatgcaaaatgctctggaaaatctcagcaacataatcaaacaagtagaagaaagaaatttagagcttgaagacagggtctttgcattaatccaatccaacaaagacaaaaaagaataagaaaatatgaacaaagcctccaacaagtctggcattatgttaaccaaccaaatctaagaattctaaaagtttggaaaacatatttgggagaagaatctaggaaaatttccatggccttgctagagacctagacatccaaatacaagaagcacaaagaacacctaggaaattcatcacaaaaagatcatcacctaggcacattgtcatcaggttatctaaaattaagacaaaggaaagaatcttaagagctgtgagacaaaagcaccaggtagcctataaaggaaagcctatcagattaatagcagatttctcagcagaaactgtacaagctagaagggattctatctatcttcagcctcctcaaacaaaacaattatcagccaacaattgtgtatccagtgaagccaagcttcatatatgaaggaaagatacagtctttttcagataaacaaaagctgaaagaattcaccactaccaagtcaccactacaagaactgctaaaaagagctctaaatattgaaacaaatcctgggaacacatcaaacagaacctctttaaagcatatatctcacagaacctataaaacaaaaatacaatttaaaaaacaaaaaaccaaagtatatgggcaacaagtagtacaatgaatggaatggcacctcacatctcaatactaacattgaatgtaaatggccaaaatgctccacttaaaagataaagaattacagaatggataagaattcaccaaccaactgtctgttgccttcaggagactcacctaacacataaggactcacataaacttaagataaaggggtggaaaaagacgtttcatgcaaaatgacaccaaaagcaggcaggattcttacatcagataaaacaaactttaaagcaacagcagttaaaaagacaaagaggaacattatataatgataaaaggccttgtccaacaggaaactatcacaatcctaaacatatatgcgcctaacactggagctcccaaatttataaagcaattactaatagacttaagaaatgagatagacagcaacaccatagtagtgggagacttcagtactccactgacagcactagacaggtcatcaagacagaaagtcaacaaagaaacaatggatttaaactataccctggcacaaatggacttaacagatatatacagaacattccttccaacaactgcagaatatacattctatttgacagtgcatggaactttctccaagatagacaatatgataggccacaaaatgagcctcaataaatttaagaaaattgaaattatatcaggcactctcagaccacagtgaaacaaaaccggaaatcaactccaaaagaaaccttcaaaaccatgcaaatcatggaaattaaataacctgctcctgaatgatcactgggtcaaaagtgaaatcaagatggaaatttgaaaattctttgaactgaatgacaatagtgacacaatctatcaaaacatctgggatacagcaaaggtggtgctaacaggaaattcaaagccccaaacacatcagaaagtctgaaagagcacaaacagacaatctaaggtcacacctcaaggaactagagaaacaagaaaaaaaccaaacccaaaaccagcagaagtaaggaaataagcaagatcagagcataaataaatgaaattgaacccccaatacaaaagataaatgaaacaaaaaactgattctttgaaaaaataaataaaattgatagaccatgagcaagattaaccaagaaaagaagagagaaaatccaaaaaagctcaataagaaatgaaatgagagatattacaactgacatcacagaaatacaaaagattattcgaggctactatgaacgcctttacacacataaaccaggatacctagaagagatggataaattcctggaaagacagaaccctgctagcttaaatcaggaagaattagataacctgaacagaccaataacaagcagtgagattgaaatggtaacttaaaaattaccaacaacaaaaaagtccagaaccagacagattcacagaagattcctaccaaacattcaaagaattggtaccaattctactgacactattccacaagatagagaatgagggaaccctccctaaatcattctatgtagccagcatcaacctaataccaaaaccaggaaaggatataaccaaaaaagaaaactacagaccaatatccctgatgaacgtagatgctaaaattaacaaaatactagctaaccgaatccaacaacatatgaaaaagataatccaccctgatcaagttggtttcataccagggatgtagggatggtttaacatatgcaagtcaataaatgtgatacaccacataaagagaattaagaacaaaaatcacatgatcatcttaatagatgcagaaaaagcattcaacaaaatccaacatccttttatgattaaaactctcagcaaaatcagcatacaagggaaatacctcaatgtaataaaagccatctatgacaaacccacagccaacataatactgaatggggaaaagttgaaagtattccctctgagaactggaacaagacaaggatgcccactctcaccactcctcttcaacatagcactggaactcctagccagagcaatcagactaaataaataaataaataaataaataataaatggcatccaaatcagtaaagatgaagtcaaactgtcactgtttgctgatggtatgattgtttacctagaaaatcctaaagactcctccagaaaactcatagaactgataaaagaattcagcaaaattgccggatacaaaattaatgtacacaaatcagtagctctgctatgcaccaacagcaaccaagctgagaatcaaatcaagaactcaaccttttttttacaatagctgcaaaaaaaccaaaatacttaggaatatacctaaccaaagagttgaaagaactctacaaggaaaactacaaaacactgttgaaagaaatcatagatgacacaaacaaatggaaacacatcccatgctcatggatgggtagaatcaatattgtgaaaatgaccacactatcaaaagcaagctacaaatttaatgcaattcccatcaaaataccaccatcattcttcatagaactataaaaaaattctaaaattcatatggaaccaaaaaagagcccttatagccaaagcaagactaagcaaaaagagcaagtctagaggcatcacattacctgatttcaaactatactataaggccatagtcaccaaaacagcatgatactggcataaaaataggcacatagaccaatggaacagaatagaaaacccagaaataagcctaaatacttgcagccaactgatcttcaacaaagcaaacaaaaacataaagtggggaaagggcatccttttcaacaaatggtgcttggataattggctagccacatgtaggagaataaaagttcatcctcatctcccaccttatataaaaatcaactcaagatggattaaagacttaaacctaagacctgaaactatacaaattctagaagataacattgaaaaaacccttctagacattggcttaggcagagttttcatgaccaagaacttaaaagcaaatgcaataaaaacaaagataaatagttgggacttaattaaactaaagtgcttttacctggcaaaaggaacagtcagcagagtaaacagacaacccacagagtgggaggaaatcttcacaatctatacatctgacaaaggactaatatccagaatctacaatgaagtcaaacaaatcagcaagaaaaaaacaaacaattccatcaaaaagtgggctaagaacatgaatagacaattctcaaaagaagatatacaaatggcaaacaaacatatgaaaaaatgctcaacatcacgaatgatcagggaaatgcaaatcaaaaccacaatgcgaaatgcaataccatcttactcctgcaagaatggccataatcaaaatatcagaaaatagtagatgtttgcatggatgcggtgaagagggaacatttctacactgctggtgggaatgtaaattagtgcaatcactatggaagacagtgtggagattccttaaagaaataaaagtagaactgccatttgatccagcaatcccagtactcggtatctacccaggggaaaagaagttgttatacaaaaaggatacttgcacactcatgcttatagcagcacaatttgcaattgcaaaaaacatagaatcaatccaaatgcccattaatcaatgagtggataaagagatcatggtgtatatacatgtatatatatataatggaatactactcaaccataaaaaggaatgaattaatgacattcatggctacctagatgagattagtgactattattctaagtgaagtaactcaggaatgggaaaccaaatattgtatattctcactcgtaagtgggagctaagctatgaggatgcaaaagcataagaaagttttgggggaaccagcccccatatttcaacgtaggttctttctattttccctaagtgttggctggtctgagaaataaagaaaaagagtacaaagagagaaattttacagctgggcctccgggagtgccatcacatattggtaggaccgtgatggtgacgccgagccgcaaaatcagcaagtttttattagggattttagaaagggagggggtgtacaaacagggagtaggtcacaaggattacatgcttcaacgggcaataaagatcacaaggcaaggcaaaattagaaatactgatggaggtctatgtcccactgtgcatgcattgtcttgataaacatcttaacaggaaacagggttcgaaagcagagaactggtctgactagaatttaccaggctggaattttccaatcccagtaagcctgagggtactgcaggagaccagggcgtatttcagcccttatctcaaccgcataagacagacactcccagagtggccatctatagacctccccccaagaatgcattccttccccaggtttattccttgctgagaaaagaattcagcgatatttctcctactcgctttctgcagaaagaaaaatatggctgtattctgcctgaccccacaggcagtcagacctttatcctccctcgttccctgaaaatcactgttattctgttctttttcagggtgcactgatttcatattgttcaaacacccatgttttacaatcagtttcatattgttcaaacacatatgttttacacacaatttgtaccgttaatgcaatcatcacagggtcctgaggcaacacacatcctcagcttatgaagatgatgggattaagagattaaagtaagacaggcataagaaattataaaagtattaattctgggaactaataaatgtccatgaaatcttcacaatttatgttcttctgctgcagcttcagctggtccctccgttcggggttcttgacttcccgcaataagaatgacacaatggacttggggaatcagggggaaagggtgggaagggggtgagggagcaaagactacaaatagggttcagtgtatactgcttgggcaatgggtgcaatgaaatctcacaaatcaccacaaaagaacttactcatgtaaccaaacaccaccagcttccccaataacctacggaaacaaaaaaaatttttttttaaatcaggtgctaaattttgattatttaacttttcttagatctttaagactgaccaaaattttatcagttttcaaggtcatttaaactcagacacaataataaataatttacttattttataatggttagtaatttatgggggggcttgaaatttcagttaccgtagaatgatggtaccctggtaagtgtacaactcccagaggtagaattgtgtgtgatcaaaattttattttatttacttgttcagtgattaagggattctggacagatttcatataaaattaactttcaagggtctggttttacagattggatgctcatgttctgtaactaatgagtttccctgtaaacaaatctacctgagaagttaaattataaccaaagatagtttgctcattagcaggaatctaaccatagatggagcacctcgtttttggcagtttacacattagattgatcatttaattaagaaatcatgaaggacgtaacttgacctaagtaacacagctaagcaagtagaaaatttgaaattttaaccaaagtttgtctaatgtcccaaggtgatactcttgactaggcaaattgcttttcacagtaggggatctaatgaacactcccttgcccagtgtctagcatgttatatccttttttttttttaaactaagaacaatagcattttcttaatcctgtacattctatttaaagttgacccttgaacaacttgggcttgaactacatgggtccgcttatatgtggatttttttcaaccaaaccgatcaccacgtatacctagggatgactgtactgtggactcaaattgaggtcttttaatgaggaagagttaataggtactaaataaatgtacactgaatgaatgaatatattgactcacattagctattttgaggaggcaatttgatgaattgtctcagaaaagaacacacttgtatatatttactaaattatgatattatactaaattacaatattatactaaatataatatcattgagtcctggacccccagactttgccagtgaaatctgtatgagaacttttgcactcaaagagctgtggaaggcagtgttgtttatttcattattattattttttcctcaacccatttaaggtggagtttatctcattattaatgttgctactctgagagctgtatagcctccatttcctcttgtttggaatcctaagtaaaaaaaatacagaagtgtttaattcattcattccaatgaatattactgaggcactgacgtgtacaatgccttattttcctttttctttattttcctgttttttgtgagagaaaaaagcctacaatgccttatttttcaaatagaactcctaattcccctctaccccaagcttgcttttccttatgtccttcctgtctcatcaaattgcaacctcttttttagtagctttaagtaagaaaatctacagtcatccttgacttcactgtttcacacacaccccacaaacaatcaatcaccaaatcttattgcctctgtcttaaaaatatatcaagaatctgacccgttctcaccgcttccacctgtaccaacctggtctgaaccatgctcacctctcactgaatgaattactacagttgcctcctgactgttctccacctgatctatcttctaagaccttaactctttaaatccctcttccccttgcttcctctaacttagccacagtggcttctctgcttttcattaaacacaccaacacagttctgtctttgcacatgttgttttcttgctgggcaaactcttcccttggaagtgggcatggctacctctgtgtctatattcaggtctctgctaaatgaggcctttcctgaaaaccccatctaagatagtcctgccccaccccatatcattttctatttctttcccttgttttcttctttatcatatcaataatcaacatctgagtgcttatatatttattactttatttattgtctttcccatctttaattagagtgtatgctccacaagggcagaaattagttttgttacctattgactctgcaatgcttagaagagagcctgtcatttaatatttacatatttgttgaatgaatgactatgcatagtatcaaactgaatgctagagatacggtaatggacaagtaatgggcaacatagacacggttcctgatctcatgacatttacagttcctacaggggaaatagatataaacaattaattacataacgtttaattattatggttataaacatgaaggcatcattgaccactctggctgaaggtcttggtgtgtaggaagacagactatcaaatatttaataacttaggatcaagagccagaatccctcaaatcatataatttttgaataaaaatacagagaatcagtgtcatgcaaatgagcatctatagttagaggtaggttaaataggattatgaagatttagagggagctgacaaagcaagacagggaacaagattaaaagtagcctactaaatagataatccaatgcagctatgttctttctatcagtcaaggttactgcaggtacccggaaaagaaatccagtgataggtatacagggtcaagctaatcatgctttggaggggaaaacacaacacaacacaactcaacacaacacaacacaacacagtactcttatccttttaaacttggataaatcagaaaaatattgtagtatgtaagttttatatatgcacatgaaattccaacttaccttcaatttcagcaaaaagataatcttcccaaagccttccagttcagttcctttcctccccaaatttttgggctccttgtatgtaatctctcagccctttatcacactgttttgtaatcatctctctttctctctctcttttttttatttttttgtttgcctgtgtcctgcctctgtggagtctctgaggaaggaacttttctttgtgcctcgtagaaaagtgcccagcacaccgtagatactcaagagttatatgtgaaatgaatgtacaaacatttgagcaaattttatgcctttatgaaggattattattttgcattgttaaacactctacacacatgaaaacacagattctcattaaaaatgaaaatattgaatgaaaattgaaaataaattgaaattacttcacctggttatattttgctagaattatataataaattacttagaaacaaggtataaaaatggctttgtgtcttttttttttttgaaatagagtctcactctgtcacccaggctggcagtggtgcaatctcggcttactgcaactccgcctcctgggtttaagtcattctcctgcctcagcctcccaaatagctgggattatgggcatgcaccatcatgccttgctcatttttgtattttagtagagatggggtttcaccatagtgaccaggctggtctcgaactcctgacctcaagtgatccgcccacctctgcctcccaaagtgattacaagtgtgagccactgcacctggcacaagttaattacttagcagccacagatatctgcttatgaaaactcccattgcagcataatgggtacagttaagccctcagcaatatgctgcaaagctccagtttaggtgctccacactttagaaggaaggaaaaggaagagagagcacaattatgaagtgtcctctttatatactgacagtgtgtgaaatgctaaatccatttaagtctcataaaaacctaatgaggtaggtgttatttccattttacaaataaggaaattgaaccttgaaaaagctaagtaattttctcaagaccacacaactaatccacatgatcccaggaatccgtaatatttagttcattcttaaatatggtttttcttggggggggtgggggaagatagacgaaggaagtgtgagagctagtaaagaaagcaataatttgctttatttttgagataaatcaaatcagttatttggaatatggagagagagagtgtgtgtgtatgtgagattcattgtggaagagctgttttataatgacaagttctatgaagtttcatgatattgaccaagatttaagttggctgaaggaagaaaggtttactataatcattaccctgttttatttaattcattaaaatcatttaagaaagtttcaagtaacaagcaaaccatgaagaaaataaacattcatggctacctatgggagcgaattctggatcttgtcattttgatttctttttagatatgtttattataatcacatcatctgtgtatgaggtaggtaggactgcaagaagattgctctaattaaccctggtatattttctaaccagaaaatatatcttccacttttaaaaagaaaccatgtaaatttattgcaatgcaattattgtaaaacaaagtttaactttgatatttgtctttttaaaattgatagcctcttctcaagtatttacaatgctttaggaacagtaataaatgcttcatattactatgtctcatttaatcctcacaataaacctactagatattattatgctcatttcatgaaaactgcaactgagacccagcagttcattatcatgctccaaatcccagagctagtgaacagcagagctgagattcaaactcagtcctgggactacaaaacccatatatttaagctcagtgtgatatcgtagaaaactcccccaaagtggataacaacagttggcattagagaggctaaagtaaagtgaacactgaatgtaaaaacaaaaaggtcttccacattcaacaacaggcagtcattttctgaagatcttaactccccaagaagcaatattaagttgaaaatattaaggagacccacagaggtctggtctgagtactttcatgaatgctagatccaaattgggtaattaaaaaacatttcttagatgtgagggacaattatatatattatatatatattgtgtgtgtgtgtgtgtgtgtgtgtgtgtatatatatatatatatttttttttatttgtttgtttgtttttttgagatggagtctcaatgccttgcccaggctggagtactgcagtagcactatcttggctcactgcaacctctgcctcctgggttcaagcaattctcctgcctcagcctcctgagtagctgggattacaggtgtgcaccaccatgcctgcctaatttttgtatttttagtaaagacggggtttcaccatgttggccaggctggtctcaaaattctgaccttgtgtgatccacctgcctccacctcccaaagtgccgtgattacaggtgtgagccaccacaccgggcctcaagggacaagaatattataaaaagtaatagtgggcattatcaaattttgcatttgtatgcaggtaaagtgctaaggggtttacaggtgcattcaatgtaaagatgaggaaattgaataacagttgatgaaaaacgtttttctgtagaagaattctttgctatcactgttagaggcaatttgctgaaataggcgacttgactaattttccatgtttttaccttccagatgtcaaaagtagtgtggtgctctgaagtcagataggcctagacatagaggtatcagataaaacacagactacccagttaaatttgaatttcagatttaaaaaacccaatttttaaaataagtttgtctcatgcaatatttgatatatacttatactgtacttttagttgccaaatctagtaaccctctctgggtgtgaatcacagctaactctgatatggtagcagccattgtgactctggacaaatgacctcatctcccagccttcattttcttcttcaaaagatgaagtagataccttttctacttcacagaattgttttaggatttgaagaaagttaagttcattctcttgataatttctttgtgtgtctgttgattacttcatgggtttccaaatatttaccattaatttcatagagatagacttaagacactgccatggtattcaaggcaaggggcttattctctttttctttttctttttcttttactttttttttgttgttgttgtttttgagacaaagtctcgctctgtcgcccaggctggagttcagtggtgtgatctcggctcactgcaacctctgcctcctgggttcaagtgattctccgacctcagcctcctgagtagctgggattacaggcactgtaccaccacgcccagctagtttttgtatttttagtagagacagggtttcctcatgttggtcaggctggtctcaaactcctgactttgtgatctacccgcctcagcctcccaaagtgctgggattacagnnnnnnnnnnnnnnnnnnnnnnnnnnnnnnnnnnnnnnnnnnnnnnnnnnnnnnnnnnnnnnnnnnngaagcatgatataaaaggatggacacaataacattttagcataaagctaaattgtggcacaagagaccacatgtgttaatacacttttttagatccagtgatctaatttctaagtaaacactaatcacagaggtacataatgaagagtaagaatattcattttgaggctgggctcagtggctcacgcctgtaatcctagcactttgggaggcccaggtgggcggatcatttgaggccaggagtttgagaccagcctggccaacatggcgaaaccccatctctactaaaaatacaaaaatttctgggcttggtagcacacatctgtaatcccagctacttgggaggctgaggcaggagaattgcttgaacctgggagatggaggctgcagtgagccgcgatggcaccacggcactccagcctgggcgaaagagcgagactccatcttaaaaaaaagaatgttcattttgaaatgttttagaccagaggaaaaaatatccaataataggaaaatgaatcaatgaattatggtataatgaaatacaatagaagattatgtaatcttaaaaagaacacattagatagatatttagcgatataaatattatcataatataatattacataaaatcagaataattttaatttaagaatataatggtaggtataaggaaaatgttaatattggttatgccaaaatagtaagactatgtttccattttcttttctttctttctgtaatatctttttatgaagcatgttttatattagaaatatgaatttaatttttacaattctggaactcagaagtcaatcttcctaaggtacacagtactcctctaattttctctgctaggcgtcttgaggtgcctcctctcttgagagcctcctacgctactggagctgaaaccattcaactgaggcaataagtgttactcggttgttcattgttcagcaagaaaaatattgcaaatactggagaatgcatgatgtatttttggagctaatagatggaaataaaggcagttttgctaaatggaaacagtatttatttcatgtcattctgattttcagccataagcaaaagttttgtgagtatgtagcctgtcatatattgcataaaagagttcttagggaaatttacttttaggttattagagtaacactgagacactaactgaaatattgtgatgatttttatacatctaaagcatgaatttttctttcaggcaagctcagctttatcctattttatttcttgactaggtatctgtcaaatatgcaattcctccataaaatagacaattaaaagatcaatgactaatgaagtgcatcctactaatattttaaataacttttaatatcatggcactgtatttgaaaatgtaattatactttgtaaaaaacctagacgctattttcaagatgataaccctgggtgaagttggaggtataattttaataaaattcatcaggcaatagtacatgtggtttactttcaaatttgttgagagatgtagctttgagaacccctcttttatttctaactctcattcatattaataggctcagactcaagcaaaggataatgatgttgctgttattttcatccatgtgtaaatccgcaaatccaatgccgagtcatgaaaatcctactttgacaatgcgacgaactgtttatttccctgggaataattttgaaaactagccatttgtgtatctttgaggaaagggaaaaaatcagcatgtttattatttttaaaaaattagggcctggattttgacaatgtcaagatttaccgtatatccctgtttgtttggatacaccagtgacgtccacttctagaagacaaagttatattacttaaacaaccaaaggtaagaacccagtgataacgataattagagttatatttttcacaaatgcttatacttctgttttgattctttaaagtttcagcttttgctttgcttttcatgtgatgtgctctctagatacagctatgattgtatttttattaacttctctgtctttttgacagataagtgaatactctacctggcaatatgattctgctaatctgaatatcacaaaatagtaaatgctacctgcttttcacaaattttagttttatttttagaagtcaaaaacaatacctttgacaggtatgtttttccccaaaggaagtgtcatatactgatttttctttctaaaatttggagataggacactatcaaactcatgtaaatcttaaagaattcactcctaaaaataagagctccaactcactggaaacttaagtatcagatactttatcaacattattataacaacctgcatatcccctttcagagatgaataagtggtctgaagagattaagtgcctcgcccgaggatacaatactactctatgaaggagctagaatttaaatcaccttgccttcttttaaataactgtgataagcgtgtatattttaatcagaaaaaacagttattggctgggcctggtagctcacacctgtaatcccagcactctgggaggctggagtaggtagatccttgagcccaacagttggagaccagcctgggcaatatggcaaaaccttgtctctaaaaaaatgcaaaaattagcccaggtgtggtggcatgtgtttgtagtcccagctactcaggaggctgaggtgggaggatcacttgagcccaggaggttgaggttgcagtgagccgagatcacaccactgcactccagcctgagtgaaagagagagacgctgtatcaaaaaaaaaaaaaaagaaagaaagaaagaaaaataaaaaactgttatcaattactgtcatgtttttctttaattaaaaaatgcgtactgcattcatcatgtaataagattacatgtttcaaaatatcagtgatttcattctatattggaaagttgaacagtcttaaaacaagattttaaaatgtttctatcaataaagatacctcttaaaacgggctttttacattttgactttttgtttatatatcctttaatcagtttgttcaattacactcattctttcacttggctaacacccataaacaccaatcactcatttcattgtcattttcccactcagcaaataaaagagggtagggagtgaagtattagggtgtcaatgaaattaaaaggcctattatttacctgttgtaccttatgtcccctagagaatacgccctcttttctccattctggaatcatttacaaacattgttaacaaaaataatctcagtaaagcaaaaaactatacaggccacagtcaaagttagaaattaatgaggaaagtgtaaataacagaccctagtccttagagaaaaaaattttttcaaaaaggaaaagaaacctctttaattgaagatatcaacaaaacagccattgcagatcactctctttttcttggaggtaattttttaagttagaaagttaatgtgttgaaaactaaaaagtttgggtaaaataaattattttgtagaaaaacaaatgtcaaatttaaattaagaatcaagagttaagttgactacaaatcatgagcaaaattttaaaaagtgtctaagaactacctccaaaaaagctactgcatcctaaatattttttacttattaatttattcaacaaatatttatttagttcctactctaacgctaggcattttcctaggcagaaactttcctttgttttctactatatccccatcaataggtcaaaggagtaaatccataggatgctacagccatttacctcaggtgatagtatgtggtatctgggctactatattttataagttttgggtatggcattaagcaaaatttacacagctggtcctttcttacatatccttaaagtagaaatataatgtcctttcccatgagcagacaacccttgtgccaagatttttttttttttttttttttgagatggagtgttgctctgttgcccaggctgaagtgcactggtgcgatcttggctcactgcaacctccgcctcttgggctcaagcgatcctcccgcctcagcttcctgagtatctgggattacaggcatgagccacctcactcagcgaatttttgtattttttgtggagacggggttttgccatgttgcccaggctggtctcaaactcctgagctcaagctatcctcccatgtctgcctcccaaagtgctgggattacaggtgtgagccaccatgcccagcctgtgccaagattttgaacaatgctaatatagctacttgatagtctgggacaagtgcttacagttataggtaatggttctcaaatgttacctttccaaagtacaaatcaacttgagctttaacaatttttatagctttagttgataaaaaggtaattgattaaatgcaatgatatagtcttgataaaacagaaaattttttataaagaaatttctttgacaaaataagaaaaatttatctgaaattaatgggcaaaataggagaaattctagagactgaaacaagaagtcaaggagtgcctgatagaatatctattatttaacattgttctataaattctacccaacacaataaaacaagaaaaaagaataagatatatactttgaagagagaaaattatcattacctgtggttaatatgattgtttatccagaaaacccaaatggatcaatttaaaactatattaaaactgacaagatacttaggaagatgataggctacaaaataaatatataagtagttttcctctagaccagtaataattattaatagttagacggtataatacaacagattttatttagaaataacaaatttaaatacatagagtacatttaataagaaatgtgcctagcttatttaataaaaattacaaagacatacaaggtaaattttaagaagtaaattagtaaatgagaagacatcccttgtcatgtgataaaaatttaatatgttaacatgttgattctcccaaaattaatccaaaaattaaaaaaatctctttaaagtacgttgtgagagtttatttttaggggacttgataaaattattctaaaggcaactggcaataataaatgtatacactgtactgtcataggaataaataatcattaaataggataaaaatcacttagggctgggcgcggtggctcacgcctgtaatcacagcactttgggaggctgaggtgggtggatcacctgaggtcaggagttcgagaccagcctgaccaacatggagaaaccccatctctactaaaaatacaaaattagccaggcgtagtgacacatgcctgtaatcccagctacttgggaggctgaggcaggagaattgcttgaaccagggaggcagaggttgcagtgagccgagatcgtgccattgcactccagcctgggcaacaagaatgaaactctgtctcaagaaaaaaaaaaaatcacttaaatgcagtcattaaagtgatgagtgtagatgtatacttttttattagacatgcaagtagtgttttgtgcaataaaatgcaataattaaaaaaattttgttgctttttatgaacctgtataaggcactgtataaggttctggagacattagagttcattaaatgaactctaataaaaatcagagctcactgtgacctgtcctcaagtctgggggagagacactgacataaatggatcatgataaaataatgggtcagtgcactgatgataagctctctatattatgtgagtgttgaggagaaaccatgagcactcagacatcctaattccagctgtattagtctgctatggctgccatatcagaataccgcaggctggtggtcaatagaaatttatttctcatgcttctggaggctgaagtccaagatcaaggtgccatcagttttggtttcttctgaggcctccctccttagcttgcagatggtcatcttttcgctctgtcctcccatagtcattcctttgtgcatatcatccttcctgtctctttgtatgtccacgtttcctcttcttataaggacaccagtcagattgggttgggtccagcctaatggcctcactttgacttaatcatctctttaaaggccttgtctccaaaaaccgtcacattctggggttagagcttcaatatatggattttgggggcacacaattcagcctgtaacaccagccattagaaatatttactcttttcttcattctttaccttttacacatgctgtttcctctgccaagaaagctcatttcctctactgtcgcaaactcctattcatctttcaagatccaattacatatcccctgctttgggaagctctgtgattctcccacctctaacagagttggcctatgcacacgtgatattgtcatatgagatttttatcacttacaggtttctcttactaatttctctagggctggaagcctgtcttaatcaacattctattttcttttctttctcacttccatacctcagcaacctacacgatgctgctgtcaaagggagcgctcaacaaatgttgagaagcaaaaatattaatgaaatacagattggattacatgctatctgtaaattgtttgcaagtgaaaatatcaaaactttaaatgtacccttttcagagataaggtataaacttgcgagagaagtaggaaaaaaaggttatacaaaatgctgaatgctcacagtgactgacaaaatctccgtggaattacagtccagggaacctcccttgctgggttctaagtatctgcctttttatatggttacttatctttattgttactatcaagaaatttgcacttgtcttctctcaggggatataaagagaaacgaagtaagtttcttgaccttaagaagcttacagaatactgggaannnnnnnnnnnnnnnnnnnngccactttttgtgcatgacatagccagctcttattctagcaggatccacatctatatatgtgtatatatatatatacatatatatgtatatatatatgtatgtgtatatatatatatacatatatatgtatatatatatgtatgtgtatatatatatacatatatatgtatatatatatgtatgtgtatatatatatatacatatatatgtatatatatatgtatgtgtatatatatatatatatatatacatatgaaagtaaatgcttagggagaaaggagtgatttaagatataggaaatgcatgcaatggatggtgccatcacaattgatttcatggacttttttttaagactttccaaaacacctgtcatcagcatgaatttctagagaaatttcattgtgaaacagatattggggtgaggaaccctaagataaaagtcaggaactacttcagttcatcaatatttaataatttttataattaaatattcagaattgtgaatactttctgagtcaatgaaggtagagaagtgggaaggataacacattaaggtctccaaccattgtgcaaagtctttgttcttactcttgattgtgatagcatattggttttaaagtaaactttctttgatgatgaaggatcttgtgatgccccaggatcataattaatatatatgactttatagttctaataactttttaatgcttatttaacaaatatttattgacaaatattcccagttctagatactgggattataacagggcacaaaaacagaattcttgctcttaattatgcttacatgctctggtgtttaaaacactcttatatcactttgtgttcttataaaatattttgtttaaagaaaggagtattggaaaatatattgggttatttgtttgttttagttaattgacttttgattaattgagctttttattgtattgtagatactactttaacattttctgtgaattgtgaagatgatgataatgattatgataacaatgatctctttggtaaaattgtttcttcctgagcaagtactggattttctttatacgttgataacaatttgacttaccaagtgtggcaggtccctgtgtgtgctggggcaacatagcaacagtgttttgtcagctctgttttagtttttcatgagaattacagctggcttatgagcctataaggataattattattttctttaatagttgctttgacaattttaaagtctcaaagtgatatttcaggggaagagattaaagaaagattaatcattttaagtttctttgtctctttaacaagttgatggttctctctttctgaacttagagatcatataagaatattatcaactagtatttgtataacttttcacaaacagcattcaatattgccttatacatatttttcattacctccccatcgagacttattacaataggcagagcaggtattattatctccactttacagaagagaggaccctgtaactcagaaagatttttttgtcagggtttcacaggtaatttgctaaagagctagggctagaaactaagcccttgtggaagaagcgattgctattttcaggcactggctgtttctcttttgcagagcaggcacaacccattctagaagttacacaacttgctgagcgttgttaaatgttaaaaaaaaaaaaaaacttagttctgcaattaaatactgagatggaacgagtgagatgaaaaacagtattatggaaaatgtttattttaaatttatttttaccatgctatataacagatctccagaccttagtcctcctaactgaaacattgtatcctttgaccaacatgcaccctgcccaataatggaaaacattattttaaagcaaaggtgctgacacaaatgtccagaccttattcctcctaactgaaacattgtatcctttgaccaacatgcaccctgcccaataatggaaaacattattttaaggcaaaggtgctgacacaaatgatttttgatattaaacagactcttgttttaaaaatatgacttttttcatttagaaatatattaggagaaaatatagataaaaacaaagaagaaaacaaaaataccaatgatcccaccactaaaaatttaatgtttaacattaaagtgcttattagttctatgtacacacacacagttttaaaataaaatgtatgatactataaatattacttcacaatttgctttttcttttttaaattttatttttaaagttttatctagctatctatcatctatctatctatctatctatctatctatctatctatctatctatctatctagagaccaggttatgagactgactaatttttgtattttttgtattgatggggtttcgccatgttgcccaggctgatctcgaactcttgggctcaaaagatccgcccgcctcaaccacccaaagtgctgggattacaggtgtgagccaccacacccggccacaatttgctttttctacttagcaatatatcatgaacatttcttcaagttgttcagaagaatatgagaaaaaatattgaaatatatcattttattataaaattaatgtgttcattctgtaaaactgatataaaacagaagtatataatactactgtccagaggtagctatgtaatttagtgcctactcttctgcactttttttttttacacatcccgaagttaactggttggtggattagaataccttcttcacaaaaagtttgaactaatgaagaagagagcatcatttattttacaaaggtatatattttactttaaatttcaatatagcaaataatatgtaaataacaaatgcatcatttgtaataatctttaggggcattcacacagaatactactctggaaaccactagcatacaggaagccttctacgtgttgaataatctttggctgtcttcaagtaatacctcagtggtgtgtgagtgctctgagctgcatactatataactatccttgtttaaagatggtgctttagaccggacgcggtggttcacgcctgtaatcccagcactttgggaggctgaggcgggcggatcacctgaggtcaggagttcaaaccagcctggccaaaatggtgaaccatccccacaccccatctctacaaaaatataaaaattagctggccatgatggtgggtgcctttaatcccaggtacttgggaggctgaggtgggagaattgcttgaaccggggaggtggaggttgcagtgagctgagatagtgctactgcactccagcctgggcggcagagcaagactccctctcaaaaaaaaaaaaaaaaaaagatggtgctttaaagtctgtgtactatatcagcctttcagactggatttctcaattcagtttgtaattttatccaaaagtagtttactgcttgggtgatgtaatacaacctatatgtgagccataaattggtaaacaaatatttgttgtgaaatggcttacaggatttacaggttagtaaagtacacaaatgactttagtagatggcaggattttatgcttcagaaaggtaaaattaaattgtagttaatagtcagaggaccatagtcagaggtacatagttacttgtgggacaataataatgcttgacacctagtaggcatttcttaaatatgtgttaaatgttgaatgaattaaagaacccaactcaaaaaagcagaccaagaatataaacatgtaattcacagagaataaatccaaatgattaataaacacatgagagtttgtctaacttcactagtaaatgtgaatcaaaaactgtagggtaaaaaatgctcacccatcggattgaggaaaacttttaaatctgacaatattaaatgttggtcagggtatgggaaaaaatgatctacttccataggtctagcagaatgcaaaatggaacagcaactttgggcagcaatctggctggctctagtgaactgaaactagaactagcagttccacttctggaaacatacatgagaaccactcttgcacatgtgactaaggagacttagtctcctaagactagggacttttattgcagcattgttagtaagagcaaagaaatggaaacaaccaatccttcattagtaggaaagaaataaaaatagaaaaggggaacaaaatattatgtatttataggctggaatattaataaacaatattgtaaaatgaaacagctgtatgtatattagcatagataatttccaaaatggtttcaagtgaaaaaagcacaagttgcagaattatgcatagaggaagatactgctttgcaaacttaaaatacatgtgcaaaactatacattggttatggaagcttacataggtacgtaaaaggatgaagaattaccctgaaggatataccccaaactcacagtagtgactgctcctagggaaatagggaagggactgggagattacagtggtttttgttgttgttgttgttgtttgtttgtttgtttgtttgtttttcagagagtcttgctctgttgcccaggctggagtgcaatggcatgatctcagctcactgcaacctccacctcccaggttcaagtgattctcctgtctcagcctccccagtagctgggactacaggcgcatgccaccatgcccggctaatttttgtacttttagtagagacgggatttcaccatgttggccaggctgatctgaaactccttacctcaaatgatccgcccaccttggcctcccaaagtttgctgggattgcaagcgtgagccaccgtgcctggccacggttttttaaaagaactttaaatataaagttttatttttttcacatgccataaaaggactgagagccaatttgacagaagtcaacagttgttaattcctggtggcagaaatatgaatgatataattcatattttatagttcatataaaatgaatatatgaatatttcataattcatatataatgatatgctgttttgcattttgaaatggggggtcagtatatatattcactaagtaattaatttacatgatacaacattcaaaatgtataaaatatatacagtgaaagatattttcccttccactccaattgcccagtcccatacttccccttcctcagaggcaatcactgttaccactttcttgttgcatttttccagagagattctcaccactcctttacgcacagcacacacacacacacacacacacacacaaatatagatatttacatatatatgtatatttcctacaaatggtagcatactgtattttttttttttagatggagtctcgctcttcgcccaggctggagtgcagtggcgcgatctcggctcactgcagtcttcacctcccagattcaagcgatttccagctaatttttgtatttttagtagagatgggatttcaccatgttggccaagctggacttgaactcctgatctcaagtgatctgcccacctcagcctcccaaagtgctggtattacaggtgtgagccaccacacttggcctcatactgtatttttgaaggatttccaataccttttttttccttccaaaaagaggtcccatagatgaaatactatatagtatataaaatataaaaataacaaggtaccagaggtaggaagaaaggcagagggagggaggaagggagattgagactgtggcagaagaaagggcaataattcagtagacaacggtgaaatcttgttttctttcttttttttttttaatggagttttgctcttgttgcccaggctggaatgcaatggcacaatctctgcccaccacaacctccacttccctggttcaagtggttctcctgcctcagcctcccgagtagctgggattacaggcatgcgccaccatgcccaactaattttttatttttttagtagagatggggtttcaccatgttggtcaggctggcctcgaaatcccgacctcaggtgatccacctgcctcagtctcccaaagtgctgggattacaggtgtgagcagtaatcctagcaggagataattttgtcagttgtggagttgggggaggtggtggtgagatcagggtattgagtaccctagctatgctgttcccgtgggcttgccttgtgctggctgtgttcttcaacgttaagtcactgttcctcatagttattctgcataactccccctctatccagggccacactaaattcctcttcttgtccttggatcccagtggtattaacagtttggctacttctaacccgaggttgctgcaaccatcctttgtggtttccctatactaacatctttgtaaatagtctctttggaaataacctcttccagaattattttgagtgtgcctttctttttggttgggaccctgactgagaacctccttcaaaagtattacttatctattacatatcctttttgtcttattcactgtagtattaatttcttgaaggcatatatcatatattttgttaatatctgtattcataacattgagtacacttcctgtggctagtaggtattgataaatatttttgtctcaagaagcaagaatggaaggaatgatggaagatggtaggattatagtcgccaagcagtttttttaaaatcttagttttggcggggcgtggtggcttattcctgtaatctcaacactttgggaggccaaagcggggagatcacccgaggtcaggagttcaagaccagcctggccaacacggtgaaaccctgtctctactaaaaatacaaaacttagctgggcctggtggtgcacacctgtaatcccagctactagggaggctgaggcaggagaattgcttgaacccgggaggtggaggttgcagtgagccgagattgtgccactgaactccagcctgggcgacagagcaagactccatctaaaaaaaacaaaaaaacgaaaaaacaaaaaacaaacaaaaaactgagtttggtttcctaaaattttctcatttctcccagtctccgaatcagtttccgaaacacagttctctgtgtttctgctctatggaaatcactttactaggagtggggttctggctagtgattcgggcatggctcatgcctccagaaatttgtctcggtgaagggaccagtgtggctaaagtttcttaaagcaggaggtgtctcctgggggtgggagatggaagtgggatctgacactaatggagaaggtgtggaaaagcttctgtggctataggaagaggattaatgagcagtattaagagccaagttgaaactccatagcaggaatttatagtgcatctaatccactttaccttacacaaaactactatattagtcttcctaaagtaaacatgggatgatgtcattctcttgccttaaaatcttcaatgactcttcacttcatgtagaaagaagaatgaacctctattttgatgcagtactcttactttcacagacctgtttcttactttttctctctgtgtagaaattaaaccagtttaatttctattctccagatgggcttccacaggaattccataggaatatctcctgcctctatatctttactcatgaatttccatttgcctagaataggaagcctttctcctgccccatttccacctgataaatcctacttacccaggccccttattttctgtttgctcttgaatttattgtttcaggaggtgtctcccatgatgatttctcttccaacagagagactctccctttctagtcccagatcctgtgggccattcctaactttaagcagcctcttgcatttatgtctcctgctcttggggcagtaggagtgtcctattattgttaatctctgggtttcctcactgtcctctgtttgacattactaacacttttgtagctaatgctctgtattaaattccctctattgaaccacctgatgttagccgtttttctgattggctgatttctgattcactgtgttagattcactgtgttagcacacctgattgaaagactgtgcttcaatatctttgtacaactccatcttcttcatggacctcttttcattatacagctgaaaaagattaaaaaaaactcccctagaatattaaaaaatatctgttatttcaacaatcatatttttcttatgacattgtacaaatatctactaatttctaaacaaaatatctcagaaattggggaaaggatgatggacaattacaaataattatctaagatccccttgtagatgccaaatacttgttcattttagtactcttggcttgttcccctatagtcctctactacactactagttggggggcatactcatctttggatttgttccttatccaactggcagagaactctgtgcattgtacatgtgtgctatttattaagttgggcacagacttattgcttggcatgtgtatttttttttttgagacgaagtcttgctctgtcacccaggctggagtgcagtggcgtgatctaggctcactgcaacctccacctccccggttcaagtgattttcctgcctcagcctcccaagtagctgggaccacaggcacccaccaccacacccagctaattttttgtatttttagtaaagacggggtttcactgtgttagctgggatggtctcaatctcctgaccttgtgatccgcccacctcggcctcccaaagtgctgggattacaggtgtgagccactgcacccagcggtattttaaattttcattttatattctagttgttctttgctattacatataagtaaaattcatttttacattgactttacagtcctgtgaccttgctaaattcacttatttgttctaatcatttttttctagatgctgaagaatttattttatggttgactacatacactattatgtcatctacaaacaaatagttttacttcttttccaattcagatgctttgtattctttttcctgccttattgcaagcgctagaacctccagtgcaatgttgactacttctagaatatccttgtcttattcttgaccttaggaggaaaatgttcagtctttcattattaagtataatgtcaactgtagtttctttttttttgttttgtttttttgttttttgagacagaatctggttctgtcgcccaggcaggagtgcagtggcaagatcttggctcattgcaaactctgtctcctgggttcaagtgattctcctgcctcagctttccaagtagctgggattacaggtgctcgccaccatgcctggctaatttttgtatttttagtagacacagggcttcgccatgttggccaggttggtctccaactcctgacctcaagtgatccacccgcctcagcctcccaaagtgctgggattacaggtgtgagccactacacctggccaatgttaactgtagattatttgatacttgctgtttatcgggttgaggaagttcccttctattcctggtttgctaagagttctagttataaatgggtgttgaattttggaaaatgcattttctacatttctgcatttctacatttgttgaaatcaacatttggtttctctccttattttttgtcattattattgtgaatcttattgattacttttcaaatttatacctacatttctcattttaagttacaaatatacttataatagttgcttgtaagttttgtttgcaagaactgatcctaaaggtttcagatttgtagatctgaaatatcaagcagttaacagcaaccttgaagcctttcctaaccattattttctgtctcccacttgtggcattcagaaaaggccaaaggcactaaaggcaaataatgcagagtaatgtttcacaaggtgtgattcaggaatcctttgcaacagaattacttatagcgcttggtaaaactgtagatttatgtgccttacccataccttattcagattctgcaaatagggccctgtaatatgcattttaaacaagcttcacaagtatatgcatgctaaatttaaagaaccactaatacatagttaattatgtgtgggtttgtgtgtgtaagtgggtatacagcatatcttctctgcccttttatataaagaaggcattattattctgttcacaaatgtgtaaactgaggttccatgaggttaaaaaaatctcacttgagttcattcagctaataagtggcagagccaggttttgaacccaagctagagcatgacttcaatcagtagaatatactgttccatgtattcacagttcatgttccatatttgttttgcctgaattacccataagattttctcaaccattgctttggtatatttttgtgtactttgttatatcctcgcttaagtgaggaatttttgtgagtcagctaaatatgagagctgaatcttgctttccaaagcaattgtttctctttgattcacaaatttcaattcaaagactcatgcatgggaaaaccagtaaagcaacgaagtccctaaaagaatattttttttctgttcttttcagatgttttgcctatgatcctatgatacctcaagagttgaaaagtgtatgaaaagaataagcaattactattaaaatttttttctcaaactacagagtaattttacctttaaaaacagatggaaaaattcaaaataaaatactagcagctgggacccagtagcatataaaaagaataacttatcagggccaggcatggtggctcacacctgtaatcccagtagtttggaaggctgaggtgggtggatcacctgaggtcaggagtttgagaccagcctggccaacatggtgaaacctcatctctactaaaaatacaaaaattagccgggcctggtggtgggcacctgtaatcccagctactcgggaggctgaggcaggagaatcacttgaaccaagatggtggaggttgcagtgagctgagaacacaccaccgtactccagtctgggtgacagagtgagactctgtctcaaaaaaaaaaaaaaagaataacttatcataaccaagaagtgtttatcatagaagtgttaaaattatttatatagttcaccatattaatattcacaggaaaatatgattatttctatgagagcaaaggagactttaataaaactcaacattaattcccatttctaatattttaaaaattggcaacataggaaacttcctaacatgaataaaacatctacctcaaactaatggtcaacaccatgcttaagaatgaaaatcaagaggcattttcataaagccaaggaccatactggatatccgttaagatagttataacagaatatcaacattattatgtattatcttctggaagttttagtcaaggcaattagacattaaaactaaatgcttcttaaaaagaggaaataattttgtgtaagtaatataattgtattgaaaaaacagaaattaattaatacaaaaactattagaaaaaaatgttgtaaaggccagtaatgtggtcagtttcaaaataaataagaataaataatttcctgacgtagcaaaagtaaagagttaatatacatcaagggaaaaccaagctaatgacaaaaggaacacaaatataaaacatgtaggaattaataaaaatttagaatctatacattgaaacatttttgaaaatgtaaaggaaaataatttcctaatttattctatgattttaatgcaaattccatcaaaatctctatagttggaaaggcagttttagaataacatttcagatcagtagggaaaagatggtctattgattattgattaaatgctaattagaatatcgactatccactcagaaaatataaagctaaatctctactgtataccttgcaccaaaattaatttgaggtagattaaaaagaaaaccataaaacaagtggggaaaatatttataaataattataaatttcaaatgtctttttctgtttataatttctatttttaaaagtgattatgtatgtttaaaagtgattaataaaaaaaaattccaagtagaacacttaggccaacaagaaattataggacaagagaaggactcatttttctttagggttaagcaaagcccaggctcggtttgttctgacaatcagaattatattttctgttcttatttaatattttactcatataattttttctgtgtattatgatgaatgaaataatcacatattctcccttccctagtcataaggcatgaggtctccaaagagagtgttcattgatgacaacagggagttggcatgtggggaaatataccagaatagtcatgtcttcattctgatgctgaaaaggagtcagcgaagaatttctcatcttagaaagcagttgtttctcagtaaaaattactttaattatattttaaaatatatgtacacgttcattcacaaacattacaaaaattctttatttactatttattggctactgcctgctagttattttcattaattgtttgggtactggagtaagatagaaagcattatttattgttgtcttcacttgaatatttaacattttataaaatttaagtcattattgattttactttcaataatgaggtatattttatacatttttctatatcaaatgatttttctttcattttaatttacttaagagtcctatgaattggcaagaaaagttctaagaacagatggggacagtcctgccttggactctttcagggcagagtataaatgggtggacatgattgacagttcattgtaactcaaaagtatatgctaccgtgaggattatgtttattaaactgatagaataaattgtcatttattgggctcttactatgtgccaggcataatgctaagcacttaactcattttatcctcaccacagtttgtgaagcaaatgttattcaggaaaataagatgaatttcctaaagaacaaagttgtccaacaatggaacaggctactcataaggcaggaagttcccacaaccagaagtgttccaaaagagaccaggtgatcatttatcaggaatatgatagcggcattcctgtttgaatggaaggttggctcaagtgacatttgaaattataactgcttctaggtttctatgattctgctttgcaaaggccatcacaccttgtaatataaaccaaataataccagcaaactcactcaatttaaaatccagttattggcttggcgtgatggcccacgcctgtaattccaacactttgggaggctaaggtgggaggatcatttgacgtctggagttcaagaccagcctgagcaataaagtgagatcccatttctacaaaaaaattagccaaatgtggtggtacgtgcctgtattcccacctacccagaaggttgaggcgggaggactgcttgagcccaggagtttgaggctgtagtgagccatgatcacaccaccgcattccagcctgggtgacagggtaagaccctgtgtcaaaaaaaaaaaaattcagctattatgttttaaacatatcaattctttctgtcagtcaagacactaaattagtgttgtttgcttaaacagataatatacgtagtctttggtttattttttctctttgaggttcagtggtcctcaaatttaaaagtggattattgaaatggtatactagaattatgacaactttaatattaaaatttaaatatgttttggatttctcatctgtagtgcaaaaatttgggggaaattagaaatcagtgtaacgagaagttaaaagcatagagttttggcatcatatgtactctggttcacataactactatattgagtatatattctggctatatgttcttggcaaattaagtacattttctgagttccagattccttatctgtaagaacctgaggaaatacttacttcacagtttgtagtgagaattacctgaatagagtgctttatgtctggcatatagtaagaacccagtaaattgtcaagtaaattattacattaaagaatggcatcactaaaaacgtatacttttttttttcattttcaacaatatatttattcaacctggtacttccaacatattattccaacatgtaatcaattttttttttttttttgagacagagtctcgctctgttgccaggctggagtgcaagtggcatgatcttggctcactgcaacctccgactccctggttcaagcgattctcctgtctcagcctcccgagtagctgggattacaggcacacaccaccacacccagctaatttttgtatttttagtagagacagggtttcactatgttggccaggatggtctcaatctcctgacctcgtgatccacccgccttggcctcccaaagttctgggattacaggcacgagccaccgcgcccggccataattaatattttaaaaatctgtaatcagatatcttgcattctttttttactcagacacttccagcacatttcaattcacatgttaaatttccaggtaaatgctcaatctatatatttagatttataaaattcacaattgaaattgaaggttcgcatagtcaagttgttccaaacacacttaaaagtctcctaataactttattatcacttcaaatagttaaaattaaataaagtttaaaatccagtcttcagtctcactagccacatttccagtgctcagtagctacaacagctggtggccaccacattggacagtatttttatttttatttttgaaacacaatcttgctctgtcacccaggctggagtgcactgtaaacttcactccgccccaggctcaagcgatcctgtcacctcagcctcctgaatagctgagaccacaggcatgcactaccatgcctgactaatttttgtatttttagtagagatggggatctcactatgttgcccaggctggtctggaactcttgacctcaagtgatctgccctccttggcctcccaaagtgctgagattactggcatgagccatggcacttggcctggacagcatatttagtgtctgatcattggttctcagctctgactacttggcagaatccagaatccacagaagagggttttaaaagcacagttccacagcccccaaccccaaccttactcaatgggaggctggaagggactctggttccaagaggcagcctgtgtttcttgatggaaggatgtgacagggctgtatctttaatgtttcaccttgaatgctgaagacagcttcaaggaggagataactcaatgtatcttagtccattttctgttgcttaaaagaaatacctgaaactgggcaatttacaaagaaaaggaatttctttttttccattctggagtctgagaagtccaaggtcaaggcacttcttaatatttttgatgcaaatatttttgtatttaagaattgaggttaaaattttcatactgtaagtaaaatgcaaatatattaaaggtacaatttgatgatttttgatctatgtatacactcatgtaaccaccttccccaattttcattccagaaagttcccttttgtccttttcagtaaatttcaccccccttagacaactactatttttacttctatcaccaatgttttgcctgtccttaaattttatataaatatagtcatgcagcatatactcttatatctggcttctttcatgtttttgggattcatccatgttgttggaagtatcaggagttcatttctatttattgctgaaaagtatttcattgtttttttaaaccagattgcttatccattcctctattgatgaaaatatgggttgcttcctgtttgggacttctatatatatagctaatgaaaacattcttgtacaagtgtttttatatacatattatttcatttcatcatatgtgttttgataagcaaaagattggaattctaatgatatccaatgcatcaaaaatttattttagatttagtgtcttttttgtgccttctctaagaagtgttgcctatcccaaggtcatgaggatattttcctatgttttcatctagaagctttataattttagcttctatgtttaggtcagtgatccatcttaaattgagtaaatacatatactgaaattagtgagaaacagagtagttgtgtgtttgtaggtaactgccagacagtttgccaaagaggttgtacaatcttttgtcccaccagtgacatgcgtgacatttggggtgttggtcttttaaattttagccattgtactaggtgtgaaaaagtatcttgtggttttaatttgcatttatttgttgactgatgagttaagcacattttcatgtgcttattagttatttttatatcttcttttaggaaggatttgttgatgatttttgtttatatttttattgggttgtttttatggttgatttgcataaaatttcataaattttatgtatataagtcttgtcagataaatgtactgtgaatatgattatctgtggcttgcctttacatcttcttatatgtcttttgataagcaaaagtttataatttttgatgatatccaatgcatcgcgaatttcttttagagctggacgtggtggctcacaactgtaatcccagcactttgggaggccaaggcgggcaggtcgcttgaggtcaggagtttgagagcaacctggccaacatggtgaaaccccgactctactaaaaatacaaaaaaattagccaggcatggtggcaggtgcctgtaatcccagctactctggtgactgaggcaagataattgaactaaggaagcggaggttgcagttagccgagatggcgccactgcactccagcctgggtgacagagtgagactgtctaaaaaaattttttttcttttagattgagtgtcttttttgtgccctttctaagaaactttgcctaccccaaagttatgagactattttcctatgttttattctagaagctttataattttagcttttgtgtttaggtctgtgatccatattgaattaatttttgtggtggtgtgaggcaggggtggagttttctttttttctccatgtacttttaaaatgataatttactttatttgcacactcaggccacaaggttttcaagtttccaaagtgaacatggaattagtgggactaattaaatctgatatatttttggtggtccaaaggctcttagatgagtgtgtaccattggttgttgttattgatttctcatttcttttgagtttctataatattccctttgcctctaattaaacatgatagtttttgcgaggctgttgggcaccagcacccacatttgccaccaactctctccccagtgacttatacctgtctttctctatagtttcctgacctttctcaaaatctccatgcttcatgtctttgttgattgatcacataaaatcttcttcgcaaacattttcttctttatgttgttaatttctctataaacaatcaaagtaattctgttatggcaagtgattttatttctgtaataaaaataaatttatttgtagctttaactttattacttatgtttctgcattacttaaatgaaaaatgaaataattataatgaattatgtttaaggtactcagttaaaacttagtgcagaattgattccactttaatgctaaaaagctttagtaaatatcaggtattacgttcaagagctcctgtatgaacttttccgaagagctcacaatctagcaggggaggtggatgtatcagtacccatgtagtagccagtgtgtagagaggtagacgcacagaactatgggaataaaaaggagggtgtgctggattctgtgcccaagtaatcatctacgtctattttttttttttttgaggcggagtcttgctttgttgcccaggttggtgcgcaatggtgcgatctcggctcactgtaacctccaccttctgggttccaatgattctcctgcctcagtctcccaagtagctgggattagtcacccgccatcatgccctgctaatttttgtatttttgtagagatggagtttcaccatgttggccaggctgctcttgaactcttgacttcaggtgatcagcctgcctcggcctcccaaagtgctgggattacaggcgtgagccaccacgcctggcctcattgatgtctttacacagggaatatatgaactgatttttgaaggccaaataggatttttcctgggagaacaaaaagagtcaagaattccatgcaaaatgaacagcatgagcaaagttattgttaaacagaggtgtatataaaaattacaaacatggccaggcacggtggctcacatcccaacactttgggaggctgaggtgggtggatcacgaggtcaggagatcaagaccatcctggctaacacggtgaaatatcatctctactaaaaatacaaaaaattagctgggtgtggtggcacgcacctgtagtcccagctactcgggaggttgaggcaggagaatcacttgaacccgggaggtggaggttgcagtgagctgagatcccgccactgcactccatcctgggcgacagagcaagactccatctcaaaaaaaaaaaaaaaaaaaattacaaacacatctatctgatacattatcaaatgcttacaacataggagaatggccaaagctaatcaaggtttctgaatttttgaaaccttaatactgtttgtatctggtcagttcagttctatatctggtgggagatcttttaaatagcataaagatgtttcttatcattgctaaactcacctttcttcaaatttcctctagtgcttgtgaacttgaggcataaatatcagtgattttcttatttccatttttaattttaattttatttttagagatgaggtcactctctgtcacccaggctagagtgcagtggcacaatcacagctcactgcagcctcaacctccaaagctcaagtgatccacctgcctcagcctgccaagtagctgggactacaggtgcacatcaccactctgggctaacattttattcttatttttattttgtagagatggagatcttgctatgttgcccagtcttgaactcctggccttaagcaatcctaccacctcagcctcccaaagtgcttggattacaggtttgagccaccatgctcagtgtgtgatttttgctcacttcagtaaaagatccatgaatatatttaaggagacaatattctcatcatcttgaaaggttagactaatgtaaaaatttgcaggctggtggcagtggctcacacctgtaatctcagcactttgggagactgaggtgggtggatcacctaaggtcaggagttcgagaccagcctggccaacatggtgaaaccttgtctctactaaaaatacaaaaaaattagccaggcatggtggcatgcacctgtaatcccagctacttgggagaccaaggcaggagaatcacttgaacccgggaggcagaggttgcagtgaaccaagattgtgctactgcactccagcctgggtgacagagcaagactcggtctaaaaataaataaaaaaataaaaaaataaaaatttgcagtaaattctggaatttattataatgtagatatttaaatgccagcaaaaaaggcagtttgaccattaatgtttctcctaaattttcttcaaacaacaacaatagcaacaaaaagtctgggaatgtgctctgcttttctcctctctatcacctctcccacactccttccttcccttttccttcctcttctttcacatttcccgttctgtcctttccttccccttcctttccctcattttggcaaccatttccaatgttctacagcacttcatgtatctaaaatcaggaaaagaatttgttcatttgcagaaaccgaattgtacactggcctttttcaatagaaagagctttaattcttggaaatagatgcaaagagtcattagaagggctggggctctaggctgaaccataggcataaccccagaacaatatgccagaattagccagcagggaagtttcttcctctcttgtaacctgaaagtgggcagtgaggaagctcccactggaactgtttattcaagaacgcacttccttagatgggagccacttccactgcacctggcacaacagtcaccctactcctgctagatgcattccagcataaactggatgcccttcctttggcaccaggaaagctagtaaccagacggggatagccgcctcagaatatccaacgtgtccctgcccattcttgctggcagccatagcagaaatggaagatccattgtcttcacctcacttctaccttccaaatctcatacaaatgcatttaattgactaaacctaagtgccgcaaatgccatccagaatctgagctgcaaagcagactcagtaatgtagatttttagctctttcagtttttgcagatcatgaaagcacactagaaggagagaagaatgggttatgtgggccaattcaccatatctgtcgccctaagaaccatttcaaagtcgttgtaaatttagtgagttttcataacttctaatgaaatgtctcatgagtatagctttttaaaacacaaaactatatttgttcatgccataagcatttcttgagtacctatcatgtgcaagcactgctgtggttacaaaagtctcccttccagaggaggttgtagccttgtgaagatggtgtgtgtcacaatttagcaagtggaaaacaattgaaatatgtacaaaatgcagtggcagagaagagaaggaagcaattacctaggtcaagggcgaggagtcagtggcctggacttgagcaatggataacacctatttggactcaagagaagtggacttttgaagcccaaggagagcatatgcaaaggcacagaggtgtgaaacagcatggctcaggcagggaactgcagctggaacaccactttgtaccttagtaataatctgttctcatagcatagaccaatcattaaaaaaattgttatatgggccaggcgcggtggctcacgcctgtaatcccagcactttgagaggctgaagggggcggatcacctgaggtcaggagttggagaccagcctgaccaacatggcgaaaccctgtctctagtaaaaatacaaaaattagccaggcgtggtggtgggcgcctgtaatcccagctacttgggaggctgagacaggagaacagctcaaaaccaggaggcagaggttgcagtgagctgatatcgcaccactgcactccagcctaggtgatagagtgagactctgtctcaaaaaaaaaaaaaaaaaaaaaaaaaaagaaaagaaaaaagagacagagaaaaagaaattttattggattccaagaattcatatcctaattgagtcactgaggcatgtacacaaaactgttaagtaacaaaattaggaaaaagtgatactaaaatatttaacaactattacagtcgtgagcacttaactatcagaaaaggatagttataaaggatggttataaacaactggtctagctatatcggtgagtacctttacatagcagccctgtttgaatatagcctaaaggtccctgggcccatggagtctttggatccaaataaatttgcatagtcatcaacggcacagaatttcagctccacctacacccagagggccttcagctttacccccccttcaaaaaggctcgtaaggttttccagggaatccctgaaggggtgcctcacatgtgcacgttttgaacagaagtatgttctttaagtggctggctcttttaagggcaggtatcaaactccacgcctaggtgatcaaggccagtagggaattaggaggaggaacattcaccactctgcagtcagaaccattctggcaccgagtattggaagccatggaagatgcaggcgatgtcatctttcatgtggttataaaatgggaaggttttctgattccccttgcaggacgtgcggcaggggtgtggctcacctgtttggtcccctcccccgccgctgctcaaacccctgagggaagggggagcacgcagacggaaaggtgccagagcccaagtgggcatgtgttatagtgagctcctttagccttgctgtccggggacagctgagtgttaacctccccacctccattcttttccagagtactggacaaatcaggtcatatgaactgtttgaaaggtaatgaatgctgagactttgttgaacagtggaggtgactttcagcgggatggggagctggaattccgggaaggtggaggggtgtggggataatcttcccctggagttccgccgttctggacgcaactcctcttgatgttcagacgcctcttccctccttctctgccgtgctgctctgctgctctccaccactctctgccgctctctgctattctctgccactctgttcctctcgacattcagccgcttgtgtgtgtgcccgctaaggtctcaggtttatatgggcacaggatgggggggacgtgacagctagagtggtctcagaaaatgcaacattgaggcgaaaacaggagtgcctgttttcacttaggtccgagggcataaggtccgagggcataaggcccgagtgtggagccctcgccggggaccccactcttctctacccagcacttccctgtcccccttcccgttatcagttactggcattctcaaggtgggttccctcaaactggagagaggatccttcctgaggaccatgaacagaaatcatagacaaacggaagctgaagccagtgaagaaggcagagtctcagacagcagccaaaggggcatggcctgtgctgggagcagctggaaagtgaattgaaattccaccctgcctcctctacctgagctgaggaaataatatgtcctgactagagtttaggccagtgttttcaaaatatgttgcttgggtatatatgcatctgaataatttaggggacttgctaaaaatgtgatcaattttatctctctttcctctaaagtttgaatactactcaagaccctttttgtccaaatgcctatggaaattcacagcagattacctccattacatctactgctttttactgttatttaattgcttgatgggtatgcgaggtccctatggttttgttctacagttacattgcttgagtatttcaaaactgggataaatccaaatttataaatgttttataagtctggtacattcttaaattaaaaatttttttacaaaaaactggtcaatggaaattaggggaacaggccatgcctgcattctattaaagaataattcctatgtaaaactgcaaacagatggtattatatagtcttagaaaaatggtagggttgatatggtttggctgtgtacccacccaaacttcatcttaaagtgcggctcccataatccctatgtgtcatgggaggaactcagtgggaggcagtggaatcatgggagtgagtttttcccatgctagtctcatgatagtgaataagtctcatgagatctgatggttttataaaggggagttctgctgcacaagctctcttgcctgctgccatgtaagatgtgtctttgcttctcctttgctttctgccatgattgtgaggctccccctagccatgtggagctacaagtccattaaacctctttcctttataaattacccagtctcaggtatgtctttattagcagcatgaggacagactaatacatagggtgaaacttttgattatatatgtaaatatataaaaatagcctttccactaataagacttctttctcctcagatatgaaactatccatgaagaacaatattatcaatacacagcagtcttttgtaaccatgcccaatgtgattgtaccagatattgaaaaggaaatacgaaggatggaaaatggagcatgcaggtaaatccaaacattttcccatgcatttttattattagctacagttctttaatttaactagatttaatttcaatttagctttataatttgtaaccttgaactttgtaatgtatttagcaaatttatttacactttggaactgcataacttgtctaacaaatgaacatagattttatttatttatttatttatttatttatttatttatttattttgagatggagtctcactctgttgcacaggctggaacgcagtggcacaatctcagctcactgcaacctctgccttctgggttcaagtgattctcttgcctcagcctcccaggtagctgggactacatgtgtgcaccaccacaccaggctaattttttttttgtatttttagtagagacagggttttgccatattggccaggctggtcacgaactcctgacctcaagtgatctgcctgcctcggcctcccaaagtgttgggattacaggcatgagccaccatgcccagcctgaacatagatattattgtggtcacttttttggaagcatctattaagcacctatgccaaacatttctttagtcaatggcagggcttttcctcaagtgacattttgaatctaaagagatgacattgccatagatacatatgaaaagtactcagagtatgaaatgctagcaatgtgatttaaaagtataatttaaagtgcttaccctataaatgaatataatgtatatgaatgtggttgaatttacttttagtgggacgaaacattagttagaaaactagttcacacaaaggtataatatgatctaagtcccagatatcacacttgctatttgataaatattaacatcaaccaatgcatcaaacaataggaatgtggaaaacctagaaactagtttcttagttaaatgcattttactgaattatgcacatattttatataattctatgtattttgtatagttctaactttatgctaactaaaaattgttatgtgtgttagtttgagagggaaggaaaagaggtgaggcaattgtccccctagtgaggaatgttgcctctctgcagtggttgaaaacattaactcttctctctctgcctcctattggactgtagctccttttctgaggatgatgacagtgcctctacatctgaagaatcagagaatgaaaaccctcatgcaaggggttcctttagttataagtcactcagaaagggaggaccatcacagaggtgagcagtatgatccatcccttggtgcttgtttttaaccatttatgcttaaggttgcagtgttttgaatttttgcaatcagatcatggtgatgaccttgagcagtaggatagaaataactcccacatgcttagcgttccaataatcaaacactaggcataaatgggtttgtaaactgttgtttcggagcaagctcggcaaatgcctctgctatctacacacaatgtgggatctcaggaggaattacttctgttccttacccatgccgtctcttgggaaatattgccactgcccgatgattatttatggccatggcgttccaagttgtaaacactcttgcttcattttccctgagacccactggggtctgtcccttaagaaacccagtcctttctgatttcttgtttctctctgatccttctttcagggtcctgaagcaagtacatgtgagagggttggctgttattctctaaaatgctccatcccttttggtcctacttttaggaaatagagcactggagagaggtgctagaagagaaaagcaaaaatatccttagtaggaaataaagaagttgtgaaaacttcagataccggacttgagattgcagaaggggtgtggtgtggtattggtgttggagctggggtttccacctgttttacataattactctttctttacttttttttcctttttcttatttttcttcccattgactacctccagccttcccattgtttttatttagcttttctcctcatcttactttccctaacagtcttaggtttcttgttgggagttactggcattgaggttggttcacttaagctaattcttggtatgaacattgactgatatgcatttactaaccatgtccattttcataatgttatgaagaaatacccgagactggttaatttataaagaaaaagaggcttactggactcacagttccacatggctggggaggcctcacaatcatggcagaaggcaaaggaggagcaaagtcatgtcttacatggtggcaggcaagagagcatgtgcaggggaactgccctttataaaaccatcagatcttgtgagacttatttactagcacgagaatggcatgggcaacacccacccctatgattcaattacttcccactgggtccctcccgtggcatgtggggattatgggagctataattcaagatgagatttgggtggggacacagccaaaccatatcactatgtttgttcaagacactggcatttggcaagtcatgcttcatggaggctcaggatatacttttatgctttatgcttcataatatgtttttgaaatatctatcatctacatagtctttagtaatgagtagaaatggagaagaatttgttttttcagaccatttgcctaccatggacattatacagatggtgactactgtgatttcactgcatgtttttcatttcccagggagcagtacctgcctggtgccattgcactttttaatgtgaacaacagcagcaataaggaccagtaagtatatttacaatagaaaaccaaagttttggttttaaagaaaaccagtaaaaatgtaggaatatatctgaatctgttatagaggaaacatttattaatcaaatgatctaatacaatggcaatgatagtcttatcattttgttgaaaagtagtgttcattcatttatttgaatacatgtagaaaaaatcatgtctatagtgttcatgcagttgactttctctgtgaatagagtgactgacaaaaataagtgaatttttgtcaggaaatattactcctttccagtttgagccaatgtgtcttaggtgaatttcctcaggagacagtttctgagatggaggcttgtatgcagaagtttgttgggaatggtcttgggaacaatatctggaagggagttgggggtcagtattgggcagagggagaagtcgaacttcagagaatagagctgatgtacaatgtgattctctggggatccctggagcagggatgaccttttagagttgtccctatttaggtaatagacttgggcctttgttcccatgcacagttattggaaaaaagttggccctagaagatggagcataaccatctggatggagcatggtggtttccttcagccaaggccagccaagggagaggaaaaactgagctgacagcaaccaacactcttggcaagtggggaatgagtgcctgaattttgtgcaccacctgcatagccactgtatggcccaaccgtgtgctgcccagatccattttgtttatatagaaaattcaccccatgtgggaatacctactccaggatcctggttattttttcctgagaaagcttataagagtaaagttaatgggattaaactaaggtctctggcagttgcaggtggttttgaggcctcaaatgaaattcttcaccctctccgcttctactcattctagggtcctctcacccttagccagcacatctgctggtctagatgacttagctggtggaacagtacagacactcatccctgaagaacttgagccctgggtcaccatgcccttcttgagtcatggctacagtacttgcccatttaccaccaaaactgggctggaaaataccaaaagaccacctaggtgcaaatacatctcccctccctgcattgtatacagcactgcctacttctgatgatcacggtcaataacttttgccagtgtggtgactctcttccttgcctgttgggcatgaggggaccaaagtggctggggagtagccgtagcttaatgtttaatggaactctggcattccctggcagatgcatcacccctctggaagccaggacctctagatccatagatccttaagttgcaagaatgggaaacatacctttcctacatttgtcacccctacttagaccccatagttcccagaccaatgcattctatacaggcatagagaaccatacaatgatcattgttttagcatatatacagtatcctagaggatggcaccttttcttcctagagtataaactctatgatagcacttcagctgtggtttcaaaaagtccctccttaactatcatgtcagtagctgacaaaggtgtgcagcttatgataggaccactggatcccaaactcaggttccaatgccacatttttttttttttgccttaaagtgggtccttggtccaaagtgatgttaagcaatatttcatatatagtgatcatgcttcatatgcccctaaataatggcactggtcaaagccctgtggcaaaaaagcaaatgaatagtcataatatatgtcagttcttatcaatatatttgatgccccttccatggtgtcaggagtccaatttagttaacttgccatcaagtgactgattactttcctcaggagaaagcactgttttggagtcatagcattggtctctgtaacaggcatgttcactacgagcaaaaaacagacaaataaaaacaaagattttcaaactttgtgctcacactcataatatgtccattcagtctgcctcttctgaaatattttccctgatctttccatcgttttccatccaggtccctgaccaaccagtcaaggcatttgtgactgcccacgagtccttttacacatgtatattcttaatttgggctatttctttttccctttttttttcttttcttttttgagacaggtactcactcagttgcctgtgctggagcgcagtggtgcaatcttggctcactgcagcctccatctcccgggatcaaatgatcctcctgcctcagcctcccaagtagctgggattacaggcgtgagccaccacgcctggctaatttttgtatttttagtggggtttcgccatgttggccaggctggtctctaactccttggcctcacgtgatcctcccacctcagcgtcctaaagtgctgggattacaggcttgagccatcggacccagtctgggctatttctttttccatacaaactagatgactgtatactgcttgaagctgtgccattggggaaattaacctcacactttcaagaccacctctaagtgaggctgtggtgcagacacagaccattttggcttgcatccacattctaaactgacccatctatgcaacatgctgtatcagctccttctaaagaaccccacatatgaccacaggtgggggctgataaataggtgctgagtggaaaatgacatagtggaaaataaatggaaatttccaacgtggaaatgacataaagaagggtactgaaggccgggcatggtggctcacacctgtaatcccagcactttgggaggccgaggcaggcagaccacctaaggtcaggaatcgagaccagcctggccaacctacatggtgaaacctcatttctactaaaaatacaaaaattaaccaggtgtggtggtgcacgcctttagtcccagctacttgggaggctgaggcaggggaatcacttgaactgggaggcagaggttgcagtgagccgagattgtgccaccgcactcctgcctgggtgacagagcaagactcctcaaaaaaagaaagaaagaaagaaagaaagaaaaagacgaagggtactgagccacctgcctgggcagcttacttatttgctctgattcatgctcaatcccagatatcttacttcatcatatgacggattgatacattatgaattgttgtttctgacagaatccatctcataatgggcattctttttatgtcccatggttaggtaatcctatttcagggcctgactaacagaatgccattgatgcagatatagtggactaatgtggtgctctgagaaatgtccacgtgatccaggtccctcaaggctgtcatgacagtaggaaagaaagttaatatagccttggaaaagagtgtaggtgtgtacagtttgttatcccctgtgagtatgagctatgtctgatcctctttcctgatagtaatgaaaaatgacattcacaatgactgacccagaaccttaggtatgcagtgtatatcaagtgaatgcattgttttccacatatgacacagcagctgcaattggggctactacttggttgattttgcaattgtctattgctatccattaggatccatttggtttttgcaggggtctgatgatgaattatgtggggaaatgaagagcgatcaccacccctgcatgcattaggtctttaaggatggcatttctttttctccccaggatgcaatgttgcttttggccagaaggtgggaagcagcttaagggcttctcctcggtcttacacctctttcctcacaagccaaggaactagtggggtaggggtgggagttgtgccgatgaccaactatatacatttcccttttgtattcaggaattatgtacattacacttatacatttaggaactggagaaatgatcacagagtgggtcactgtgttattttccacataggacatgtcagctgcaattggggctactacttggttgattttgcagtagtctctctgccatccactaggatctatttggtttttgtgggagtcagatgataaattacatggggaaattaagagagaccaccactcctccatgcatgattttatacaattatatacatttctcttttatattcaggaacttatatacattctacttttatattcaagaattacatacatttcacttttacatttaggaactggagaaatgatcacatagtagtgggtctgtggacccagtgggaaacaccataagtcatatctcatccaggaatctattattaccagtccatcatatgcccctcaagtttaacagggggccacgatgatgcttcaatccctaggtgtcaacatcaacatggatcctgtgccaaacagtcttcaatgtatctaagtattcttttttcccccagagtatagtgatctaagtaatggtcataggttctttaggagaaagaccagggaaatcgttactggaatatgtttgtcatactgttgcagagtctttcttcatgggtcttggcttctcctctagtcattggttttaggtctaagtactggcttaggtctaagtactggcttaggtctggaactgttcaaaggattctgatttttttaaaatttaaattgtaatgaatcaatttattttttgagatggggtcttgctatgttgcccgggctggtcttgaactcctgggctcaagtgatcctcccgcctcaacctcccaaagtgctgagattatagccataagccaccatgccctactaggattctgatttttttgatggagtaagttgccctcaacctcctaattattcattcctgattcattttggttgtatacattaaataataccctaactagctaacaggcttcccatctgtctaggaatactatattctattaacctcctccatagctgtctatgggttaagacccttggttaccatccccaccttaatgctcattataattactggaccaaccttacttctgatgggtaagcactgccattagtctcagttatttctagatcctattatccctattgctctcagagaactcagttctgtaatgacatttcccaccatcagccctggcctacagaggatagtaccactgaacttctcaaagctgataatatccctctcaccagcccattccacatcacttttgcatcctttgagccctctttgggaacataattagctggtaggctatcttccaaacagtgtatccacttcaagatgccacttttctgagtcttttgataccttcctccaccatctgccatggtgttaatgtttatttcattttgtgtggaccattacctttttccaggtttccaagagccatttgagtagtgtgtcgacatcatccttcaggatccatgctaggctgtcaaatcttgaatagaagtgtactcccatagcagtaaattcttccttatccaactttattgttctgtccctgtttgtacgtgaccatcttagatgttaagcctcacctcacttgtcaatcttatcttccatttcttcttaacagaggctttccacttctgttgggtcattcttacccagattgagtccattgcacttagaaattttcctgctctaacatcctctctcttcttctcaactccaagtcttagtgatactttgaggcctagctttagaactacttccctttaaaagccttctctgactatcctagtggtaacaagatgcctgttcattcatgtctggctaatgaaatttcctaagacttctgagctgacaatggcagcctgctataaccctaggtctgtctgacttcagaatctattcccctgctgatagagaaagctaatcatagaaagaggcactagttacacagtctccactcaagaagaaattgtatgtggaaaaaggtggccttaaatctggtaaattattctaataactgagattccaccatattaccagacagcttgttgattactcatgaaaaatgacttcagtcagggttatcccctctaaagaaaattgatggcattttcttaaaattctgaatgattttattcaaggataaatgtaaatgatgtcaagaagcttaaattttaaatattatttttaatacattaacactttcgaagaacactcttggggggctgttgtttcttaaatttttctccttggttttatgcctttattcatctccatttgtttctatttcccaaatctattagcttagaagttcttgtttattatctggataattgtctgccccaccccccactttttggggtagaaacctccagtaagagaccagatgggttttgagcactggagcaggtctttgaatgcaaagctgagatttttgctcaatgaaaaagaaagtaaataagagtggaagactgtgattatgtgacagatatattatttttttctttagggaaccagaagaaaaaaagaaaaagaaaaaagaaaagaagaggtaagactttggcaagaattaccccacatttttctgcccataacatttctgtattttaatactacttgcttaattttttcagcaagtcagatgataaaaacgaaaataaaaacgacccagagaagaaaaagaagaaaaaggacaaagagaagaaaaagaaagaggagaaaagcaaagataagaaagaagagtaagcacttttagtggcattgaaatagaaggaaattgtgatgggttttagatgcagggatgattttccataatacaaagtagaaagaaactttatagtaaagagccctgtgtaaagactaaatgtctttaaatattgaaaaataaacatttaacataaattatcagaagtgaattaaaactttttccaatttccctaaaattagcaatggtagcattattcttaattctctcaagaattttcactgctagggttaattctcttccctaagcattggtgaagataacttatcgctgagaaatatttaggttccaaggaggattaggtttctaggatcctacaatcattttaaaaactgaaataaaaatttaatttttattttaattacattcttataaagagtgtgcaacctagatcccttgcacgcgcagatcacaataaggtttgtgctcctatgagaatctaatgccactgctgatctgacaggaggccgagctcaggcagtaaacctccctcaccctgcagctcacctcctgctgtgtggcccgctgggttcctaacagaccacagaccagtaccggcccacagcccgggggttggggaccccagatctatgccactattccctctcagtggctgaggtatacaactgactgcagcatcgcagtgaaaccagggctttagtaaaaacctaatgtatgctttaatataagactggtcttaatgagaagagtggcattgttttacatttttacacatctctttaacatttagcttaataaaacatagctggcctctcaaaaaaaaaaaaaaaaaaaaaactggtagttttgttatctatccacccctcactaaccactttcttatgactagtgctcttatgccatgctaatcttcacactgcagagtgagcttctccagcttacttccatttcattaattgtggttgatgggcataacgatgtttaacatggtaaataaaaatgttcttgtatcttggtaactatcccctttatttctaattgccgctagggagaagaaagaagttgtggttattgatccctcgggaaacacatattacaactggctgttttgcatcacattacctgttatgtacaactggacaatggttattgccaggtgtctataattttttttttttttttttgtggatctcaccccatttctagtttccaagttcactgactaaacaatttgacttagagccctttaggacacacctcctttctctactgcaggtggtaaagagaggctagattattctcagtgtgttttcctgggatcaggaggaagtgcttcagttctcaatataattgggtctgcagtactgggatgcatggaggggtcggggaagacttttattttttaatttttttaacttttatttgacgttcgggggtacatgtgcaggcttgttttataggtaaactcgtgtcacaggggtttggtgcacagattattttctcacccaggtgttaagcccagtacccaatcgttattttttctgcttctctcccttttcccacctgccactctcaaatagaccccagtgtctgttgttagaggggaagacttttaaacttttggttgtataataacttaattagaacatcgggagaaactattttctttgacctatgagaaaaaaatgttgccaatagtggaaaaagatcaaggatttaatgtcttttagatggtaaacatctcactcatccaagaccaagcacaacttcctaaagcattttgggtacagatagtcaatacgaacctggtgatcgatgtgtttcacccaacatattttgattttagttttaggccatttatttttttaatttatttaaagatttttttgtacaaatttatcgggtacatgtgaaattttgttacttgtatataatgcatatagtgtgattaagtcagggtatttagagtgtccatcacccaagttcaatacatttttgttaagtatagtctgctatcaaacattgaatttattccttctgtcttactgtatacttgtacccttcaacccacttattcttattggatgtttttactaagctgactagtatcatggaaaggatgttggaattcagaagtgtgaggatcgaaatccaaccactcagggaaaatatcgggagagccatggttaattaaaggactctaaggacctctcctagcctgagtgtgctgtgcttctcatcatgataaagaaaatatacaaagagaacttttacttaaattggcccccatttcttttttatttatacaagtgtttctttttttatagagcatgttttgatgaacttcaatctgattacctagaatattggctcattttggattacgtatcagacatagtctatttaatcgatatgtttgtacgaacaaggacaggtaaatatgttcagttttgaatattttaaaatttcatgcttttatctctagcattgtaatttgacatttcctaatccaagtattcttcaaagaaaactcacaaaaatctgttctagagaaaaaggcacaggtgaaggcaagagtcacgatgtataaactcataggcttagatgactccagctgattcagaggaagttaccaggcaactttttgacaagtagatgtggctttcctccattatcttgttcattggttttgtgccaggcgagaggaatagagagagcagaaatattctgccagctacagggggaagctaacagggagataatgtaaagagtcgtggggaaaaatgtcattgtcctcagcagagccatattcaaaattttataagaaggaggaaaaatgcacataactcagctttgtggtttatggtgagatattattgaccagaggggatagcttctgaagtatttctgttaagtaggtagaagctaattgtttctacactctcacatgcaaatgtaaccattatacacagactataaccttttaagaatcattacgtaaaattgaacattctctaaatactagtatcctggaacaatgccctgtcatatttgtagctttggtagccagtttaggagaaggagcaaatccctttcctagtgtaatgtatcagagggctgaaatgctgggtttaaaacacacaagcccatggtaacagcataggagggaagatcccaagtgtctaagggagcaagaatgagagatgaaaatgcagcctcaaaggacacttatgcttcacatcgaaggggtaaggcaagaatatgcaaaatagacagcacagggcaagtacccaagcgtccacgatagggctgggattctgacaagacactggcgtgggctattaggcacattgctagcgtgttcaggaaaccttccatgaactgtgtacggtggggaaaaaaaacaacaacccattgtatgttactatgctctcaatacaacacaattctggtgaccaatatgtatatggcgtttcctctacacaccaagcaattctgtaacaccagctgggttaaaatttaactgaatttggacactaacgggagttagaacaggcccaacaggttaagggctcagtctcccaagatgatcccccacttcagatgccagtcgtaagtctcaggttgtggcttgtgcttctgactgaccagctataaattggagttcccacagctcccttgtgggtctagtaatttgctagcacaacttacagaccataggaaaacacttatgtttactgcgctattatattaataaagggtatgataatgaatacagatgaagagccagatgaagagatacatagggcaaagtcgggaagagtcatgagaacaggggcttttgtccccatggaattggggtgtggcaccctcctagttcatagatgtgttcactaacctgataatgctccaaaccccatagttcagggatttttatagaggttttatcatggaggcatgatggactattaactcagtctccagtgcttctccctttcctggatgaaggaggttggggtaaaagttccaagcttctaaacataacttagtctttctggtgaccagccccatcttggacctcaccaagggctgcttcattagaccaaaagacacttttctttttctttctttcctctttctttctttccttctttctttctttctctttctttctttcttctttctctttctttctttctttctttctttctttcttttctttctttctttctttccctccctccctccatccctctctctctctctttctttctttctttttttctttcaaataatatcatagagacttaagctggtctcaaactcctgcactcaagggatcctcctgcctcagccttccaaagtgctgggattacaggtgtgagccactacacctggccagaacaaaagacatttctatcacccaggaaatatcaagggataaagagctctgtttcaggaactggggtcaagaaccaaataccacaacaaaagatggacttagggccgcgctcagtggctcatgcctgtaatcccagcactttgggaggccaaggcaggtggatcacgaggtcaggagatcaagaccagcctggccaatatggtgaaaccctgtctctactaaaaatacaaaaattagctgggcgtggtggcacgtgcctgtagtcctagctactcaggaggctgaggcagaagaattgcttgaagccagaggcggaggttgcagcaagacgagattgcaccactgcactccagcctaggtgacagagcaagactctgactcaaaaaaaaaaaaaatgcacttagtaaccatattgcttaggaaattacaagagttttaagagttctgtgccagggaccaaatatatatatatatatatctcacaatatcacaagaatgctactcatgaaaggaatggctttacctggatggtgatgatagaccttgagagatttgtacactctcacttttgcacttacaaaatttttctttttttctttttttttctttttttttttttgagacagggtctcgctgttgcccaggctggaatgcagtagtgctatcatggctcactgcagcctcaaactcccaggctcaagtgatattgggtctcagcctcccaaagcactgggattacagatgtgagctgtctggccaaaattttaccttttatttctacagcagaatattttctacagccataggtttattagtatttgtattttattacattgttaaaggcatatttattgaaaatgaatttttctgttgacctcaacaaagttaattgacagttattcacaaaaattcacaatgacataaaaaggagaaacactgaattgattttattttctattttaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaactgtagtgaaaatgagttatttgataatttagcaggcagtttaggatcttgcagaacttcagggtcattttaaggaaaatcaattatttttgtagtctaggactgagaaagagtggttgagagaaactttttaccaataaagcatgataaatcagactttatgaatatatatatatatacacacatagatatagagatatattacattgaaaatcataaaatgttttaggaatcttttatattaaattttaatttttttctgattactaagacctgacagcagtggctatttttttacttctctgcctggccagcagtaagaaaaagggataaagtaataatatttctggacgattaacaagggaaattgtcataatgttaaaaaaggcgacttgaaatttctggagaccagcatgagcatcacctgggagcttctcagaaatgcagaatcctgggctctacccctacctactgcatcagaatctgcatcttagcaagtgtttcatattcacgttgaagcttgagaagcatgcatgtagagaaccaggaaggagttaatgagaggatggtcctagaaaagaaaaggaaactatctggcaagtgtgtggatgtggaaaacattggtaatcaatcagccatcttctgctgaacccagatgtggctcaaaaaatctttcttaacacagatcactagaagatttctatccctatctataatgacatgattaaaaatggcttcttgttaatttgacatttcagatacttaaacagaccttgcttggggtatgctgatggcatattttattctattgtaccagtagaatatccattgaactatacattatgtctttgaagtcctgtgtttccattcatcttggctgttccttcaatatcttcactacagaaatgtctagtcctggagtgggtgcgttgtatataataccataacgtatttctctctgacacaagttctccttttcctttctttttcttcttgttcttgttattacttcttcatctgcgttttgttctttttctctgtgccatttcttgcctgttataaaaacctctaagacagtgtaaagaggcttactggctacccataccaggtagatatggtaagatagggagaatgagggttacatacctggcttagagctggctcccaagaagaagcacccctaattacagcatccaggactagggtgaatactttgactctcatctgggctagagatatagccaaggattctgatttggtgacccctggcccaagctctatagtcttgctgatgcttacattggacaggtggctgattcttggctcaaagtcttggggtaaggcgaatttagccaactattctttttttcgtgactcctccatgtagagaggaatctgatgtgctgaaattgcactgtgggctttagtttacaggcacctggggtgcaatgcagaggttcataattggattccagcttcatcagggagtttttttaaagacaggaaacatatggctttagggaaattcatgataagagtgttgacttgggtacatgtggatgctaaagcaggaactcatcttttagcaacccagacaccagccatattccaagttgattctagacgccaattggtcatccagaactagcatcttaacatatgaggactagaacaggtttggcataaggacaggagtgagggtggggaggtgggtaggatgaaatctgaagatccttaatacctgtgtctgagaggagctgggactcagagatggtagatcagtgagggaatagaaattcaatctctagtcttgccaataagtctggtgcgtgtttaccctgttcttctgccaactctattataatatagagttctcataggaagagactgctttaacattttgcatacattaaaaaaaaaacccgtttccaacttaaaatatggtgtgattaagcttcctacc

SEQ ID NO: 17421 - DNA, 6172 bp, Human
gcagaaagggtgactgaaaattttgcaaatgaacatgacttcccatgaagtctaatgttccattcgctgccatggtccaggggactcccaccagcttccaccggcttcaacaggatctccactagagagcccagacttatctagtcctgtcggggaaaagggagaagaggccttgcaggagaaagctaacagaaaattcgttacccgaggtcctgcctgcagtttcaaatagcttccagcagttttacaaaacacatcctttccatttcttccttttaaatgtttccctaagaacgatccatttaggtgctataagtcctcagccagggagtctctgggacactggcattcaaaattttaaacttccgccccaaaaccaggaacattccaagacagaactcttttagggggccatttcctgggggtgggggagagggcttggaatcaatgctagattgaaaacgttgtaatagctttgccccagacttaacaccggttgggcaggaggagggtaatttttatttagccgtttctccgatcatgtggggaataccattagctgttgatagcgggccatgtatccgaggaaagcctgagctacaaggcaaaggcatcccatctggaacaaaatcagaaagctattggcaaaggtaatcaatcaggccataaatagccatttacccgcttccttttcggggctggaggtgggccgggagccctccaagggtgagctgggcaacttgtagagcaaggaatatgccctccgctgccggcgccccggccgcttttgtctgggctcccagccgggcttccgaggctttgtaccatggatttgggagtgacaatgggcatttccctcagattcaaggctgctcaacctcacctctgtagggggaaaaaaatcagaagggagtgtcccaaggacctagccattcggccgaattttttagacattttgggagtctcctccgaggcctttaagtgcgaaccgcgcgaagcggccctgcccggggagactcgctgaggcagggctgaggcggcgggcgggagcaagctgctctagcatttgggttctgccctgtggcgtgttctcttccagggcctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatcaaatggagcccagacgctggccctaaacattgtgtgcctgctttctctgcctctctgcaaaatatcacactcaggatatttctcctctacccctgggagtgagacattgttaaaaattcagggcccttccacctgacagatctctctgatgtgtctctgccttctctgcctcacatccctttgtgtaggcagatgcagcagcacagaccctgtggggggacattggtgcctccccaagcctggttcaaggtcctccacgaactctgtgcttgggcccagtgttagccttgcagaagcgcccagaagagccagcaggccccagaagccaggcactttcaggctggggcttgggtacacagcaccctaaccttccctgggctcctgaagccccagatgccaaacccctctccaaacaagggaaaggccaactctacactctggagcaactgtcccagctcggtggggctagctggctccgggaggtcccagctggtcaggctgtgagcttctgctcctccccaccaaagccccaaagtgaccttagcgatcaaaatggtcaaggctctcctccccagccacctccatttcaccgcccccttccccccacccagcttctgtgtatgtttagcccccagcttggccctctgagggctgcattcaggggctaaaatgaaggtcattgtaagtgagggtttgggtgagcacagcatttgcaggccaaagaggcagcactgccaagtggcctgagctgggtggaaggtgggggcggtggcagagatcttgggggatcccaatgaaagaggggacgcgaagaaaaagcataggggggctgggagggaaagccaaggaaggcccagatccggcagaaggtgctgcgcacccctgccactgtggccagctgggtacctagggctctttgaaaacaggaagagccgaggtgtcataaagccatctagcgggccagacgtctggaggtaatgagtttacgacaggcccagtgctttgctttgaaaccatctcattttgatgtttgtgtttgtgggagaaaaggaaaaatgcagacaaaactgggtcttaaaatctagacaataaaatataaacaagactgcgttggaccaagaaggcaggggcatgggagcccccaggtgaggtgtgagcacctaggaagtaaacatgaaagaggtaggaaggaagaggtgaatgaatttctgatttttgaaatgaaccaggtaatggaagtagcctaaggagatggcattttacaatattttgactatgaccacggtttagctggttctttagaaacaaacaaacaaaaaaattggcctgttatctggggatagggtggttagtgatcttaggtcatttacccaggtgagagtctcccagaagtgtggttcgcgggaaaagatgaagttagatgcctattcacaagaatctctggccctccactccaaactttgaagcaaaatgttgttgaaatttatgtctattcacttataaaaaaatacaattgttacacctaaactggaggaaagcagttttgaagatgagtaaaaagattaacctaacaggaaacacttaagccaattgaatagtcattgcttttaaaaaaaattctagtggaatgcttagttcaatgacttttgatatatatttttaaaatcccatttattgtccatagaaattccaacaaacagaagcgcaaagggactttccagacagccactcagagatccagcaaaaagcttttgatttggcttcgattccccccaaaatcggccacctaagtgggccccaaagcattaaagttacagtgttaaagtagcaaatattcatgatttaatcctaaaagtaacagctgtaagagaaaaacaaaaacataacaatacttgatttctgtaatttcttggttgccaaagtgtctggttcctctggaaaataaaaagcctcttggcagttgatatttagaaagttgtaggttttgttaaatctagcctgtcctataattgttttaaaaggca

SEQ ID NO: 17422 - DNA, 164061 bp, Human
aagcgcaaaggagaaaagtggggggggggtggtggtgaggaagctggagagaaaaatcaaggcaggttatgaagggcctctgttaaacagtttagaagggtattgaaagtcaccaaaaggatttaagcttaagaagaactaattaacatgtgtttttaaaaaagattgctcaggaactatgtctggaaaagaacaaggacttgacttacattaaggtaagaagtggaattataaaatctggggcccaaaggaattggagtgagttaattcctcccctttaaagtgtctattttcttcaaagataaccactatatcatctctggggctaacattctctggccctttcccactgtctctggcagctcccgacccaagtcactacagttacagcattcccttaaggaacacatgcttttccaacctgctgcaacacagaaagcacatgtaattttttattttattgtattttatttgtttttctgagacagaatttcactctgttgcccaggctggagtgcagtggtgtgatcttggctcactgcaacctctgcctcctgggttcaagtgattcttgtgcctcggcctcccaagtagctgagattataggtgtatgtcaccacacgcagctaacttttgtatttttagtagagacggggtttcaccatgttggccacgctggtttcgaactcctgacctcaggtgatccacccgcctcagcctcccaacgtgctgggattacaggtgtgagccaccgtgccgggcctggcctttctatctggcttttttgatttgatatcctagtagagcccactattaaaatttccatctatagaaacaggaagtcaggaaaggactggagggaatttcggcaggttaatgattacaacgggaagagaatacaattattgaggtgttttgactcacttggtcatttcctgagaaactctttgcttgaatttttccactcttcaggtgaagatgatgacactgtccaggctttcaggagtccaacctcttagacaataagcgacatactctttggtaactgcagtggctaagccaaggaataaatatgcataactacaacaaacaggtacttgatgagaacgttatctagagctgccagataatttagaccaagtgcaccttttgttgtaagaagctggtatgatgtccacatagttttcagggctgctgttccctctaagaagaaggaatagtctttttcctgaactactctctctctgaacttttaggctacaattatgtcagttcaaagtgggcagatttgccaactgaaaaaatgatgacacgcagcttcccaactctgtaaggacttttcaggtctgtgggtgaacgtcattcccgagcaaaccaatgccacaagattagtaggatgcggctcacaagaaatgtttacaatgaagggcatcacagactgcaaaccaaacagggtaggaggacacgggaccatttccttttcctgtctccatctgactctggaaggcggggacaagacatttaaaaccaggaccactccaggaggacagcacattagctactgccctccagctcccttcagtgttgtttccgtaaaggacttataaactggcgagggcggtggcttccaaaagcgcacaggcgtcccttttccaacttggtcttcttattttcccttcctgctccataactacaacgtgtttctgttcgtaatcatctcggcttttccttacctctgcttgtaagaaaagtcctttgcgccattcccctccaagccccagggaagggcctggaaagcgcttacacctcagacccagtgtcggtcagccgtcaaggagcgagcgacgtgggaaaccctgagataggacattggcccggcgctgggctcgggtaacgatgcggggcggggagcgcgggcggccggggagggcggcggcccctttaagagcaggccacgccccctcccctcctcccgttcgctgccagcggtcggtggcggccgctacggtgctgacaagatggcggctggcggagctgtcgctgcggcgcccgagtgccggcttctcccctacgcgctacacaagtggagctccttttcctccacctaccttcccgagtaagtgccgggccttgagctcgtgctgccccacccttccgcgtcagcacggttgggccaggggtgcaatggagggcagccgagccgagaggcccaggcggggcctgctgagggggacgtgcggcctccggagtcttagttcagctgctgagagcgttgctcggcctcgctcgggaaggggttagggtccggagagcgagcccagggagaaggggcgaggtgtgtggcggatccggggcgcgcacaggagaaccggaagcccagcggttctgcgcttgggatttgggggttgaggttgaggagggcttggggggcggacggctctggggcaggaatcggagttggcggggccctgcccgcgggcaaactaccccgaatgtctgaggtcgtccgaggtggtcggcgtcgggggacagttcagtcgattgctgccgggacaaagtgtaaagccgaggagtgtctattccagagtggggtcattaaaagtgattagctctagagtagtgttaaaagtcacggaaggctgaaaagttgtggaatccatctgaatcctagcaggcggggagaacttgtaggattggcagacgttgtctttaatgcctggaagttctgaaaaagatagggagtgggaaggagggacgttaccgaagaatttcagtattacggctcattagaagatgggtttgtatggacacagacacgtttcccagtccggaaactcaaacatagaaacatctggctttaatgaatttgattttcaacaccggctttgtcttgatccctgatttaggtgttaaaaaaattcagttgcattgttaggtttttgttggtggtgtttttttctctagcaaattccttctgaaatgctgaaaatactcttacatagtatcttatttatctttggcttatctttgaaaggaggagcagatctaactccaattttacatgctagtggaggaactggcttagtaaagggttaagatctgtgcagatcctgaagaaaagtgctagttgtccctctaaccatctcacaggaccgaaacgattttatgaacgaaacaaattaatgaataatatattttactgagtattttactaaacaaaaaagtgactagatctgtgaagcatactcaagtaagttttccatctgtatttgagaaattcttcacatttatccaaatttgatttcactggttatatcaatgaagaatctcaaaatggagctgcaactggaagaatctgtcatgactgccagcctcccattttattcaccaggtcaagggttggcattcagtaggatctggcccaatgaagggtgccaagtgacctgtggtttgatctggcctgcgtagcctattcatggccatatccctgattgatgctgaaacccaactttgaatttgagagtgagccagataaacagtccagccatgtagttggagttgaaatgtggccctatgtacttgacctctgatattctgggctatcttgttcttggatctgaagttattcagcttttttctatacccaggctaggattatggacagttgggaattggtgtggcattgtttgatctaactgtagagacatttttctggtcttgaattagcgtatttccaggacgtcactccttaaatttttgatgtaggcctgaggcttggataacacaagtaccatccgcgttatctgttgtatagacattttaagaaagtacatttcaagcaggaaatgatttagtgggatggcaactttaatcttttgtgtcttgttactctggcccctggtttgcagtgggcagaacactagttttggagttagaaagcaacaatttgagattggagaaatacattgctgcaattttctcaagtacatacataaaatagtatttaatacatacgtaactttcatacacttccacttactatatcttgtttaatccttatgacattctattgacaaatgcagtataatttgtatttaaagtaaagtattagaagagtaatctaagcttttttctttgaaggagtatagttgagtattatggagctggagttggagaatattgtgtctgctgggttggtgtgtgccatgcctaaattataaaactcttggctctgaacttctataagcaagcaaggatattacttctctgtgtgacagaagatgtaggaaaggggttgactttacttacctttgccctaaaatcccctctagcagcaattgttgtatctttactggcagtggaaaccatattaaggtacttcttaaacaggtctcattttaggttaaagacatttgttgaaattgtccacaaagtggcaaatatttgttggcatagatctaagcatttcgaggtggcagtaataaatcagtaacaaaaatggtaaacatttatgatgtgccgtccatttgctaggctctcttatgaacatttttaagtgtatcaactcatttaatccttaccgcaatcccaagaggaatctccgtttgccagatgttggaagcaggtagggagaagtttaaacttgcctaaggtcacacagctagatggaaccagaatttgaatcaaggtagtcaggctccacagtctgtggtctttaactatagtgttttactgcttctgcacaaaggtatatatagtacaggaaatcagaactttaaaagagctcttgtattaaaggcacttacattttagttgtgtaaagaaatgtgaagtcattaaaaaaaattgaacaattttatctctattttctttctaaggacttagaattcttttccccttcttccagaggcagaaaaaacaaatatttcccctttcaactctttttaatttatttggactttaaaaatgttaaagcagattcagttatagggaacacatttttactttgagactaaaaaaaggccttttatttttgtgtgcttagagattgcctgtattttactttttttctgaaatttacacctaatttaataattaaatacacttatttaaataattcataaaattacatatactcttatacataaaaatattttgtaaactgctaatccctgtactcaaatgtttatttttgtatctaataatgatgctagttacaatttagtgagcacctaatatatgcaagatgctttttgtatacagttttgtttaattcttggtacatacctgtaagataggtattttatatatgttttgtggaggatgaaactgaggtccatacagggtaagtagcttgcccagggtcatatagttttccagaggcttgccaggttttctgacttaaaaactattgcattgtgactttaataacagtcaccacttattgagtactttctattcttcaggcactgtactgagcatttagcatgtgttctttgatataatagtcttcacaaaaaccctatgagataaatattattattctattttagagctaggaaaagtgagatttagggaggtaagttaacttgcccaggtctaagagttgaaaatgtaagaggggcagggcagggtggctcacacctgtaatccctgcactttgggaggccaaggcaggaggatcacttgtgcccaggagtttgagaccagcatgggcaacacaatgagaccccatctgcaataataataatgatgaggaggaagaaaatgtaggtgataaggttctcatattgggccttttgacttctgttacgaaagctgttcattattatacatggctattgtatatgtctaattgagattacagataagcgctctaaggttagaacagcaagagagggaaaaatagattttatcttgatgtttaagattttagtatactcatatgagaactgggagaaactttgaaagtattttttacatattaggtaatttcattggtatagaatgattcttatcttgtttacatattattgaatgacttagataatttagatgataaaatctgatagatttttaagtgtgtttacctttttcctgttagtcttattacttaaaatcaaatagtacttaaaatagtaccttgtgtcaacatgtgattgattcatggttcagagtacaagtgttatgatttgacaactagaatagaaggtgaatttatttcaactcttttcaaaactaattttaaaatttcacatttaaaaatgaatataggctaggcacggtggctcatgcctgtaatcctagcactttgggaggctgaggcaggaccatcacttgagaccaggagtttgagaccagcctgggaaacataccccatctctacaaaagaaaaaaaatatataaatatttatatatttttattacataaaatatatgtgcatagttatatattattatgttaaaaatatgtaaatatatatatattcttttcttctttgtctctacaaaagaaaaagacagcatctcgtcaataccccatgtctaagaaaaaaatagacactttttatatcatatatattaaaatatattttatatatcttttaatatatattttgatgtaaaaaatgctctatgtttattatcgaatatttgtaaaatatggacccacagaaacaaaatttaaattacccttgatatcactacctaaagattactagtcaccctttaaatactgtttattatcattccagatcttttactgtagatgtatgtatttttcaatttactgttgtcctgtttgctgttctgtatttgctttttcctccttaacatatagtaaatacttccttatgttattaaatattcttctatattgtattttttttctttttttttaaagggacagggtcttgctctgtcacccatgctggagtacagtggcatgatcatagttcactgcagcctcgacctcctgggctcaagcgatcctccagccccagtttctcaagtagctgggactacaggcacatgccatcacgcctggctaattttttttttttagatggagtctcgctgtgtcacccagactggaatttagtggcaccatcttggctcactgcaaactctgcctcctggcttcaagcaattcttgtgcctcagcctcctaagtagctggtattacaggcgtgcaccaccacgtctggttaatttttgtatttttggtagagacactgtttcaccatgttggccaggctggtcttgaattcctgacctcaaatgatccacttgctttggcctccctaagtgctgggattacaggcatgagccaccatgcccagccaaccatgcctggctaattttttaaatttttttgtagagatggggtcccactatgttgcccaggctggtctccagctcctgggctcaagtgatcctctcacctcagtgccccaaagtgctgcgattgtaggtgtgagccactgtgcccagccaaaatttattatggatacattatattccatgtaatgactttatgtcattttgtttaattggtcccgtgttattagacatttaggctttgtggttttattttattttcatttgtgtttcttgttatttgactattatgagtcatgaggtagttttgctttacagaaatttttttttttttgaaacggagtttcgctcttattgcccaggctggagtgcaatggcgcagtctcggctcaccgcaacctctgcctcccgggtccaagcgattctcctacctcagcctcccaagtagctgggattacaggcatgtgccaccatacccagctaattttttgtatttttagtagagacggggtttctccgtgttggtcaggctggtcccgaactcctgacctcaggtgatccgcccacctcggccttccaaagtgttgggattacagccaccacacccagcctggaaaaaaattttgaactcattggtgataaattcctagatgttgagttgctggattaaaggtatcagtttattttccttctatctgtgtagactactctgagttcattttggcattatccttggtaatttggaagaaaacatatttaaatcagagacaggtccgtagagatgtctagaggatgcttatataattcaaaagtgataatgctcccaataacttttttgtttcttccttctctatccctttactttagcttttaagtgaattttgattttattaatcacatatagttgaaaaatagaatatatttattgtatttggtgtacagataatggtggttatgaaaatggatttgaggtcttgttacaataattctgtaggctcctgcaacccagaatttgtgaaccactagtttggaggcatgcaactcccaggagaccggatactattatgcccttccttttctcccttttctccctatcttaaactgagatttaaggacactggccctgtttgggaaccttactggccactgaaagttctgtgtttttcagtctgggactcttagaacttcagaaaaataaaaacactcaagatggaagaaatgtactcaggatgagaatttgagtctacagagctgattcctagaattagatatttgtgacttttggcaagttatgattcttttctgagcgtcagtttcttgtgtagaaatactttttatcttgatcaaatgttgagaggtttatgtacaattttttgggcacatgggtaaatggttctattatttgcgttaacttttaggtaaatatttaaatagatttttaataaatgatttttggcctgatacaaagactttgtgatgttttacgtgtagataagatacatttcagccacttgtggcaatgagtttgctgtatttcagtcattcaaaaatcgtttttggaaatatgaaagattttctagactttaattttagagatacagctatttatagacattttaatatgtataaaatgtttcaaagaatgtacagttgagaatttagagatccctaattactgtttgtttataataccatttgtcagaaatctctgataagagacaatagaaaatttataaaatttctaggtctttataggttcaatcttaggatagttgatccgggtatcttctctgctaccggatttcccagggcttgttttgtgaatggctggttctgtagattgttgcttattaaggggtggtcagataaagctctgagaagtccagcagtattaaaatctattaatatgggggacttttgaagaaaatattttttaacatctttgcacattgggaagatgtttcagttagaaaatttttttgttgttgtttaatgagaacttcaggacttggttacgaatatttctaaaaatctgtgaagtcaaagtaacattctgtagaatactgtgtatgtatatttatgctgtagataaacaaagatattgtttgtttaatgggttttgcttatgatgaaattttactgattaagattaatccatgtttaaaaaagtatacaaagagaaaggaaatatcatagtcattatctaggaataatttaagtagtctaatataaatctgtccctaaaaaagttgttgaatggcagctaactagattgaagtaccctaacataacttatattttgaattggttgttaataataattggaaaactaggctatgtttagtcctaagactatagggtttcctctcaacacattttagctgtatcccacaaattgtggtatgttacatgttcattatcatttatgcaaaaatgtttttcagattttattttggcttattctttgacctgtaggtttttttttttttttaacaaatgtattgcttactttttgaacgtttggggatttgctagttatctttctgttactaatttcttaatttcactatgattagagaacacactctgaatagtttcagacctttattgatacttattttatggctcagcatttttataaatgtttatgtacccttgaaaagactatgcattctgctgttaactactgtcttctatgtactttgttaagttcaagtttgtaaattgtgttattgtgttgtacaaatcttctctatccttactgaatttttttttttttgcctttttttctattcattacagagagaggtgtcttgaggttaagtgtcaaatgtgtcttactgtgattgtggatttgtatatttctccttttagttctataaagaactaaactgtatgctttatgtattttgaagtcatattactaggcacatacaaacttatctttctagtacattggctctttatcattataacatgtccctttttatctctagtaacacttgtctctcgcctcaaagtcttcttagctacacctgctttattttggctgctgtttgcttgcatggtaaaactttctctctcctttttgcttttaatgctcctgtagctttatatttggggtctgtttcttgttaagaataaacagatttttgtttgcctgtttttaattaaatctgaaatatatttagctcattaatggtaaatataattattgataaatttgggtttatgtctgtcattttattgttttctgtttgtcctacttgttctatattctattttctctccattgttgccttcttttggattaatcaagtgttttaaaaatattattttattcctccctttgttagcttgttagttatatattctgttactgttcttttggtggttacgctagatcaccacaagctttcttgtggtacattagagttgcatattcattaggattttgaaaaacaacatctcagacattgttaggaccctagaaaactttaatagcatttatcactctcctgcttttatgttgtcattgtcatgcatttcacgtctacatttaaatccagagactgttgttttgtacagttaatatttaccctttccattgttctttatttccttttgtatttacatgcttccatctgagattaattttcctctgtctgaagaactccttttagggagtttggtggtactgaattctcagtttttgcttgtttgaaatttatttattttcatctttgaagaatatattaaatgactgtacagttctacattattagctgttattttcttgaagcactttaaagatctcagttcattgtcttctagcttccattgtttctgttgcaaaatcagccgtcagacttactgttgcttcttggaaggtagtatgactttcttgttcagctgcctttctttttgtcattctctttttctttaagtttaaacagctttcagtgatgcacctaagaatggttttgtttgtaccctgtttggcgtttctggcacctcttgaatttgtagtatgactgatcagctgtgaaaaaattttgactttttaaaaatattgtttctgccccatttttgtctcctttgctctgtgactccaattaaatctttattatactttttatcccccatatgtctcctgctctcttctgttatttttatgatttttttcctcctcttatccgttctggatagtttttacttgactgtatttcagttcacttattctgaatttaactatgtccaatctgctttttaaccccatctattcttaattttagttatagtattttttagttttagaattatttcatcctctctttttaagatagattctaattatgtgaaaatctcttgtcatgtattttttgagcatattaatcaaattgctttaaagtctgtgtctgaaaacttcaatatctgtatcacctataggcctatttccatcatctctttccttttgattttgcatcttgttaggccaaataataataatagttaatatatttgtatattaatgtatgttaattatatattctattgtatattatataaattattacatgtggataataacataatagtaataattattattaggcaattttttgatggagtgccagacattatatgcagaattttagatacaaattttgtatctataatgatacatttccccagataggattcacatgtcttcagattcacccatcttcttgcaggcagatagagatcactgcaactgtcaaggactgagctgacttgaggttgggttttcagccttataaaccttgttctacctgtagtttgcttccaacttggtagccccctagagatctcaattaagagattgggtatttttagggcttctctggctttttttctttccagacccatgagagttttaaaagctccttcttcctttttaattgctttctgctggctttttagccttttgctatgtgcagtttaaaagctgataaatcccttaagaggaaaatcagtactgagtgtcacatttgttcttctgtgccttctttcactaggggatcttgactcctcaagacttagctaccaagttttgtccccctactcccatgaaattgccaaaagctttgctgacttctctgcctcctagtggctgtccttttttggcttcttagccccttggcctgtgccattaaagaaataggtgacatgtcttgaaagggaaagctgcacagaatgtcagatacccttcagtgagtttcttgccacctcaagtcttagctacctcagaaagtctgatattttaagaactttctccctatttaatacagtttttctagtttaagagggagtgttgatctgctacagactattccgtcatattcaaaagcagaaatctttctgtgtttagttcttttggaatagagtgttatatcttgtaggcctgtgagtttctcatggttatattaatgtaaaaacgtaagacttgatccccagagttctttggtctcttgctaagtgttttccttcattaactgcttattcttgctatctgatgggaaagaattgtggaacttaaatacagttgacccttgaacaacatggatttgaatttgcagatctacttacacgtgattttcttctgcttctgccaccttgagacagaaaggtcgatcccttctctttctccttctcagcctactcaacgtgaagatgacaacaatgaagacctttgtgatgatccacttccatttaatgaatagtaaatattttttctcttccttatagttttcttaataacattttcctttctctagcttattgtaagaatatagtatgtcatacacgtaacacatgaaatatgtgttaattgtctattcatgttattgataaggcttctagtcaacagtaagctattagcagttaagttttatgggagtcaaaagtcatacatggctttttcaactgcatgggagttggcgcccctaggccccacattgttcaagggtcaactgactgtaacatgatttgttagcagttgttttattcttgttcttagccaaaaaactgagaagttattgttaagcagttgttttaaatgcttattaagagttaaaatgagattttatttttggtttcattggtgatttgcacatttcttttgagacttacttgtttataaggttaagaaattgagagttggtcgggtgcactggctcgtgcctgtaatcccagcactttgggaggccgaggtgggtggatcacttgaggtcaggaattcagcctggccaacatagtgaaaccccgtctctactaaaaatacaaaaattagcaggatgtgttggtgcatgcctgtgctcccagctgtttgggaggctgaggcacgagaattgcttgaatccaggaggtggaggttgcagcgagctgagatcgtgccactgtactccagactgggtgacagagggagactcagtctcaaaaaaaaaaaaattgagagtttaatctttctataagtatagtatttcccttcatataataggatttttaaattatttacctttttgttaggacttttatggaatcttatatttatgtgaagatgtaggtttagaaggaagataattgggtttggtgtaaactttggttttgtaaatgttagtatttaatactttaaaaatattcctacttttttttttagtgtgactaatatttattatggccagtatcacctatgtattttttgttaaagaagttgtcttatatacatagaaatggtataataagctactttaaacaaccctggatatgtttcttttcccttcctgtcactgtcctctttcttcccttttcccttttgattaagaagttccatcagaaaagtcataaaatctaactcctgtttattctcgagctatcagctaaaatgtcactttctcaggaaatcctgcctgacccccctttcccctttgttctggcacccattcccctggcctttaaatgctttcatagcagtgtgtacctatctatcattttttacagtttgtaattacggctttttttttttttttttttttgagatggagtctcgctttgtcgcccaggctggagtgcgtggtgcgatcttggcttactacaacctctgcctcccaggttcaagcaattttcctgcctcagcccccccaagtagctgggactacaggtgcgcaccaccacgcctggctaatttttgtatttttagtagaggcggagtttcatcatgttggccaggctggtctcaaactcctgacctcaggtgacccacctgccttggcctcccaaagtgctgggattacaggcgtgagccaccgtgcccggcttcctgtaattatgtattaaaatgtataattacttgattaatagctatcttcccaactagaccaaaaactccatagaatgtatggaattttcctccatcatccttgtagtccaagcataatatttattaaatgagtaaatgagtgaattaactagccattttgattaattttctctttttagtgcagttttggtttaggactgtaaggagtcatactggccatattcagaatgtcacattagtgttttaagtccattctgtatttttttcaatgagtttcagcaaaatctgagagtgtcttaagtgaaattggttatatctagggtggaggtattatatttggaaagacttgtaacagtagaaagctttttatttaaatctttgagttttaaaatatttttattatgaagttatttatgattttataggtaatatttttaatgagaccttgaaaaatttatagagtgcagtttattacagaatctgagttgcctaatagtttttaatagtttttgagtatcagtattttgattaattttaagttagggatcatttcctctaattctttgaacataattatttgttggttgatttttttttttaatgtaacagtgtttttgagatgtaatttatgtaccatacggttcttctactttagggtattagattcatggattttttgtacattcacagatgtgaccgtcattgcagtcaattttagaacattttcataatctcaaaaggaaaactgtagcctttggctattatccacttattcttccatccctgagcaaccactaaactacttttggtgtgtatagatttgcctatttaagacattttctataaatggaatcatataatttatggccttttgtgattggcttccatttaggatgttgttttcaaagtttatattgtatcatgtatcagtactacatccttcttattgctggtaagtattctgttgtatcgatataccacattatgtttagccgtttattagtacagtggtccccaacctttttggcaccaaggactgactttgtgcaaggcagtttttccatggatggggtgtgatgggggaggatggtttcagaatgaaattgttccatttcagatcatcaggcattagattcttataaggaacaaaaccaaaacagcaacaacaacagtgattctcataaggagcacccaacctagatcccttgcatgtgcagttcatagtaggttggtgctcctatgagagtctaatgcctatgctgatctgacaggaggcagagctcaggcagtaatgcttgctaacccaccgccactcacctcctgctgtgcatctcagttccttacaggaaccagtactggtctgtggcctgggggtttgggatccctgcattagttgatagacatttggattatatccacttattggctattatgaataatgctgctataataaacattcatacaagttttttgtggacatggtttcatttcttgggtatatgtccagcagtggaatttctgggtcatttgctaactatgatttcgttattggagaaactgccagattttttgttgatttttttttttttctgttattatgtagtgtcaagaaaccgtttaatgcatatgaattgaagccctgtaaggaaagtgatcatttgggattagatcgcaaattgcttgacttcaaatgtattactttgagaattttctgtgacagtttagctagtcctttatcttccttatttttcttgagaatacatgaattagctccctgccttcatatttgaagatacatacctatcagtgtacagacatgtacacacataggtacacatataatactttgctaagcagtttgtgctggggacaatagttgaaactcggtgttttttcctaaaatttatatcgtttgtttatatatgaaatatcaaatgggagatatttttggaagcagtgaaacttgtttatgaattctttccttacacaaaagaagacaggttttttaaaaacaaattaatctttttctctttgtttctttcagcattgatgactgggaagtgagagacatagatttttgaaaagctgaaaataacttctagtttaacaaaatagtttcttccagagcttagaatttcagatgattggaaaattcatacatctaggtctgaaagtttaagtctttcgcatctatggagatctctattttctacaacctaaaatgctatgatgggtgacaggttaaagacaaacctttttaaaaaatgtatatttttattgctatatagtggtattatggcttttgaaattcctatttttaccataaacagattattaggtgcttactgattccagataatagcctaatctattagaaggtagaagagagaatctctggtgatacactgtccatacatggttcaataggaggtagcaaaggctaagtatgagtaagtgacaaaagcagtaaatgctgcagaactgaaattcagagaattgcgcttccactgttgggtaaggcttaaggggagactttgaaagaggaagatgagctatgccttcctttgggtactgatttaatttcttttgccatttttttgcatttcttgaatgtaggaatttatccttacccatgtgcatattcatcagctccaatttaggagattgactagtgtagcacgtcataaccagaaagatacttggaggtagacttttccctaaagtttatacaagacacttaatgggctgggtccttgatcatgtacttctttcttagactttgtgtatatgaagtggtgttcttatccttatttctttccacattcaccctttttaatgcttttagtaagtcttttcagtttttgttaagatttattttatagttacactattgtatttattgaaggtagcttggctgatactgttccaaagtcacttgccactttcctctctgcataattaacatttattctcctcattatttgtcaatgaattcccttctgtttatttatagtttctttatgattctgcatatcagaagataacaagcacttatcacaaatgcatttaggggatgtactactctgtaaaaaatttaaatatattgaaaatagaactctttgaattttattttactcttttgaggaaatgaagatatcttgattttttttatggtattctaacctgcttttccggggcatacagggcagcacttatttttatataaatctgagaatgtgtgaattgcaaattaatcttctggcagatatctaatgctgttgatagagatgtgttgccctaagatttattggatttaatgagacagtcttttgatatatccttgaattatgatgggatattgggttgccacatgtaagttttagaatattttttaatgatatagagaaaatgcttcagatacaatggcatgtaaaagagaaaacagcaaaaaaaccctgattttaaaacggtttgattcaatttatattttaaaaacacagacacatgatttgtatgcctgtgtatatagaaaagattgcaaggatatttaccaaaatattaagtgattatctctgggttgtagtaattggggtgatttttattttttaagtgccttttctttgggtattgcctgaaatgttaaatattatctcattttagcaaataataaatactacttttaactaagaaaaaatagagaattgttgtgtttgtgtgaattgctttgattataaacacaaattatataggatcctatgtcccatgttagtgagtttctttttgtttttttaaagtgaggagctatcaaaggattttttaatagaaaagtgatgtgaataaagttaagtctatggtttaaaattaaaaattttaagtactcttatgacccagcaatttcagtttttagtagctaattttgagtatcatcaaattcaggcatgcttatccctgggattacacgtagaccttccactgggtatgcgggcaaaaatagttttaaaatactcagtttcctaagccttactgttcttgtgtattctttcctaaaattgatctgcctaagaacttgcctgtggcttatgcccttgctcctcaaaagtgtggtctattcaccagcagtattgttattgctggttgtttgttaaatgcaaaaaacgtggttctcaattcttttaaacaaaataaaaggaggacctaatcaatttgtcagttgatggatcataaataattttttttttttgagctggatcttgctctgttgcccaggctggagtgcagtggcgccatcttggctcactgcagcctccacctcctgggttcaagcgattctcctgcctcggcctcccgagtagctgggattacaggcacgcaccactgcgcctggctaatttttttttgtatttttagtaaagacggggtttcaccatgttggccaggctggtctcgaactcctgacctcaggcgatccacccgccttggcctcccaaagtgctgggattacaggcatgagccaccgcacctggactgatagatcataaatatttttaatgatagctcgttatgcgatttttggcatgtaatttggaaggtggtaaaaaaaattagtagtacaggaacagtccaggttgagtatcccttacttgaaatgcttaagaccggaagtgttttggattttggaatttttacgattttggaatatttgcattatgttaatatatacttagcagttgagcatccctaatctgaaatttgaagtctgaaatgctcccatgagcatttccttgcagtgtcatgtcagaactcaaaaagttttcagattttggaacatttctgattttgggttttcagattctcaaactgtagtaacagaaattccttcagctcccttgtatttatttatgtgagcaagggaggatcatagagtccagaagttggagaatagcttgggtaacatagcgagacctcttctctacaaaacgttaaattagtcgggtgtggtgttgtgctcctgtagttctagctacttgagaggctgaggcttgaggatcacttgagcccaggaattcgaggctgcagtgagctatgttcatgccactgcactccagcctgggcaatggaacgagactgtgtctcaaaaaaaaaatttaaaaataagtacagagttgatgttgaatcccattttattctagcagtgatatttattcatatatacatgagacaattgttttgaaagtacacgtgtctttgagaatcgtatctaatacctttactgtatatttaatcatcatctgtcaaagtttttaatatattgttttggtcaataatatacttatgaaattgataataacatccagaagaaattttaaaaatcactcggaatctcatgatcaaaaaccaaaaaagtttaatcttaattcacgtggcattttctcagagaagtcataggagtgaaaaatgaaagaccttccagcctataagtaaaattacatttacattttgtaaaattctttgggggaagtttaaggagaaaccaagataatataaacttttgactgtataagaagaggctgttcacttaaaaaatagatgatggtatttttcttctattgatacttttaaaagaacacatataacaactttattaaaaattaacaatattagggcgggtgtggtggctcatgcctgtaatcccagcactttgggaggccaaggcaggtggatcacttgaggctaggagttcgagaccagcctggccaacatggtgaaacctgtctctgctaaaaatataaaagttagctgggcgtgatggtgcacacctgtaatcccagctagtcgggaggctgaggcaggagaattccttgaacccgggaggcggaggttgcagtgagctgagattgcaccactgcactccagcctagtgacagagcgagactcagtctcaaaaaaaaaaaaacccaaaaaacaatatttaaagtacactggaaatcacaacctttgcaacaattataaggtatgaaacattttacaacttaaaaatgttgaggatgtgcatagattttcaaaattaatttagagggtacttgagcagaaaagcttgtgcaccattaactgacagcagtttgcactttcgaattacttgtgaatcttttaaaaatgctgatgctcctaggttataaaataatctattattttgggcctaggcccaaagtactagactatgatgaagatcccacaaaagtgattgtttttctataattacatatacacatatatttattctgtagttacatgcatagatagaaaaaagacttggaatctaaaacaaaagcaaaaagataaggaaaatattaatgaaaaattgaaatggaggctagccttgatccagaaggtccaccttctcaccttcaggacacatggcttaatgagcagatgatgctctttgactgggatacaggacttgatgggtgggacacaggctgaatttcagctttcactcttcagtgggatcttctagtgcatggtgcaacctgcataattatatatagcagccctgcaccttctacataataataggcctagaaagagattagaaacaaaatagaaacgaaaggaaaaaatagaggaaaatttatctgagctaaagaaaggctcagttgaagtcattagtttgaacagccttgctgattgtcaagagagtaagtgcaaaagtatccataattagtctgcattcagatgcaggaacctggtgctagagaagctgctcaggcacaggaactgggcattgaagctgtatatgctgctggagcctgatgctggagaaacctgtatggcaggaatgaagagctagagaagctgtgtatgctgcaagagcatgcacggcaagcatacctgaaccaagaagccaaacaaaaacaaaaaaaacccaaagacaaaaaacccttacttgctgcgatgactcctgccccctcttactgacacagcttaacattgcaccagctggtaaaggaaaaataaagggcccaaatccattttcaaagaggagacaaaaagagtgaatttagaggtgagagtcaataaatccataattggctcgtttacttttaccttttgatgtgattttaaaatctgttttctcagcatttcatttatacttaaactggttaaatctagtatctgaagttttcttttggttaatctgatgcctattattgtttcaagtggattaatattactagtaagcttttgtgtttctattttccattcatacagtgcaataacattttttaaattgcaaaaatggataccgaattataaagacagtagtgcttttgaaacaaatgttggctggcatgtgaggtaatcatagtatagtaacaaactaatggtttgtgacctgatgaacattctgtatttaacaaaggaaaggctgagagctctaagatacataagtgtgagttgtctgacagttgagtgaggagagttattacctgtaataaacttgatttcagttatatcactaaactgctcatgttccatatattattttaaacagaaaagcactccaaagttgtattctgtgctacagctatctatattgtgatttgccatatgacatatctcttattaatatatgaagagagcattaaaacagccttgcctatttatcagatatgttctaggtgttaatttatttgtgaattttatgcgaacagatatatatatggaaatgagtttttgaaagtccagcatacaactacagccattaatcaaggacacatgtagaaaataattcatatatatgcagagatgttgggagaagttttattccaaagctaacacaaaacaaggtacacaagtttttatagaggatattatccattgcggtaatatttgatgtataatacttctgaattttttaatagttttaagagttaactatagtcgttgggttttttttttttaaagacagggtcccacaaatgtaatttaaaaatatttgtagatcctctggagtatctctgaggaagagagtttgaaaaatgctttaccatgggacttagggcattggtcaaagatacctattatgggtatgagaggagagttcttattaagtaagcagatttggattagttaatattggtttgacctgtcatccttagtacagtttaaattattgtattatactgtggcaaaagctggatctgatgcaaaggaaaacatgaaagaattgagacagtatggtatagagagaacactgacctaggactgggacttgagttctaatcccagttctaccaccgattaattggtagttttagatcggtcatttaatttctctagccttttatttttttctcatacaaaatgagggatttagattctgaaggtatttttttgatgcaaaatagcaaacagttgatattacagagtaattttttaaagacatgcaccctcccccacatccacatgttatagttcatattaagctacattgttgcccaacaaagatattttaagaacttgatataattagatgataatgattattttagtaaaattaattacatataaatgaagcctttgagagtgcttagaagcagtttgatctcttaaatctatctttttttttttttgagacagagtcttgctctgttgcccaggctggagtacagtggcacgatctcggctcactgcaacctctacctcccaggttcaagcagtcctcttgcctcagcctcctgagtagctgggactacaggtgcgtgccaccacgcccagctaattttttgtatttttagtagagacggggtttcaccatgttgaccaggatggtctctatctgttgaccttgtgatccacctgcctcagcctcccaaagtgctgggatttaggcatgagccgccgcacccggccttaaatctttctaatccctctgtgaatatattgttatattgtctgaggtttgaagaatgtgtgtactaagcagtaaatcattgccagatcatgtccaaatttaatgatctttgcattaggtagaaaagggatagttctttgttttgaaatatattctgaagggtcatttaatttctgaaaagattgataattcaagccttctgagatattcagcaattgaggactatttttatatgagtgtctcagcagatagatttttttgttttggggagacaccaaatcatgttagcgagctttttagtttcatttttgtctagtgagaatttcctattttatcaaacttctgtataggaatgtttgttttattttgttgccattcttttttcctagtggtcgctccattcattcttgtggagtatgttgtaggtatgtgttcccaaagtgttttgaatccttagagataattactacatgcttattttcagttgcttggtagtgataagttgacttgagttttgctttgagtgatggtaactaacgatactacaatggtctgctatttgctaggccattgacattctgtaattttcaacctgtatttgtacccacctctctttcttctggtatattttaaagtaaatataagttatgttattttatttctaaatacttcagtatacatgaagaagaggacattttattagttattttttatttcattttatttaaaatcttttttttttttttggtagagttggggtctcgctatgttgcccaagctagtctcaaactcctgggctcaagcactccttcacctcagcctcccagagttctggaattacaggcatgagccgctgcacctggccttcgttatctattaatccataacaaattgctacaaacttagcagcttaaaacaatacacaatttattttctcaatgagggtccagtgtttagacatagatttgagaggtcttctgctccaggtctctaaggctacagtcaagatgttggctggggctgtggtttcacctaaaggcttgagtggggaaagatctgcctctaagcttatttgattgttggcaggattcagtttcttgcaagttgttgcccagaggttgtcctcagtttattgccacgtgggcatctctaatgtggtgttttgcttcatcaatgccaacaagggaaagtctgctagtgaagtggaagtcacagttttatgtagcctaggccctgaaatgatgtcccatcacctttgccatattctcttcattaaaaacaagtcactaggccaacctacactcaatgagatgaaattacaatgagatggaattactcaatggtgtgaattctcagtggtggggatcatttgaggccatctttgaactgccctgccagagacattttcttttatggccacaatgtcattattttacttaacagatttagcagtaattctttaattacaattaatacctagtccatatttaattttcagttttctaaaaaatgtctttttatagtgtgttcgaatcaggatccaaacgcttattgcatttgttgttatgtcccttttacaattctttttatcaagagttcttccattagccaggtgtggtggtgtgcacctgtagtcccaactactttggaggctgaggcaagaggattgcttgagtccaggaggtcgaggctgcagtgagctatgattgtgccaccgcactccagcctgggcaacagagcaagaccctgtctcttttaaaaaaacaaaaagaagaagaagagtcttcccatcctcttgctgttttctttttatccattgatttgttgaagaaatcaggtcatttgtcctgaagaagctcccctattctagatatgttcagttgtttctatggtggcatttgactaattcctctatttgtcatgctttatatatactgggagttaaacagaaagccttatttagattttggatcagattttttttgagacagggtcttgctctgttgcccaggctggagtgcagtggcacaatcatggctcactgtagccttgaacctcctgggctcaagtggtcctcccacctcagcctcccaagtaactggaactacaggtgtgtgccaccatgcctggctcatttttaaattttttttttagagtcaaggtctcattgtgttgcctaggctggtcttaaactcctggcctcaagcaatcctcccacattggcctccatcagttttttagaaagaccactccctaggtggtgccatatactttgtattttatcacttcaggaggcacaaaatgtggtggtgacaacttttttgtaaagccatccacttttcattaatagtgttaatatccaaagataactcattgttagaataaactatttcagtagaagtatcaaaattggatttctctcatcttaccattcctttcacatttactagctgtaattttcctggataaaattttcccttgtctatttgagctttttggttactctgaaatacagttctactggaaaagcaagacaaatgcttaattctttccttttaatcactagttttcagcatagtgagttgttatatacctccaggtgtctaattaattttttcttttttaaaaacgaaaagcatttatgaacattagtctctttattcattgtgttttaaatgacttcagtagtcattatttgtgatgccagatggttccatcttaggccagtgggagtcccttcaggctctctcctgtgttcctttgacatgaccccattctttattttcttgctttttggcataggaaaatgactttatataacatgctttagtcgaagaatgatgttcagagtgcataattggaaaatggagatacttaatgttaccagattgtcatttcttttagatccttctaggtgatagagctaggaaataaatttttttaagagaaaaaatatcttgaatttatactgctatttccagttcaaatttgatttgtgaggttgtaacttctttcattttacacttttttttttaagttgaaaatgtttcccagtattaacattaatataattgctttgggccctatctatgtgtgtgtggtgcacataaatatgtttaaaacataaatttaaagtaatatcagtgttattactgggtgaagtttaacatttctttgtagattctttttgccgttagactgttttctactgaagatagtaaaaatgctgtgtcctaaggtcagttggaataattctttttattattttctgtgggttatgtcaccaacttgatacacaggttcatttgttttagtttattttcagcttttagtgattcctgtttttgtttctgcatgtaaaacatttgcatggtttcagattttaaactatgcagcttccacctctgtcccttcaacactttttattccctttacaatgggctagttcttccgctgcaaatacaaacatctacatgtgtatccattcatttagatgtgccacaatttgttgaaccattcagcagttgatgaacatctagattgtttccattttggggttattagaaatgaagctactataaacattggagtacaggtttttgtttgaacataggtttttgtttccctaggaaaaatgccgaagagtccaattgctggattgtagtggttagttttgtaagaaaccttcatacccttttctaaaatgggttaccattttacattcccatcaacaatgtatgagggatccagtttctctgaatccttgtgagcatttggtgtcatcactgttttatcttttagctattatgataggcatatagtgatatctgatttttttttattcctctaatggctagtaatgttgcacatctcgtgtttatttgctatctgtataactgcttactggaatgtattcatgtcttacctattttctgattggattgtttgccttttacctgatggatgtcaagagtactttgtatgttttaggtgtatgttttaggtgtgtgtttaggtgtatgttttaggtcttttgttgcgtatgtagttcggaaatacgttctcccagtctttagcttaccttttcaaccacttaaaagtctttctcaaaataaaagtttttaattttgctgaagtccagtttttcaatttttccttttatacattttgctttttgtataagatctccttgcctagtcctagaccgtgaagattttgtcttatgtttatatttttttaaagtttcatagttttatattttacattttcattcatgattcattaatttttttaatgaagtatgagttttaggtcaattttttttttttggcttatagttgtccagttgctctagcactgtttgttgaaaaggctattcttcctttgttgaattgcttttgtacctttgtaaaaaaaaaaaaaaaaaaaaaccagttgggcatatatgtgtgggtcttttgggggccttttattctgtcctaatgatatgtgtctgtccatctgctagtattatactttattgattatgcagttttataatggagcaagctttaatattgtatagagtgatcgctctcattttattctcatttaaataattattttggctattctaggtcttgtgttttatgtgtaaatttcagagtaaacttgtctatgtctaaaagaaatcttgctgggattttgataggaattacattaaatttgtaggtcattttgggagaattgccatcattgctatgtcgagtcttccagtccacgagcacaatatgtcttccatttatttaggtcttcttcaatttcttttatcagcattttgtagttttcaggatacagagcatcctgtacatgttttgttaaaaatattcttccttcatttcctttaaagcaactgtaaattgttttgtgcttttaatcttgggtttcacatgtttagtgttagtatatagaaatgcatttgattgttgatcttatatcctgcaacgttgctgaactcattagtcctaggatttttttttgtgggggggggcgtaaatcttgtgggatttttcacgtaggcaaattatgtcatctgaaaatagggatggtttcatttcttcccttctgaaggttgcatcattgtttagttgaatgtgtcaagttttatttttttctggatttttgaattagggagtgtcttctcagtgacaggatgtaaaggatttaactgtgttttcttctgttacttgtatgtttttatatttagttttctgattcatttggaatttaacctggtggatgatgtgaggcacaaatctaattttatttctaaatggctgtacatcatttatatctatcgaaacatttaaatacatcatttattataaagctcatatttcccccaaccccaatgatttatgatgctatcttgatcatttattaaattttatgtgctttgttctatttatttttatttttaaattttttggtagagacagggtctcactatcttgaccaggcttgtcttgaactcctggccttaagtaatcctactgcgtggcctcccaaagtgctgggattacaagtgcgaaccactgcagtcagcccactcttttatttcactgttttgtattctgttcctgattgtgtattcatgtataaatatcttgctgctttaattacagagacttcataatatgctttaacatctgacagggtctagtcttctctccttgctcttctactctttttcagggtttctttggctgtttttatccttttaatttttaatgtgaaatttattatttgtgtgaactgtatcagccttatttgttgtatggtcatagggaaacctgtttttatttttgggtctaattaaatttataagttaacatagaattgtatttttatgatgagtctttttatgcaggaacatggcatgtctttgcattttttccaggtttacttatacatacatatatatatgtatatatcaggactgtttaaaacaattttctcataggttttgcacatttttctaagcttatggctaatactgtattttattgttgtaattagaggtcttctcttgcattatatcttctaactgcttttcgcttttatgtttgaaggctctgatttctttaacttgatactatatatatatatatatatatgctttaagttctggggttttttgttttttttttttaaacaggtctctttggtccaggctggagtatagtggtgtgatcatagctcactggaacctcaaactcctgggctcaagtgatcctcctgtctcagcctcccaaagtgctggaattataggtgtgagccaccacacccagccttgatatttttttctaactaaattcttctattctaaatagtatttttcccattgattcttttggcatcttctagttgtataattttttcatctacaaacactctaatttgtatgctttgtaattactttttctatctcttaaattttagactttatcctttagaacagttttagatttactaaaatatcgagcatgtaatacagagagtttgtatatacctcccaatagttcccctattttttttttttttttttttgaggaagggaagaaaaggaaaggagcaaagtacaacttggaagagggccaagcaagcgacttgagaaaccggcagcttgacctcttgacttgggattttatacgctggcatactttgggatcttgcattacttctcctcactcctgagatcttattgagaagctgctgatgagtttcaggtgttttatatctattagcctgcctttccctagctccggctgcaaccagttattactttagagaaacagttaactgcctgaccatcacctgatggtcgcctaacactcctggtgtgcatgtggggtggagccccctactgccctgctcatacctgactagctacccactgtaacatttccccccccaagagtccaagaccccaaatctttggggttaaatggacgaaggtcagtcttctgtaactgcttcctgctgacagaggggcagtggtggttctatgggtcttggcctcttgctagctgtcattgctgagttggctccatgagttgttgaaagcgatatccggccaggcccaagggagacaggggcaggatttcgcctctgtcgtgtcccactgatgggcagtctagaggtcccctgtagaagggtgattcttgaatattgaaaggacagtattcttcatcgaggattacctggagcttaatggccactagggaatgtatccaaatcgtgtgcgccaaatatgttgccggtggcagatacccaagttaccccgattccgtatgggtctgccacaacttcagttcttgcctcctcaggagaattcgaatgaggggcataaggcagaaggagggagagactgaggcaggtttcagagcaggagtgcaagtttgttaaaaagctttagaacagtaaggaaaggaaggaaaggaaagaaggaaagtacaccttggaagaggaccaagtgagtgacttgagaaaccaagtgccagttaccctattcttactgtattacattcatatgctctgtttcttagaattaatgaaccaatatttatagttcattactaactataatccatagtttatttaaatttcctaagtttttctcgaatgtcctttttctgttccaagttcctattgaggataccacatcaagtttgtcatgtctcaggctcatcttgactgtgacagttttctcgaacttcctttgttttggactgacagtttcgaggagtactggacaggtgtattgtaggatgcccctctactggagtttgggttgattgggaaggaatatattgtaagcatgcccttgatcacctccctgaggtggtgtttgtcaggtttctccactgtaatattttcccttttgcatactgtactttggaaagaagccattatacacagccaatactgagggagtactctcagttcttagagtggagtattacataatttcttaggaattcttctttatgggagatttgtctcttccgccatactaatttatccaataatttatttgtatcatgtggactcagatacttattttatactttattataatccagtactactttatttattttgttgctcaaaatgttccggctttggctgttggaagctctttcagttgactcatgtgcgcctttgacataacttccatcatttttgttttgttttgtttttcattttagtgctttcttaatttctggtattacaggatgctccaggctcatcttgtttattttctgccccatttctccatagaactgttgttccttttattggagaaaggcataaaaaaacaaaatctgggtgctagatgtcctgcttcgggggttttgtttcttttagtccctctcattaaccttatatcctgaaaccttgctgtaatcattcattatttccaggagttcatcagttctttgggattttctgtataggcagtcctgtcatctgtgaatgatgacagtattatttccttctcaatgtgtagactgtttttttcccccgcttatcttattggatttagctagcatttccaggatagtattgaatagaattgccttattcccagtcttggggtaaaacatctagtttctcaccattaaatatgatgttagttgtaggtgttttgtaggtactctttatcaaattgaagagggctgcctgaattcctagttagctaagatttttaatcatgaatatgtgttggattctgtgaaatgctttctctgcatctgttgatatgatcatatgactttcttctttagcctattgatgtgtaatacattaattgattttgggatattgaaatagccctgtaataagtacgttttattgtggtgtgtaattatttgtatacatttttaaatttgatttgctaatattttttgagattatttttgcatccatattcataagagattggctggaggttttcttttagtgatgtctttatctggtttttgtattaggttaatgctggtctcgtagaaagcattaggaagtgtttcctctgctattcttttctgaaagacattctagagcattggtatcattgttttctttaaatgtttggtagaattcaccagtgaaaccatctgggcctggagattttctttttggaagattattaattactaattcagtttcattaatagttactggcatattcagaaggtcgctttctcgacttttggtagtttgtatcttttaaggaattggtccatttcatttatgttatcagttttatgggaatagagttgttcattttattatctgtttaatatccaagtgatcaatagtgatcactcattttcatttctaatattggtaatttgtgtcttctctgtttttttctttgttagcctagctagagttttgtcagttttattggtcttttcaggtagccagcttttggtttcttgctttattctacgcatttcctgttttcagtttcattgatttttgccctaagatttatttatttatttattttttctgctttgtttatgcttcagttgcttttctctagtttcctagggtggaagcttaagtgattgactttaagttgttttgacttaataaaatgctttcaatgccgtaaatttccttctaagcattcctttcactgtatcccacaagttttgatgttttgttcttagtttcactttgttcagaatatttttaaatttatctggagactgctttgacccatgtatcatttggaagtatgtttacaccaaatattttgggattttccagctatctgtgaatgacttctagtttaattccattgtggtctgagagcatactttgtgtaatcttcaactcttttacattactaacatatattttatcatcttccttggtgaatatccttgtgtgagcttgagaagaatacgtattctgctgttattgggtgaaatactctgcaaagtcagttagatctagttgattgatgatgctcttcagttcaagggtattctgagcttctgcctgctgagtctgtctattactgacagggatattgatgtgtccaattataataatgcttcttgaacttctgtcagtttctctctcaagtattttgacacgcttttgtttggtacagacaccttaaggattgttatgtcttcttggagaattgacagtttttattattatttaatgcctcttttatttttttttttattttttgagacagggtttcactctgtcacccagactggagtgcagtgttgtgatctcagttcactgcaacctctacctcccaggctcaagcaattctcctgcctcagcctcctgagtagctgggattacaggcctgcaccaccacgcctagctaatttttgtatttttagtagaggtaaaattaaaacatgtacttttttaccatgttggcgaggctggtcttgaactcctgacttcaaatgatccacccgcctcggcctcccaaagtgctgggattacaggcatgagccactgcttctggccaatggctctcttttttgctgatgattttccttgatcttatgtttgctttgtctgatattaattaatatagctattccagttttctatttaaagaatggtatgtctttttccatttctttatattcacctatttgtatctttatgggggtttctggtagacaacatatttggactttgttttttttatctactctaacagcctgtcttctaattagtttctttagaccattcacatacaaattgattgttgatataattggattgatatctaccatatttgtaactgttttctatttactgtacttgttctttgtttcttctcttcccctttttccatcttctctgatttaaaatggacattgattgtgattttgttttctcatctcttagcatatcagttacacttctttttaacttgtttttagtggttgtcctagaatttgtaatatttatgtgcatctaaactaagtccagctttaaataacagtgtactatttcatgtgccatgtacctaatatcagagtatttcctactcttctcttgtatcccttataatgttgttcttactcatttatctacatgccataatcactcaatatattgttaacattgttactttgaacagttatttgttagatcagtttaagagtaaaaaatacatgttttaattttatcttcatttaatccttctctgaccctctttctttatgtacatcaatgttgtaacctatatagctgttcttgctgaagaactgcttttaacatttctgcaaggcatgtctactggtaacaaattcctttagtttttgttttaggaagtatttatttctccttcacttttaaaggataatttcactggatatagatgtctaggttagtgtttttgtttttatttttttccctggcacttcaagtatttcgttcccactcttttcttgcttgcatagtttctgatgagaaatccaatgtaattcttctccttgtttctctataaatgaggagttttttttcccttgtctttggttttctgcagtttgaatatgatactccaacttataaatttttttgatatttcctgcttggttttctctgagcttcctgctgggttttctctggtcagtggtttggtgcctatcattaattttggaaaattccagccattattacttcaaatatttcttctgctcctttctttcccttctcatattgcagttatgcatctgttatagcttttttattttaaaaaatagtttttggatattgtttcttttttttctttattttcttttttcagtttgggaactttcagctgtcatatctttaagctcactgattctttccatggtacattacccatctatcttgcatgttgtctacattttccattagtggccttaaaatgttaattgtagttattttacattcactatctgctcgtatcaaaatctagatcatatctgagtctggcttgctttgtcttttcacactgttttttcttgccttatttagcatgcattccagttttttgtttcttttttctggctttctttttttttttttggttcccttcaatccagttcctttaacacttaaatctctctgaggaagttaactaagaactttttctaactttctttcctcactctcccaacatctgatcttaagtgatgatcttttcctttcattttatacttgtgaggcagtcagtaagtatattccaaattccacttattctccattcttctctcatttttttttggttagctctatcttttctacattgttgcaccacacatttatattctgttatgtatgacattcttatcttcatggttagttttagttcggtggttaaatatttttatttcatgtaaccagattttatgctgaagcttctcaaatcatttcttcagtatgtatagtttattcattagtagttttctcagaaagaatggctcaaggaacgctttgttaactatgcctttaaacttgaaagatagtttgattatatatacagtcctaggctcacattttttgtacttgattttcttaaaattttttattttattttgagtataaaatacctgtttattgtatttgggtatgaaatacagtcacgtgttgcttaacgactgggatgtgttctgagaagtgtctctttaggtggtttcgtcattagtgaactatggagtgtacttacacaaacttaaatagtatagcgtactccattatatagctctattataatctcatggggccagcatcttacatgtggtctgttattgacagaaacataatgcggttcatgactgttgtagctgttgtaaggtttttttgacaataaacttttcttaattttatgagtgacttgatatttctatctggaagctcaaggaagtttttaaaaaaagtcttcaaagtctgcatagtttgtactaggaatattgagttgaatttccctagcataccgtgtattctttgagtgtgtagattcaacttttattttagaaagatttgcttgaagcacagtttgatgtatctgtctagttccaattatatatttttttgtcgagtccaattatgttacgttatagacagttgctgtcttttgtatctgtttcattattttcatcactttccaacctcttttcccttactgggctattttagcggtatcttttttgggaggaacttttaaaatttagtctgtgtttttgaaagatactctagacagatatttcaaactgtgtattttttgggggaggatttttaaaaatttagtccttgtttctgaaaaaaaaactcttctcacttatatgtaagtcttatcagctcttcctgtcattctggccatactatttttgagctgttttaattttgaattattgcttcttaataaaagtaatgataataaaaatataaactattttcttaatttcatttaggtcattttgaaataattaacaattttcatcttcgtggccacatttttctcaagtatttttatctattacaacatcttagagtggatttttattttattttctattgtttaaacaagttggttttcctgtagttttagaaggaagaacttctgtaggaggaggggatagaccagtgcagtttttgagctgtgtggctccaggccgcatttgtgaattttttttttaattgcacttttgagatgtagtaaagcttttcacctttatgttttccaggtattttgctttctgaatagacccctttaaatgtattttactgttgtggaactttctgagatctgtgtcacttggacctcctgcccacctagaatgtgaatcttatctctcctggagggttctcattctttttgctttgcttaggtctatttctgtttcttgcaatttctccagaatgggtctctgttttcatgaaagtaagagagtatttgttggtaggatacttctacagtcctcttagagtgtagaatctgcctctctcagttttccagttatctctgcatttacctatatcttggagcctgagaaggatgtgttatctaactttacttagttctcagattttctttcccatcaccagcatttgaacttgtttgttcctttgtgaagaatagactttttctttatttttacatgagtggttccttctgattagcataattaaaatattttcagagaggtgatttttttctttttttgtaccatccctgggaaaaaaaaaaaactgtcctgccgtgtcaccaccccgtttatttcttttgtagcacttatcacagtctgtaattaccatgtttacaattctacttgtttattttctgctgcttgtcatttgaatgttagcctcacaactggagatcctatctcatataccatggtgttcccagagcctatcacattgtctagcacaagactaggactcagtaaatatttgtttgataagtaactccaacaaatagtaaaatccccttcttactatgctgttgtcttaaaattgggaaatacttgtgagtctaaacctctgcagtatatgtaagtctaagtgatttgggagaaagctatcatttttatagtatactctttatagctggagatattaaaaattgatttaagagttgatccttactgcattttgaattatagtcttttaagaaaaaaacgtttgtttatttatttacatgtacttatcctttcaaaatacaatgttcttagattttaaatcagaaagccttgaaaaattatcagcattcccccttcccacacatttgtagctataatcaaaaactttctagacttcctgtgtgtgtagataaagatatttctcgaatattgggagagaatgccccaagtttttaccaaactgattaatcttgggtatttaaatgtgttccgtatcagaatttcctaatgtataaggactttggtttttttttttttaaacatttattttaggttcagggcatacgtgaaggtttttacatagttgtgttatgggggcttgttgtacagattgtttcatcacccaggtattaagcctagtacccagtagtgatcttttctcttttctgctcttctcattcctcccaccctccaccctcaagtagtcccaagtgtctgttgtttgcttctttgtgttcataagttctcatgatttagctcccacttataaatgagaacatacggtagttgtgctgaggataatagtctccagatgcatccatgttcccacaaaagaaatgatctcgttttttttatggttgcatagtattccatggtgcatatgtaccacattttctttatctaatctgtcactggtggacatttaggttgactccatgtctttactgttgttcatagtgctgcagtgaacatttgtgtgcatgtgtctttacggtactttacggtaaaatgatttctattcctctgggtacctccccaataatgggattgctgggttgaatggcagttctacttttagctatttgaggaattgccatactgctttccacaatggttgaactaatttacactcccactaacagtgtgttcccttttctctgtaaccttaaccccatctgtcatttttgactttagtaatagccattctgactggtgtgagatggtatctcattgtggttttgatttgcatttctctaatgatcggtgatactgagatttttctcatatgcttgttggttgtcatgtatgttttctttcaaaagtgtctgttcatatcctttgcctactttttaactgggttttctcttgtaaatttaagttccttatagatgctgtatattagacctttgtcagatacatagtttgcaaatattttctcccattctgtaggttgtctgtttactctgttgatagtttcttttgctgtgcagaagctcttaagtttaattagatcccacttgtcaatttttgtttttgttgcaattgttttttatttgtcttgaaatctttgcctgttcttacgtccagggtggtattgcctaggttatcttccagcgtttttatagctttgggttttacatttaagtctttaatctatctcgagttgatttttgtatatgatgtgaggaagggagtccagcctcgatcttttgcatatggctagccagttaccccaacatcatttatgggaaggggagtcttttccccattgcttgttttcatcagctttgttgaagatcagatgatcgtaggtatgtggcctttattgtatactttttttgtctgtctcttaaattttatgtgtgtttttttttatgtttaaaaaatactttgtgatccccttggccacagataaccattcttgttctgatacggtattaccccagcagagtgttcacatgtagtggaagctctattataatggtttgattgattgttattactgacttttgtgtaggagcaagagtatacatgatacttcgaatgaagggtgtgaaagctcttcatagaaatgcagaatgttaacttggccttcgtgagtagtgtttcctagaattgtgcaattcaactcccctgattacagctgaaagaaatttgagactaaagaattaaacctttccctttatactgcagataaaataattcaagtcctgagagattatgtaatggattatctaaccaattagtgaccaagctccaaaatctcaagatttctagttgaagttgattttttttcagatccattttatcatatgattcaacaaaaaggcaggctttagaaggatgtttttaaactaccaaaggaaaaacatccttttatactttttaaaatactctgcttgactgacttttcttcatataaaaattagaggtggctttaaagtatctaaaacttccaatttaaagttggcggggcttactgataagcatcctgaccagcccttatcagaaaaaatgttaaatgctcaattttttgcccaattgctgctgttatatttaagtattcttaagagtagtaatttagggctgggtgtggtggctcatgcctgtaatcccagcactttgggaggctgaggcggcaagatcacttgaggtcaggagttcgagactagcctggccaacatggtgaaatccccgtctctactaaaaatacaaaaactagccgggcatggtggcaggcacctgtaatcccagctactctggaggctgaggcaggagaattgcatgaacctgggaggtggatgttgcagtgagctaagattgcaccactgcactccagcctgggcgacagagtgaaactccatctcaaaacaaaacaagagtagtaatttgaaaggtatattgctaagcaagcttagggtttaagcatatgtaatcaagaaaggtttttaatttgctgacttgaattaaaacctaaaatgtcaaataaattatcttctcatggtgaattgtaatcgtttgttactgacatttaattggtagtatatacagatatagtagattttaaaatatgcaaaaataaagacatataacttgggaaaaattaaaactgtatcccatttttcagttacccatttgtgtttcattataaatttttaaagttctcatagaagaatttaattactcatagtcttgcttttgttttgtagtctttgtatgagaaacttaaaatgttattcatttttattgctttcagttttcatccagcattggtaagaatgaaaatgtacattttaatattaaactaacctgatggaaataggtagccattttagtcttcagcccaactctattttcaattcttcttaaccagttctcagttattatttgcattttaaatatttttaaatggcagatatttaatttaactctagttggcaaatctttattatttgactcatatagttgataccgaattgtgtcttataaaatgtattttctatttttctagatgttagtataaatgaaagtcatgggtatctagaagagtgttgtggtcacaatcgctttggttgccagatcagtgactcctggcaagtggaactaaaaagccagtttctattctttcttattccctctagtgcatggtctctcaagatacccctccttctgttctacatctgcttcatttttattatgctactgactgccttatttctcttttattattcttacctggtatctctgttctctgtttcattagttctgtttacttatatattctttgtcttagaattttatttctatactggcccatcccatctcctgtcacaggagatagccagccaagattagcagtcattgaaatactcataagtaaaaatcacatgtacaaagcatattgcctatgattgctccttcagtagaggctgtggatggggtattccgcttttaaaaacaagggatgttgaattgatatcatgattgacatatgtagtataagaggttaacatctctcacttagtcctgaaaattaaaggaggataggctatatataccactagtgatggtagattgtataagtctttggaaagtaatacaagggaggataataatgaatatgttttatagaatactactatggcaataggctctattaccactgctgaggggctgatgttagcagtcactaccctaaactggattctcctttgccttgcaggagagtggaaatgggtggaggggagcaacatcataggaggaagaattaaaaacagtctagatcttactttatgttttgaaataagatccattatttaaaaattttaaaagacaatgagcttttattagtttctttgctgtctttttctatgtctttaaaatgatggaaaagtagagcctgatttgattttctgatggtgtgttagtacgttctcacactgttataaagaactacctgaggctgggtgatttatgaagaaaagaagtttaactgactcacaggtctgtaggcttgataggaagcatgactgggaggcctcaggaaacttacagtcatggcagaaggcaaaggggaagcaaacaccttcttctcatggcagcaggagagaaagagaatgagtggggaagtgccacacacttttaaaacatcagatcttgtgagaagtcactcactttgacaagaacagcatgggggaaattcgcccccccatgatccaatcacctcctaacaagtacctcctccaacatttggaattaaaattcaacatgagatttgggcggggacacagagtcaaaccatatcagattgcaagtcagtttgctataaatgcagaaagtttgctgtcatgtcaactattattttcaacaataactttttactgttttgataaataatatatgcttatatattattttatgtatgaataatatgacaaataacaagaaaataagtaaaatctcttaatggtatttatgcctcatttttggctaccatttgtacttactttatataatttgatgtaaattggatcatatacctgcttatctgtataatcacacacacacacacacacacacatatctgtatataacaggtttttaaaataagaatagaatcatacatgcttctttgtatcttgcatagtagaaatccctttaagtgttttataatgatagtataaagttccatgatgtatgttctataatttatttgatcatttccttgctacttcaaaaaatgcggcatcaaacatctctatcatatgtccttacgtactggagattttatttctgtgggatggattttgaaatgagagttctaggtgaaagaatatgtacattttagattttaataaattttacatgtttactttccataaaggctaggataatgcacatgttcatcttttctccctaattttctgataattaggaattaatttcatcaatttgatgggtaaaaagggatatcttactattttaatttctttttccatgacacagacaatacacagggattttgagaaattttttttggtcatagtttattggctatttgaatgactcttcagtgacttgcattctgctcattttcagttctgttgttcatcttattcttatcaagtgtaacagcattttgcatactctagatatgaattctttattagtcatatgagttgcagagaattttgtccaaactattgtttgtctcctgtttttcttcatggcactttttataacacaaaatttgaaagttttaatataatcaaatagttactttttgttttacagattatgtgtttcttggcaaaaagatacatattggcccctacatttttcccctagggtttttatgtatatgtgtatgtttagatctttaattgagattactttttgttgttgttgttgagacagagttttggtcttgctgcccaagctggagtgcgattgtgtgatctcggctcactgcaacctctgcctcccgggttcaagcaattctcctgcctcagcctcccaggtagctgggattacgggcacgtgccaccatgcctggctaattttttgtatttttagtattaacggggtttcaccatgttagccaggctggtctcaaactcctgacctcaggtgatccgccggcttcggccttccaaagtgttgggattacaggcgtgagccacggtgcccagccatgagattacttttgtatgatattagacaggagttaactttcttctgatggatattcagttgtgcatcatttaataaatgaattatcatttcctgctgaattaaaatatcacctttatctgatactaaatttccatctacactggactcagtttctgggtttgtgtttctctgagctattgtttttttcctattccagtcctttctgtttataattatggcggatttaaagtgttttttttttttttaaggaatcttttttaaagtctttaattcttacttttaaaaagtgttttaaaagtgataagatgatttcctgtcactattcttttttttttttttagtaagttttcttaaccctttttgtatgtttattttttccatacaaactttttacattgtatactccttgggtaaaatttcgcatacctcaaatagttggcagtcagcaatgcttgtcttatgggttttggtataccacttcctgtgttaggtttctgtgggtcaccaggagacacccctcagcaattagatggcttcaactgacagggcaagttcttctcacctttagggcaggttacttctcttgaaggtcttagtggggtagggagatagcagattgtcacagcaatacttatgcagttgatgcctgactcttagggagagaagtattcaaggaatttatggttcttctgctagggccaagcttttgtaagattcttaaagatctgagcctggcctctgtaacctggtgggctcaggagagttacttagttggcttagtgctgggactggagatcagcaggagtatcttcaagcttctatctttccaaaccccctaggctaacctcactccgtttctggtctgtattttatttctttttaattttcctttcaatttagtatgagctttaagttacaggtaatcagtgggattaatgtactgtatcctttggtgggtctactttaatttttttcttttttgtgttatttatttgttcatatcattatcagatatttattaagtaccttgtatatggcaacatttaggcctatgaagatgtatcacccagtccttgtcttctgagcagcattttgcaaaatttttcttttctttcttcttaaaatactgtcttcacttagtatttacactttctaggttttcattttctttatctttggcattcttcggtttcttttgcttgattcttttcttctggacctcctaaatgatggactcccagagcataatcagtccttaagcttttcttctgctctatttcattccctaagtcatctcacttaatgttgcggatttaaatagcattgatacattgacatctctgaagagtatattttattcagcactggtattttccttgaatttcagccccagatagccaattgccatatctaataggcatgtgaaaattcacaagaccaaaacatattgcaactgtttggcccccttgattttgcatttagtggtccatctgctcatttttcaggttatgacacggctctcttcctcatgttattgaggcctgtttctcctatacttttcttcatagtaacattattctttaccactacttaccaatactttacattatacttgacatatataacatatatatatatatatacacttaattttccagatgctgagagctgttaatctcctatttttagaatcaatttcttctcatatttactgtggtttttgctttatttgattcattacagctgacaaattatgttaccatcgaatttcttttttagagacagggtctctccctgttgccttcttgattttctgtctcaaataatttagaagatatgtggtacgtttttatttctatctttgtttaattttaaactttaaatagtattaattttttttctttttatcaacttcagaaacattattctttcctaggaactgtgaaagatgaaggaactacctcacttccatgacatctaacattcccctccccatatttattatacttcatgatttttgtggttccaatgtatcatagttataatgtattaggttttccttcatgctttataacatgtatatcagtgtgatttttaaaaattctagttctttagcttttaattgtcctgtagtcttttcaaactcagttcatatcttcaatcttctgtgttttctaattcatttttgggaaaaagctttttttgtgatatgaaaggaatttgtgttaattttagaaaatttgaaaaaacacaaaaaagcacaaagaaaaaaattacttgtaatctccctttgagaattatattaataacttagtatacgttctttgtcttttctccctgtttatgaatgttattactttgcaacacttgattctttacatacacagttaactacttttccccttcacttactatgtattgaacattttcctatgacattaaagtcaagctgtagaatacataataatttacatggtattctgtacagacatgttataatttaatcctccattgttagtttatttacagcttgctcttctaaagtgtgctttgatgaatgtggattagttatatcccctaggtttttttttttttttttttagataaagttctaagaagtgaaagaattctgaggctttagcatatggtgattaagagcatggactttgtagactgactgccttgggttcaaatccttacttagctgtatacgtttaggcaattaatcttttctttttctttttctttcttttctttctttgctcccttccctaccttctttcttttcttttttcttttacctttttcctgcagtatgtttcaatttcttaaatttgtatacttccaagataatggtttatacatagaaaacatttagaagagtgtctgggactcaaacacagtcattgtcgtggttgtcatcatttttatttaaaggatgtacatatttgaaatatttttgctatcgattaaatttttctcctgaaaagttacattaatttgcattcctatcagcaaaatataagagtaacattttaccagccctggccaacaactgctgttataattgtaaaatgtagttatttttgagggtgtgggactaattttatagggacaatatatatgtttatcttaatctccaatttttgaatattgattttggattttttttgtccgttttcatatggggtatttatatttaagtgctctttaaatattcaaattttaattagcccaatgtattttatttgcctttattttttctagttggctgtttgcctgttaatttgatttttagttgttttatgtgtttatgttttgcctttgtggaacatgtgtgtaaaggcagttcttttccatacactgtgctttttaaaaaaattcattaatctatttttgataataagtctctttatttgtgttggtataaataagtctataattattaagtaccttctgtttgccagtatagatctaacttttaaaaatagaatttttattgcagaataattttaggtttatggaaaagttgcaaagatggcatagttactatatatgttctttacgcagttttcccttgttgctgacatcctgcattattaccatggtacgtttgtcacaactaagatgtcaacattggtacactactattaactaaatgccacattttatttggatttcactagttttcccacaagtattctttctctgatccaagatcccacattacatttagttgtcatgtttattactctcctctggtctgtgagtttctcagtctttccttgttttttattatattgagagtttggaggagtactattcatttgtttcattgacctttcctctgatgttttcctgctggttaggctggggttatttgtatcaatatagactcatgggtattttaccacttaaatttttttagcattggcctgtcattctctgtgaccctttgacatgatccatactgctcccttcttctgccttttttaaaaaacactttttttcttgtgtaagatgctctaggttaatcttctgtattcccttacctggctctggaatcagccatttctccagctactcctgttttcttttattggagagtggtatgtggaaacataccattgtggaaataccagggtgcggtgctgggtgtgtttttgggtactggtgtgtcactgcttctagtccccctcagtggacagaattagaaaatactgtttgtgcacacacacccctataattatttatattatattacggtaaacacaagtttgcactgatgtcactgattctaatccagtatcacagggttccttctgccctccgtccccttgcctaactgtaacatccccctacaaaagtgagaaacctggctcccacatttaccagccatttacttatttgttcaaccccagtatgtatgtaacataggaattaacccatattccttgtgaaaaacaactttaccaaatcaagcagtgtttatgtatatagctctgcttgcctttagccttacagtttccagtgaaaaagcggtcttctaaagttacttatatcagttccttttccactcacagttctgcttttgatggtatgcctaaaagtgcatcttactccaaagatggactttatatatgtataaaaaatatatatattctatacgatgcatgtttgatatatgtaatatataatgtaacaatatgattgcatgcaatataatgcatgctacatgtaatatgtatatatggtattttatttttaggtattttattgctttatttttaccctgaagtctttttttttttttttaaagacagagtcttgctatgttgcccaagctggagttgctattcacagacatgatccatcatagcacactgtggccttgaactctgggcctcaagtcttcctccaagtagctgaggttacagacgtgtgccactgcacccagctatttttaccttaaattcttaaatatgtatgtctaaggttcattttgtcacttagtgtaaagtattaatataactttttattttaaacaaaagtgccttatgaaaagtcttgatttttctctgttgttgaaaataccacctttgtcatattttaaaatcttatatctactagaagctttctgtgcttttcttactctgttttgttttctattcttattcaagttccaaacattacataactttatgataatttcagcatctggtagattattcctgtttttgcctattcatgttctcttaattttttaatactttctttattccaggaacattttagtggacaaaccaaatgaccaatcttcaagatggtcttcagagagcaactatcctccccaggtaagattacatgtatcccttaatgctgtttagaagtcaccatttaaataaacactcaattgatactagttatctggaatctactaatagtttattctctttttgagattgtgaggtaaatttttattctctctatttttgcttgtttattaaattttggaagaatttttatctcataggcaaatgcagtgtgagatttgatgaaacatggacttttacttctgtctaccagaacagttacgctcaagttattctgtaaatgtttaaggaaatgttagtaaattgaactctgactcaatgactatcttatggggaaaataaacttaaatagtttattttattataatattattatacttaatattaaaataatatttaaatggcatcaggaccatgtgctaaatttcttttccctggcaagtagtgtctggggttgactgaatttaaaatcagtctttcagttatatgcgttcagcattaatatttataatgtattaggcacacgtatgtccatatccttgaagaaattaatgctctgctaggtaaagcaaatgggtaaataatacttactttattttttaattgtagtataattcatggaaatatatatatatatatatatatatatatatatatatgtatgtatgtatgtatttttttttctctttgcctacctatttggatcccctggtgtttacatgttttattgcaaaagacatgtctaaagaatatatatttataatttttgggagccgcagtggctcaggcctgttgtctggtgcataaggaggcgaggctaggcgttcgaggctagcctgggcaacacagaaacctttgatctatgttaaaaaaaaaaaaaaaaaatggctgggcgcggtggctcatgcgtgtaatcccagcactttgggaggccgaggagggcagatcacaaggtcaggagattgagaccatcctggccaacatggtaaaaccttgtctccactaaaaatacaaaaattagctgggtgtggtggcacacgcctatagtcccagctactcgggaggctgaggcaggagaatcgtttgaacccaggaggcagaggtttcagtgagccaaaattgcacaactgcactctagcctggtgacagagtgagactctgtctcaaaaaaaaaaaaaaagaatatatatttataatttttatatataatgtaaagaataagacaaataacctgtttattcatcagccatgtttagaaatggaaagtgactgctatcttttgaagcctcctttgagccccctcttatatctttcctctaacccctccccagtaactataattgatgttttattaagcattttaaaataatattccatagatatagcatataaatattttatgatttaatttttttggctttgactttataaaaataaaatataaattgattcagtcatttataaattttctgtgactagctgttttttaacatgatgtttattaatatcgttatatgtaattgtagtttgttcattttcactaccatatagtattcctgtgtataaatatgccaaaatgtatttatccattttgctgatgataggcatttaggctttttacagttcttcgctattatgatacaagctgctgtgaacattcttatatgttgtctcctggtacacatgtgtaagagtttctttaaggtatacataccttggagtagaattgttgaattatagggtaggtatatgtgtattgaactttatcaggtaacagaagactgttttacaaagtagttgtagaatttatcctcttaatggttgtttatggaagttgctgttggatcatgttctcctcatcacttctatgggtggattttatattttgccagtctagtggatttttcattttaactcattgtggttataatttgctttttcctatttacattaaaatctctttgcatatgttaatggacttacattgtgtttttaatcacgcttttcttgattcactttttcattttacttaattttagtgctcaaattttggtatgttagtgtttttcatttgattatttttatttcttattaatgatcttttctgaaaaaaggaaaattcagtgatcataactgaaactatgataaccttattattttgaaattgtctttatttgttattggactatattttgaaggcagtagaatttaatacttttcttaacttttttgtttgcttattcattcattaaaaaattatttagtaagcatctatggagtgccaaactttaggtatttgaatactgtagggaattaaatattgtctcctcttgatgagcgacgggtattacatcagataccctgaaacatttcaatatgataagtcctatagtagaagttatctgaagtttttgtaatgaagaaggactaatttgtcatgaaaataaataccatgcaatctagttttcttcattgtagttattactcaaatataactggggttttctgtggccagtctcaagggacaacatttttgccagaaaagaaaaaataaaattgaaagcaatttcaatgtttacttagttgtatgagagactgccatgttggatggaatgggtatagttttattttttatttgtttatttatttttttgagaccgaattttgctcttgtcatccaggctggagtgcagtggcgtaatcttggctcactgcagcctccacctcctgggctcaagtgattctcctgcctcagcctcccgagtagctgggattataggcgtgcaccaccacgcccagctaatttttgtatttttagtagatactgggtttcaccatgttggtcaggctggccttgaattcctgacctcaggtgatccgcccaccttggccacccaaagtgctgggcttacaggcgtgaaccatcatgcctggccagcatgggtatagttttcatgtatagttatgtagcaaagagtcttgcacttctagtggttgtaagctataatatttctttcccactcttgatctgaaagttcccaaatgcactggataaaaaatagatatatccacggccggacgtggtggctcatgcctgtaatcctaccactttgggaggccaagacgggtggatcacttgtgctcaggagtttgagatcagtctgggcaacatggtgaaaccctgtctgtacaaaaaatacaaaaagtagtcgggcatggtagcgtgtgcctgtagtccgagatactcaggaggctgagttgggaggattgcttgaacccaggaggtcaaggctgcagtgagtcgagatcatgccactgcactccagcctgggtgacagagtgagagactgtctcaaaaaagaaaaaatacacgcacgtgtgcacacacacgcacgcaaagctgggactttttttttttttttttggaagctggaaccttaaagcaattcattctcaggataagaatgaaacagaagaagtccccacctcctagggaccgtggaaagaattgcattgacactcagtagaggaagggaaaatgaggaagaaaactcgtctctgagaggttatagcttatgtattggtttttgttcacatttggtagtcagattctcattacttgactatccatgaaaccttgtggtatgattttagtttaaagtgattgtggatgaatagtacatttaaggttctcagcagaagcaaatgcagatcttctctgaaaatagttacctttattctaggcctcaggcattctccacaaatcattattagaggaaaattgagcagtacacactcaaagataactaagtatatagcagaaagtaagatactttaagaactagcagaacaaatggcagaaccccttccagaattttagatattagaattaaaattactgaaagatactggagttaagtcaactacttatatttaaagaaataaaagaaattggacactaaaaagtgatgtggcagatttgaaaaagaaccaaataaaacttctataaatgaaaaatataataataaaagtcagttttgacaagattttccactaagcacagatagaaaagatgaaatagaagtcaaattttaaaaaatatttttgaaggtagtatattgaaaataaggtagtaaagagtgatgggaatgaataagacctactatttgatagcacaataggctgactgtagtcaataataactatatatttttaagtaacgtaaggaatgtagttggattgtttgtaacttgaaggataaatgtttgaggttaggggtaccccattctccacgatgtgcgtatttcacattgcatccctgtatcaaaacatctcatgtaccctgtaaatatatacacctactgtgtgcccacaaaattttttttcaaaagtgatggggccaagattcagaagactatgggaatctaaaaagaactactttggggccacttttctactgagtagcctaaagaagttctaagagattaagaagctgaaatagcacctttgacaaacccctggagccagggagttatagattagaagctagaatctggggtgtggtagggtggtagactcctcttgctctgggtgaagaccctgaagctatgtctgaagagtgagcgtgaaccagaaataatctggccctcacagggagtgaagtccagtttcatatcatcccggtacttgaaactggattaaaataatcaggaattggtagtatccctagcaatagacctacagtagaagatatacttttttaggaagctgataccctaggcatgtagttacttttagtttttcatatttggtgtctatcaaaatagagggatttacagataataggagtttcagatacaagtcttaaaataagtgcccttgctatgtgaaaggaaaaaaggagatgaaaattaatattgaaaattttggcaaagaactgaaaactgtattaaaaaataccaacaaaaaatgaaaaatacaatacccaaaatgcaaattgcacttatgagaataaaataagaatgtatgcaaaagcattttctgaaatttagtatactttatgtaaagtagcagtattattataggcaggtattgctaagaaaataattgttgccagtaatataatattgcagatgcaaaaagttattcactttttagtttattctaataagctgttatgtgacctgcttgtttcaaatcacttaagaggatactcatgctgtataaattagttttatttagttttgaataaggagaaaccttatttcactaaatgttgatgtgtttttgaattcttcccataatcatacggtaattgcaaggattaggatacatgtagtagctactttgctgcccttaaactatggcaagtattttggtttcatatacagttgattctggttattcacagtagttatgtcctataaagtagtcatgaacagtgatttagcaaatactgaaccattgctcctagaaaaatacagggttaggttcctgtgagtctttggttaaatattttcatcagctaatcaatgtataatcttgtcttatgtatgtttctgtttaaagaaaccttaatataagtatttttgattcattaacattgaattcacagccaacagtactataactcatatcataatgagtttatctaacacatgtattttctccataaggcatatcatttacttaaactactttggaagaagcttataattgcagtaaaggagttatgatctaacccttattatgtcaattaaaaagacatttgtaactgcctgtacattttaaccaaccctagagagttttcaccagtcatcttgaaagacatgttttccatgacagtatcagtaactactgtaaccacatatatgatgacagggaagggtgatattatatctttaaagcatttatgggattttcattcatgctacatttactctaccagcacagatgatccagaattaacagcaatgttttctcattaaggtctcaaaatattgcccccatcactgtgaaaatgactttaatgtttttgtttatacaaattacaaatactaaaagtgagaatcaaaaaggagataaaagcataagaaatctaaaataaattagaaatcagctgaattccatcatcctgacctcatcactaccaccaccaccaccaccactgccatcattttgaagatgattcagcttaactctgtgcatacactcacacagacacataatttacgtaacatgttggttttataaatgggaataactttttaaaagaaaataattgttttcttttttttgtcctctcatctccttctctctagtaaccaatgctaacaatcaggtttgtgcccattcatatctttatatgggttcattgcatcaaatactaatttaaacatgtacatgcatacatctgtatgtactcacaaacatactggcaagcgcaagtgtcattattcaggtaataatagtaggatcttgttacctacttgatttctgttgtatgaatatctcacagtttgtttatccatatacctgttaatgaacattgaatcgttttccaatttttggctattacaaagatgtgctaaaaattaatacagaagtgcctgggtatggtggctcgtgcctgtaatcccagcactttgggaggtcgaggcaggcagatcacttgaggccaggagttcgagaccagcctggccaacatggcgaaaccccatatccataaaattacaaaaaattagccaggcgtggtggctcatgcctgtaatctcagctatttgggaggctgaggcacaagaatcacttgaacctgggaggcggaggttgcagtgagccaggatcttgccactgcactccagccagggcgacagacaaggcgagaatctttctccaaaaaaaaaaacaaaattaatatacaagtctttgtggttttaatttgcatttttaaaatgattaatgatgttaccattttttgtatgcttgttgccttcttgactgttttctggtgaagtgtctgttcaaaaggtttgtcgttttaaaatttgttgttattgttcagttttgagagttctgtgtatgttttgtatttaagttctttatcagatttatatatgatttgcaaatattttctttgcatctgtggtttccccttcctgttctccccactcactgccccagccttccttctgttccaatattagagggaatcatcattaagcatgatgcttagctatagatattttattttattttattttattttagagacagggtcttactgtgtctcccaggctggagtgcagtggtgcgatcttggctcactgcaagctccgccccataggttcatgccattctcctgtctcagcctcccgagtagctgggactacaggtgcccaccaccacgcccggctaattttttgtatttttagtagagacagggtttcaccgtgttagctaggatggtctcgatctcttgacctcgtgatcgaccctccttggcctcccaaagttctgggattacaggcatgagccaccacacccggccagctacggatattttatatatgtcctgtgtttctttgagaaaatttcctcctgtttgaagttttctgagaatttctaatcctgaatggatattgaattttgttgctattgttccacaccttaaaacctttttatgtttctctacttgtcctagaacagagtccaaatttcttaatatggtcacaaattacacctccttccagcagaaggtgcagtctcttctacctcatgagtcttggttggtcttgtgattttctttgaccaacagaaaagtctaagaaagtgatattgcaacttctaagcaaggcctgtagaagcttagagataaatgtgcttgaggaaagcctatttagcttctttgaggttgaaagcccaatcccaattaaccccagccttcccattccccactccagttaagcccagtcccctagccaatccatcagcttaatacaactacatgaatgaatccagcagctaccaatggaaaagctgtctagcaaacccacagaatcatgagaaatcatgaaccactgttgttttaagacactggagtgatttattacataacctcagatatacatagatataaaatctggacttttctagtctcatttttgtacttcctgtttctttgccagttctttccatcacagtaaatgatatcaccacttaccctgttattgaagtcagaaactatgtcatcatccttaatgcctccctctttttcccctgcatccaatctgtcaccaaatcccatcaattgtttctccaaaatgtgtgtcaaaactgtctactgttgtccatctccacgctattttagtccaagtctccttcatctcacctctttcctgagtttattgtgacagcatcctaactggtgtgccagttcttttaatccgctctctgtaatgcacattgtgtgcatatgtgtgtgtaatgttaatcagatcatagctttttgttgtgcttaatagatcccattgaatttataattcaaacttcatgtaattgcacaaactgcatgatctggtgactgcctcctcttcattttcaacacataccattttctgccctgcctattaggctgcaaccacactggcattttaacagcagtacctagaactaattttcataagcattcactactttttttttttttgcctggctggctctgtgtagtagattgaatggtccctccccccacccccacccctaccaagatatgtgacatctcagaatgtgaccttatttggaataaagtgttagtaaatgtaattaaggtagggatctcgaggtgagagcatctttgattagggtggcctataaatccaatgacaagtgtccttactagacacagaaaagacacagatacagggaagaaagccatgtgaagatgggtggcagagataggagttacactgtcacaagccagaaaaaaaatcaagagccaccagatactggaagaggcaaagaaggatcctttctgaggtcctttgaagggagcatggtactgctgacactgtagtttaagacttcaggcctccagaactatgagaaaataaatttctgttgttttaaagccatcgatttgttataatttgttatggaaacccaaggaaactaatacaccctatagtacacctatagttagctgtgtaactatatttcttcatctgtaaattgaggatgaagagagtaacctgtgttcatatattcctcccactactgctactactgtgaatgagctaatgcatgtaaaagtctcagcaatgtgccaaataagaagttagtgctcacaaaatgttagcgttattttcattgccattcttaacaccaccagcttaattctttttttattgaggtaaaatcacacataatataaagttagccattttaaagtatataattcagtgacatttagtgcatttacagaattgagcaactatcacctccatctagttccaaaatattttcattgtccacaaagaaacttcatatacccagtaaggagtatctccttttcgatctcagcccagtttttgacaaccactaatctgctttatgcctctatgcatttacttgttctgggtaagtcagactggcttttgtatctgacttttttcacttagtatgtttttgaggttaatccaggttgtagtgtgtgtcagtgtgcattccttcatatggcggaatactacattgcacagaaatactgtaatttggccattcatcagtcgacggacatttgggttgtttccaccttttggctattgtgaacagtacccctgtgaacattcatgtacgactgtttgtttgtataccttttttttttttcctcatttcatttgggtttatacctaggagtggacattcttggtcgtgtagtaattctgtttaactttttgaggcactgccaaatgattttccacagtatgtgtaccgttttacattcctgccagcaatgcatgagagttccagtttctttacatctttgtcaacacttacggttttgcattttaaaattattattattattgccatcttagtggatgtgaaatggtattttgtgatttggatttacattttcctgatgactaatgatgttaagcatcttttcatgtgcctgttggccatttgtttactttctttggagaaagggctattcaggtcctttatctgtttttaaattgggttgtttgtctttttgttgttaaattgtaggggcatttttaatatattccagataccagactcttatcagatatatgatttgcaaatattttctcccattctatagggtgtcttttcactttcttgatagtatcctttgatactaaaattttagttttgatgaaatccaatttattttattttgtttgtacttttgctgtcatatctaagaatccggtgccaaatccagagtcatgaagatttgcccgtagtttttgtctaagatgtttaaagttttagctcttacatttaggtcttcagtctttttttttttttttttgagctagagtcttactctgttactcaagctagagtgcaatggcgtgatcttggctcactgcaacctccatctctagggttcaagcaattctcctgcctcagcctcctgagtagctaggattacaggcgaccgccaccatgcctggctaatttttgtatttttagtaaaaacggggtttcaccatgttggccaggccggtctcaaacccctgaccttgtgatccgcccacctcggcctcccaaagtgctgggattacaggtgtgagccaccgcacccggccaggtcttcagtcctaaaggattgatgttggatcagtttttatccattttgagttgatttttgtgtgtgataagaggcaggaccagcaagtttattcttaaccgtctttatcacctatattatccaatatcgtgaagcatgacgtctctccaacaaaacatctgattggtttttctaaatagcttttccaacatgtgttcaaggagtggtaattttcttcttaatttttataatagagaacagtctgcgtgatgttctctatttaattgatcccgttttatccaatgtgtaataggaaaatgagctacattagacgtatctagagtagatttgggtttcaaatttgtaaacttggcagggttgattagtaaatctttgcttctacatctaaaaattttagtgccgctttcaaacattggtttagttattgaagtagagtccatagaaatatgtaattgttatttttgtattctaatcttgttttatttggttttgcatagtttggttatatcttttattgaatactgttctttgattagaagttatctcactagttctttttttcctcccttcacctacagtgttggggataatgtagtttttgggatctactggcgtgaaaagtggttctggtgggataacctttataaggctgttatgtactattctatagctttaaaaaaatctgctagtacaggatggacaaggatggaccttatacattcttctgttaactggcaatagttttaaagttgtctaacatttgttttaaacagaagaggatataatttggtcgtttctttttttagtacttgattctaaagctcgaaaggcctgctatagttcagaatatcacatttggaaaatatgagaaaactcatgtttgcaatttgaagaaatttaaagtctttggtggaatgaatgaagaaaatatgacagagctgttgtccaggtgagttatggttatgttgaagagagctgtcttctaaacaaaacgtagtcttagtctttttgtagctaatctgcatggtttgatttttctttcaaaggagaaaagagtattccttctattctatccctaatgccttagtttaatactgtggcttgagttagctttcttttttatttttattttttaaccaacagaccctagttaatatttttaccaaagaagaaacaaacttttttgtttcatccttttttaactgtatttttgagctgttaatgacttcagaaatattttcagctttaatgaaattttttgctataatctttgctgtaaaaaaaaatacaggctctatccaaaacactaagattaattgccctaatccagaagcaatattctagtggtttactgtaagttggagactagaaagaggaatgttttataaattgaaagatgcgtgactacgccaagcacagtgcctgtcacttggaaggagctcagtaaatttgagttttaataatatttgaccaccgggaatgaaggtgttaatttgctgcccagcaaatgaaaaatcagatagctaatggaatggacaaatgaaaccatggagatttagaatatatttgtgatggctgggtgtggtggctcatgcctgtaatcccagaactttgggaggctgaggcaggtggatcacgaggtcaggagttcaagaccagcctggccagcacagtgaaaccctgtctctaataaaaatgcaaagattagctggacatggtagcggacgactgtagtcccatctacttgggaggctgaggcaggagaatcacttgaacctgggagtcagaggttgcagtgagccaagatcgcaccactgcactccagctggggtgaaacagtgagactctgtctcaaaaacaaaaacaaaaacaaaaacaatatatttgtgacatggtatggcccattaacataatattttatataagcaaatactctatactgtatttaagtcatgaaagtatttcaggaaatgtaaagcaacctgagggtgagtgactttcccataaatcattgtgtcagtcctagttgtttaagtagagaggtgatatccatttatttttatttaggataaagcagatgctattaagccaacagagtaaggttggctttgaaaatttgttgaactataaaagaaacattggcatctcagtcagaattaaataactaaattctttggcgtattctaatatgtggttttaaattgtcagatttgactgtgaattatttttgaatttcattcttaccgttgaaaattttatgttatattcagttatccattcaggacactaggccctgtcacacatttttaaacaccgtagctacattctttataatactgaacatttttcattaatcctcgtataattaagagaatccagttataatgctgttgatttgaatgtaccggttttgacctatatgcccatgttcaactacttgtttatattgtcttggtcataatattttgagcatgagtttaaacttaaaacctgagtgtgcattaattcgtgttctagtgcatttactaaattatgaagtcagatttaatagccttatttttttcccacagtggcttaaagaatgattataacaaagaaacattcaccttgaagcataaaattgatgaacagatgttcccttgtcgattcattaaaataggtaagattttagcattctgaaatagaaacaaattcttgatatcatcagtcagcaaactatagcccatagaccaaatcctgcaggcctcttgtttttttaaatacaattttatgggaatattgctgcgctggtttgtttacatattgtctgtatctgcttttgtgctacaaaagtagacttgagtagttgcaagagaccacagagccccttaaatttactctttggtcctttacaggagaagtttgctgacttctgctttatataaattcattactaagtggcagttatttcaagtggaatcttttccaaatgttttctcatttgaaagttttcttagattttatgggatctagtgatttgattgccttaattttatggaaggtttatcacttatactaaaacaataatattctaaaaccaaatactgataaaatccttaaggcagtatattatggttattatcagttgtgttcttttattttatttatttattttttttagttaaatgctggtcaaacccattaaattgatttaatgacccatcgataggttgcaaatcactgtttgaaaaatattaccttaaggcatgtatttatttagcaagtattttagcttaagaaagtatttataatgcatcctcaaaattagtatttttcaggtgattttgtttcctataggatttattatttagaaggtagggaaattgagcaattaaatcctggctaacatggtgaaaccccatctctactaaaaatacaaaaaaaaatttagctgggcgtggtggtaggcgcctgtagtcccagttactcgggaagctgaggtgggagaatgctgtgaacccaggaggcagagtttgcagtgagccaagatcatgccactgcactccagcctgggagacagagcgagactccatctccaaaaaaaaaaccaaaaaaaaaatacttctaatttataaccatgttgcatacttttgaaaatattatattgatatggggattaaagtgaattagatactttgaagaataataataaaagccagagtccacattttgatttgggagaataattactcttttggagcaaacatagtcattgtttgccaatctatcaagagttgctgccattttgttttgtgactcaaacagttctgtagggcaaaagaatatttgaggtcttaagaaaaactgcttatatacagaaactgtttttggaacaattggattccagtatgtcactttgtagtaattatagtttctgttgttataataaatacttataaattaaaacctatattctgttttcttataagaatttatgagcaagcaaattttaaaaataaatttaactttcggttatttacttcttttgcactgggtaatgttttcatcagtatttagagttatcagttcctaaagacctttgcatagctttaacaattttatgattttatgttgcaagtatacaagcagtggaaattggaaccttttccagccctgtcagccttttttcccctttcttttcttttttgctgagtatttgaatatgtgcacttaaaaaatttccccccagctttactaaggtataattgacaaataataattatatatatttatggtttacaatgtgatgttttgacatatgaatacattgtgaaattattaaatcaagctaattaacatatccctcacctcacatacttaacatttttttatggtgagaacatttaagatctactctctgagcaattttcagttattactatagtcaccatgctgtacagtagatctccagaacttattcttcctgcttgactgaaactttttaccctttcaccaacagccacgcatttctctcatcacctttttaattatagggcataatgatgtcttttacttgatctagggttagtttaatggtatttaggcaaaatgttaattggagctttccaaataatagtagacacttattagcccattttctatttaggatattaatatatagataacttagtatgtcttacttttctcttaaaatatgttaataccggtcagcagtgtatttgcttcccaaccctttcccaagcattctcttaagaacttttttttttaagtaatataaggaaaatatggaactaaaaggccgtatgttaggtcatatttttagtttgtcatattttcttcaaaagttattccagtaaaggacttgaatgatgtatagctctcttttgatgttagtttagcacagacgtttatttcatttaggtaaatcgttagaatttgacttaaaaaaagcctttgagtattttacatctgtgttctatagtgacatgtttgaaagatcttgctttatttaaaaaacaagttaatgcttaaacagcaaaatttctcaatttagtcagccttcaattattcacagtaatggaggggaacagaagcaaggctaacacaatggcagataatctccaaattgtttattgacatgtaactataataattttcatttataatgaatgtagcttattaagcaaattgaagtaagtttggtcataaattgttaacaaggaaaatagcccacatttctactgtgtggcaggggttaacttttaagatctgttgtggataattcagagtaccagtaaagctgaactgatgtcattggactgccttccttcaggaaagttttactttcctttcttaagttaccttttgtataaaatgaggatgttaatgctttttctgtctaatggtaggataggtagctatattggatattttcttgaattctgttccagtttgtggatctgtggttttaatttaagagtacatttatggaagaaatgattgcattttggatatctcttttgcacattttcgtacttatatttttaaagtttgtgtttacatgccttcttacatgtagtattctagggactttgatgggacttagtgtagaaggacagttggccttagaaagaagcttggttttagataagacctagaggtgaaaggaaaatttagtaacagaggtgagttattaattgggagactggattccagagggcaagttaaagtttgggaagggaaagctcagcaggagattagatcagaggaaagtaaacataaaatgggttgagggtattggttacagatggctcaaagggtttacattctgatttatagccacaataacagctgtatgaggaaatcaggggtaggtgagggcaaaaagaggtacagggtcttggaaggattcagggggagtcttggtttttggtaaatggagagatgtggatttttgtaaaggagtcagctgcagcctggatgattgtggagacttcagagagcggctttaactctggctggatgcagcatgaaatctgagcatgaagtctgggtattagttccaggaagccctttaggagagcatgtggaaaagtgacattttagaagtatactattaagaggaaaattaatataataataatagataataacagctaacatttattgaacacttagtatgtgccagttactgtgctaagtatacttatgtcattaaatctgtagtagaatagtagatgcactctttcagaatagttaatcttgaatttttaggatctctcagaacctctttttttttttttttttgggaggtggagtttcactcttgttgcctaggctggagtgcaatggcacaatctcggctcaccacaacttcctgcctcctgggttcaagcgattctcctgcctcagcctcctaagtagccgtgattacaggcatgcgccaccatgcccggctaattttgtatttttagtagagacggggtttctccatgttggtcagactggtcttgaactcccgacctgaggcgatccacccgccttggcctcccaaagtgctgggattacaggcgtgagccactgcgcctggcctaattttttttttttttttaagaggcagagtcttgctctgttgctcaggtggcacaattagagctcagtgcaacctccagttcctgggctcaagccatgttccggcctcagcctccctagtagcacaccaccacacctggctaattttaaaaacaatttttttgtagaaactgagtcttgctgtcttgcccaggctggccattttatgaaaaaaggtgacacagggatgttgattatattcatgtctgattgtccaatggggaaaactgatgactgaatcctagaatacaaactgctagccttgggatatgtattaggagtttctaattcttttatttgatgagggaggcatcttttatcagggaacaaagaacacgtgcctggagctttaattcacttttagatttcttagtgttctaatatgcattattagtattgttaatgctaccaaaaatcactggcgtttgaagtgagtggacatcattctgctcattttttacatacccttttagtctgttgaaaattaattatattgtttattcatctgtaatatatatgcccattggcaagataacttcatgatttacctccttcctctaaaggtattctttaaaggtattaaaaattataactaattttattctagaaatatttctattggaccattgggtaacagattaaatttcactgcaagtgttttaaaaggtttttgttttgttttgttttgttttgttttttaagagacagggtctttctcggttacctaggctagaatttagtagtgtggtcatagctcactgtaacactgaactcctgggctcaagtgatccttcatctggcctcccaagtagccaggactacaggcacatactatcatgcccagctgatttttaatttttttttgtagagatagggtctcactatatttccaggctggtcttgaactcctgggctcaaatgatcctcttgcttctgcctcccaaagtgttgggattacagacatgagccactgcaccaggaccaataaatgaattcttaatgagacttggacctggaaatctctaatattttatgtctggtgacatatatagactatattcttggtgcttttagtttagaatcattattttattctgactcttatactactagatggttattgctatgtgatttagtagataaacttttaaatgacactgctacataaagaaacactaaaacaataaagataatttaatatttgttgttaaaaaaaaactttttgaaatgtgtgttgtttacatacataaacagaaaggcatattaaatatcccagcattccttcatacatccttatggctggttgctactgcctgtgtttttattcacacagcttcctttatatcagtggtccccaacctttttgacaccagcgaccagttttgtggaagacagtttttctgtggacccagaagttggggcagggtatggtggagagatggttttgggatgaaacttttccatctcagatcatcaagcattagattctcataaggagtgcacaacttagatcccttgtatttgcagttcatgatagagtttgcagtcctttgagaatctaatgccaacgctgatctgacaggaggcagagcccaggcagtaatgctcccttaacacactgcgcacctcctgccatgcgtctgggttcctaacaggccagggacctgtacaggtttgggcctgggggtttgggacccctgttttagatgacaaaaatatataaaagtatcataccccatacattttccttattcagtcggatattggaaatcattacgcctggtatcagctattctggatattctattttgatgcttcatcaaaactctacaaatgttagtttcttaaagatagttgcattattgattctgaaactgcatcagtgaatctgttgttacattaaaattcactggtctatcttggactttttacccagtggtctgtcttggactttttacccaggtgtgattttgtaacattcattggttatttagaaaatatggttcactgaattacacagatctcccaaatgttgaaacacttcattatgtaatattttaaaaatcacatttattaatatcacatctaatctcatttaaaaaaatctaagtgttgggaatcagttaagctcacagtggtgggtacttatcttccaaaattctaatttttctcttgaaagcttggtttttatccttgacagcaaatatcgttaagtattttccttgaaataacatgtaaatgtttggcaaatacccaaatctgaataatcataggttgtctgtttttctttcaagaataaaatggcattccatgaaaaataaattgatttttaaactcacaacttgaataattgtacaggtcctttccttgagataaccattgtggtttggtacacaacaaaaatgctttatatgcaaatctcattttgtcacacaggatactagacagatgtgtacttgatgggaatttaataaaattaatttttctgtgccattggtaaaaattatttttattttattttattttattttattttattttattttattttattttactgccagtgtatggtggtgaggcatacagtgcaccttgtacttactgagcactaatagtactttttggtgccattagtttggtaccaaggtgctagcagttttacacaccattgcttttgtaccattagtgcaatgttgctattattaaaaggctagaaaagtgtttattatgttattttgaaaaatagttgttttgaaaaataactagtgttgttattaaaaaaaaaagtagttttgactacgtgggacctctggaaagaccattgggattttgattgacatgatgttaaatttataattaattggagagagctacacatttacaatattgagttttcctatataggaacatagtatgttctttcatttattcaattattcactaaaattttatattttcttataaatattgcgtattttaagtttattctgaagtattttcagctttttgccattataaataggacttttttgaggtatattttctaattggttattgtaggtataggaaaagttgatttttgtgtgtttaccttgtttacaaataaaaagtttttcaattgaatatatatatatatttttttccactgagacacagtcttattctgtcgcccaggctggagtacagtggtgtcatggcagctcactgcaacctccacctcctgggttcaagtgattctcttgccacagcctcccaagtagctgggattataggcgcacgccaccatgactggctattttttctatttttagtggagacagagtttcactgtgtttgccaggctggttttgaattcctggcctcaagtgatcctcttgccacggcctcccaaagtgctgggattacaggcttgagctactgctcgtggctctcttgaatttttttaggtagacaggtcatctttaaactacaattcgtttttcttaatttgtttgtttgtttccttattgcactggttgagacctctaattagtgacaaatagtagagatattggacatctttgtcttgttctgacttgagtgggaatatttagtattttcccagtaggtttaatttttaaggtttttgatgctttttaaaaaaatctaaggaaattttttattgccttatattgcttatatattgagggtttaaaaataataatgtatttaagtcatcaaatgtgttttttcttttattttgttaacgtggtagattatattaatatagctcctattatttattgaaccatcatctttccattcctggaatgagatctgtttggttacaatgaaaatctgatagaattttttgcaacttttctccttttaatttgtatttaaatatgtattcatagctgtgattggccttaagtcttttttcttctgatttggatttcagggttgtgccactgataaataatttcagtctctttcagtgttctgatgtagactaaattctaaagtaattttttgctgcttgtacatttgataaaatttacctgttaaatcatctaattctggtggcatttatttgggggtagacatgtgcacatttttaatttatcttacagtgtttttattaactaaggaaatcttatggtggcatgggtcatctgtttcgttttactgttgtagccttagcaccatgctagtcatataaaagatgcccagaaaattcgttgaatgaatccttataaggttgaatagtgcttttactttgctaaagttttatttgaactgtgttaatatttttcttcttctttttgttttttctccttaaagttccactcttgtcctggggacccagctttaactttagcatctggtatgttgaacttagtggcattgatgatcctgatatagtacaaccttgtctcaactggtatagcaaggtaggactgtgttttaaatcctgactttaatgcctataaaaggagaaatatgtcaatctcttatcttcattgagaataatttaaaatattcaaaataataataacaacagttagctaacattttattaagcacttccagtctgccagcttttaaggaatcctgataactcacttagtcattatcactctatgagacaggtgcacttattatccccattagtttatagatgaagaaatgaagaacagagagattaaatagtttgcctaggatcacacaattgtaaagtgtttgagccagtatatgaattcaggcagtttggctccacagtctgcttttatgttattatacccatttgactctgaattttgttttttcacttgtattcatataaatacttaaaacatagtttttagtgggatagttttgcagcctaatggaaaatttaagatgtggatgtgatttagactcctaaagtagtcaacagggttaaaaaatactgctgtttaatataactgtaatatatattgttacatggtagttatgataagtcttttttagaggccaagagtaagttaattatagttaactaattataattaagttgttaattaattatagttaattataacgtgtaaggattaaggtgtttaatgaccttttattagttaagtcagctatcaactgatttgtttcaaatcttatacatcttcctaaacacattattttcttgccttattaaagggtcatgcctataagtaaatcattgttgtttgattatcatgcaggcttccatgtcatctgtttgtttgaatagtggtatacttaggaagtttgaggtagtcccagaacatattcctgaagttgagatttttttaaaaaaatcctttttataagattgtatttttggcatctatcctattaggggaaaattttaataaattaagtgcctgctttttggattccagttaattgagatgtctactttatagctgcttaatagatgaggtagttcaggcttagaaaacaattaaattgggccgggcgcagtggctcacacctgtaatcccagcactttgggagaccaaagtgggcagattgcctgaggtcaggagttcaagaccatcctgaccaacatggtgaaaccccgactctactaaaaatacaaaaattagctgggcgtggtagcgcgtgcctgtaagctcagctacttaggaggctgaggcagaattgcttgaacctgggaggcggaggttgcagtgagctgagattatgccgctacagtccagcctgggagacagagcaagaccctgtctcaaaaaaagaaagaaaaaaaaaaagattaaatgtctctttttgatgatttttgagtcataaaatgtgtttgtaaatttgaaatatctgtatacttgatacttgtcattcaagtaatagtttatttttaaaaaccaaaaatagcataatataatttatgtggattatttaatgttcttttgtgctctcagtacctgcattgtaatgggattaatagatgctatggagttataatttttacagtattaagtggagtttaagaaatagatgttctccctttcttcaaagttgaggctctggaattaggtttggtttaataacttttggctacatattttgtgaccttgagcaagttattggaacaggccaagctttagttttgctagttaaaagagccaaataatgatacctaatgaatcaggttagtaaactgcttggcacatagtgttaataaatgctcagtgtagattagttatttttactgttgttattgtttcctacagtatcatctaaccaaatctcttctttccatacttactctgtgttctagtagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatggtatgaaacttagattggttattagggtaaattcaagtacatacgggaaactttttctcaaaaataatataggcttatgccagttattactgtaattttttttcttggttttttactcggttaaagattgttatctctttggattagggacttctttcatgtaaaatagatccatgatgtaatgagacttaaaaaattgaaatgtacttgaactcacatataaatttaagttgtcatcttgggaaaccatgcacttacaaatgattaactagcattaaactgtatcagaaataatattttgatattggtagccaatattcattaacagtgtagttttgaggagaaggggggctagataataaaaaatgttattagtaaacaattatatataaggaacaaggagatttgtattgaaaacaacttccttgtggtgtgaatgctatataattgctgattttcttgtgtgacctgtagtctggctttgaaagaaatgtgaatagttgaacatctgtattatctcccagggtattggctttggagggtaacactcatttggatttttaaggtctgatgtgttttgttatttaaactaaaaagggactctgttgttgcttatagtatgacttttttttttaatcttcctcagtaactttcatagtgacaaacaacagaatagttgcacaatataaaacttgtggaattgaatttggtgcatcctttataggaagaaataagaaataatagattattcagtggtttgctctcattttaattttatcactgttattatcgtctattattaggtattcatatttatcagatattgggtagctaaaaaaaaaccagacttgtactgccttgagtttataaatttaaagttaacttaaaatgaattgctttgagctccactttttgaaatatgacaaatctgcttctaagccttgtgcattgttattgcttacttgattgatgatgatacttgcaaataaatgataggtatgtttgaaattgagtatattttggagtataaacaaacaaataactaatctcttaacagactttaaaatgctaccaataaaaaaaaaatatatatatatatatatatatgccatttctaggagtgaattctgtgggttttttttaacctcataagatgagggaggcataggtaattttagggcttttttgtttgtttcagatatttatcagtaaggcatttgataccattttgtgaagggaaagcaaaacaacagccacaggcaactctacagttaataagctaaaaacagttatattttaaaggtctctttagtgacgtactcagttggttaagattagctgataaaaatcttgtgcagttttgatatctacagagacttaacttatcctttggctctagaaaggaaccaagtttagagaaattagtagttgctcaattcttgaaacttacagccacatcatagtttttgtactgtgaatactatgggctttctaaactggcctggaacactgttagttaataaacattcctttcagggttgttctctttgcttctgatctcattgatgatgatttgttggacaaataaggaagtaaacagtgcagagttttttggcttctgctctattaaaaacatagcagagaaggacaagaagttcctgcctgctaaataggaagatctagggaatcaaaagagtctctgtcaagcttcttgtaatggaggatacaaaagctacttttagtatttttagtatattacttagtatgatctttaagtattttctgtattttaagaaagtgtaaggctctatttatttctgtaataggctttttgtttgtctagaaacatcactgtatttacatttcattttattagaggtgattttggaaccaataattgctactacctctttgcccatgcaggatccagtgatgataggcaaaagtaatcacctagggacaggaatgttttactcagacatgtagagattgtactgaaatccaccctttgctgagcttatcttatttgctatagaaagaaaaattttcttttgtgagataagggaaggataaagtttaataaggtagtcataaagtttcaacctgaaatctctacctttctccctttgtctttccctgcttctttcttttttctgttttcctggtttaaaaaataatctctccactctggttttttggattgtgcagtagttgttaattataggcatatcttggagatattgcaggtttggttccagaccactgcagtgaagtgaatgacacaataaagcaagtcacaaattttatttcctttgcatgtgcatataaaagttatctttccactttactgtagcctcttaaggtacagtggcattatttctttaaaaaaaatgcatataccttaacttaaaaaatgctttattgcttaaaaaatgctaatgatcatctgagccttcagtgagttatactctttttgctagtgaagggtcttgcctcagtattgatggctgctggctgataaggatggtgattgctgaaagttggggtggctgtgacagtttcttaaaataagacaaaaatgaaatttgctgcatcaatgagttcttcctttcacaaaagatttatctgtggtgtgcaatgctgtctgattgcatttgacccacaatagaacttctttcaaaattggagtcaatcctctcaaaccctgctgctgctttatcagctaagtttatgtaatattctaaatcctttgttgtcatttcaacaatgttcacagcatcttcatcaggagcagtttccatctcaagaaaccactttatttgctcattcataagaagcaatttctcatccattcaagttttatcatgagagtgtagcagttcagtcacatcttcaggctctacttctaattctagttctcttgctatttctaccacatctgcagttaatttcttcttctgaagcctttaacactttccacatcatccatgagcattggaatcaacttcttccaaactcttgtttatgttgatattttgatctcttcccatgaatcatgaatgttcttaatggcatctagaatggtgaatcctttccagaaggttttcaatttactttgcccagatccatcagaggaatcactgtctgtggcaactatagccttacaagatgtgtttcttaaataataagattttcttgaaagtctaaatgactccttgattcataggctacaaaatggatatgtgttagtaggcatgaaaacattaatattcctgtgtttctccatcaagctcttgggtgacaggtgcattgtcagtgagcagtaatattttgaaagaaatctttttttctttttctgagcagtaggtctcaacagtgggcataaaatattcagtaaaccattctgtacacagatgtgctgtcatctaggctttgttactccatttgtagagcacaggcagtagattcagcttaattcttaagggccctaggatttttcagaatagtaaatgagcattgacttccgcttaaagtcactagctgcattaaacccttgcaagacagtcacactatcctttaaagctttgaagccaggcattgacttcactctagctatgaaagtcctagatggcaccttcttccaatagaagtctattggaatgttttgtctacattgaaaatctgtttagtatagttaccttcatcagtgatcttagcaagatcttctagatattaataacttgctgcatcttctataatacatcaacacttgtggctttactttgcacttttatgttacagaggtggcttctttctttaaacttcatgaaccaacctctgctagcttccaacttttcttttgcagttttctgacttctctcagctttcacacacttgaagagagttaaggccatgctttagattaggttttggcttaagggagtgttatgactggtttaatctatccagaccgctctaactttctccatattaacaataagtctgttttgctttcttatcagtcatgggttcacttgtaatttccttcaagaacttttccttctcatttacaacttggtcaactttagtgcaagaggtcaactttcagcctatcttggcctttgacatgccttcctccctaagtttaattatttctagtttttttatttaaagtgagaggtttgtgttgaacacttaaaggccgtggtaaagatattaaatggcctaatttcagtattgttgcatctcagggaatagggaggcccaaagagagggagagaaatgggggaactgctggtttatggagaagtcagaacacacacaacatggtgcctcaaaacaattacattattaacatcaaagatcactgatcataggtcactgtaacagatatgacagtaatgaaaaaggttgaaacattacgagaattactgaaatgagagagagacacaagtgaagaaattctgttggaaaaacggcatccatagacttccttcaatttgtaaaaaacacagtatctgtgaagcgtggtcaagcaaagcattataaaggcatatgtatgttgaattatcttaattgattttctgtttttaatgcaattttgtattcctttttacaaaccctacttgataatggtgtcttactcttttcaggtattgtatttgatctgccacctttttatgaagtatttttgcatatatttgtgtatgtaagatattggtctgcagttttcttttaatgtgcatgtcttgttttgttatcttttggtatgtttgggtacttccagtcttatagaatggggcaggaatctaaaagtgtttgtgtagaatgagtagtagcttggtagaatttactagtgaaggcaactggacctgaagttacctttgtgtggaggtttttgtgttcttttggcagggtctctctttgtcacccagactggagtacagtggcatgatcagttaactttagccttgaactcctgggctcaggctatcctcctgcctcctgagtagcctggactattggtgcatggtatcatgcctggctaatttttaaaaatgtggagatggggtctcgccatgttacccagactggtctttaactccttgctcaaatgatcccaaagcactggaatttcgggtgtgagctatttgtttgttttctctttttcttttcttttctttttttttgagacagggtctctctctgttgcccaggctggagtgcagtggcacagtcacggctcactacagccttgacctccctgggctcaagtgatcctcttaccaagcctcccaggtagcagggactacaggtgtgcgccactacacccggttaattttttgtagagatggggttttgctgtattgcccaggctggtctcaaactcctgggctcaagtgatccacctgccttggcctcccaaagtgctagaattacagttgtgagccgccaccctcagccgaattacttctttattttatacttggttaaaacaaacaaacaaacaaacaaacactttccagtgtctgaagctgtctgtgcttgaaatttggtgggtgggagtgttttttacctatcagtttaatttctttaaacatcataggactaatcagagttgttaattgtttggttcaggtttattaaatgatatttttctaggaattgtctataattgtctataatcaaaaatttcaaatttatgggtattaaggtatacctaatatcttactgtttgtttagtgtttgcaggatttcttgagatgccccttttttgttacttatcttgaatatatatatatttttccatcagcacatgtttatcaagtgcactagtctcttgagagaaccaatttttggtttgttcatcttttctgcaggatttcttgagatgccccttttttgttacttatcttgaatatatatatatttttccatcagcacatgtttatcaagtgcactagtctcttgagagaaccaatttttggtttgttcatcttttctgttatttcctgtgtccttgacttatgctctgtttactgttgtcttccttctctttttgagattaatttgctgtctttttataacaactttttaagccagatgcttagctcattagttttcagactttgaaaatttcccttatatacatttaaatatataaaatttcctcctcttgttctttagttgtgctatgaagtatttttatttttgttcagtttagtattttcattatgaaatgaaatggctctttggaagaactgtggtttttaatttacaaatttgtggcgatttactacttgttttctttgttagtgatttctggcataattgcataggggccagagtgcatatcctgtatgtttccagtcctttgaaatttaatgagacttgctatataacccagcttattcaatttttataaacatatcatatatatttgaacagaatgtgaattctttagttgttggagcagtgttgtatatttgttcagttggtcagagttgctaatcatattgcacaaatctttatcaataagaattttctgtctgattctcattactgagaaagatgttaacactttccactatgatcatcgaattatatgtttcctatagttggtccaattttactttatacattttgatgccatgtttttaattgaaaacaaattttaaattattttgaattaaatcttttattatgaagtgcctttttatctctagaaatatttttgctttaaggtaaattgtattaagatctgttttcatttcttatttgtatggcatatcttttccatcttttattttcaacctttatccctcttaagagaaatatctcctataaattttatttaaataaagaaaattttattttattaataaatcatttgacttatgattagtttagaaattgcaagtatgcatgattaccttaacaaaattgatcagtgccttttctctcttcccatgtgaggatttagtagactttcagcttcatattctcaccttctaattcattattctattgttgtcaattgctctattgttgtcatttattttgataccatgttcaaagaccctataaaatatttgtcttatacagcaattgttcattaattttacccaaatatttactgggttttttttctcttcattattgtttgcgtctttaatcttatgtctaggattgtgttcattccctgtgccgtaagcccatcctttagaatttcttctataatgcagctcaactctctcagaattgatggcctgaaaattttgtctcctttataggagggtatttttgctagatgtagaattccagattgacacttactttcttgaaatacattttgaatatcattcgactgttattaaccagcttccttgttgctgttgagaggtgtgctatcattttcaactgccattttttaatataatctttttccctctgactgtttaaatattttatatttgttttagattattttgtagttacattaacaaggctgtccgaaactccagtgtggcagccctgttaactattgtctattttggttttctttcaattaaatatatgttgcctttgtctatcatttattttctcctttatcttttttaactgcacatttctgtttaatattttaagcttctctaaaccctttatcccatttccactactatattatttttagtgtctctttcttacactttgaccttcagttctgtgatattttcaattttttcattcctcttttctctcatttctaacaattccatttttgtttcctttggttgtcttgccatttcttttccaactatttagatgtctactttccaactgcttatatctctaatctgtactcatgtttcatagagagagttgcttttttttatttgtggaataaatttgtggaaaggtatttggctactttcatctattgcaggctacatttttctgttgaatcagattcatttgctactttaaaaaattcatttcttttcctttttatattgtggcataattcctgggttgattcttttttaacattattaatattttaatgtggtgaatttttcctatttttagaagcttcttgtgagttaggaggtagggctgtgttccaggatagcaagatttttccttataacaccttttttctctttaagattttgtttcttagcaatgctcataatgcaaaaatctcacttttttcccctttcccaactgccagacccttttcctgaaacatggtttttttttttttcataatttttgctcatttatgcctttgtgcctttgtgtatgctgtattctctttcctattactttcctttttatataattcagttccagtgcattcttcaaagccaactctttcaaggtatcttctttcattatattctcactgaatcactccttcctcctcttaactcctatttgccttggtgctgtatttctcattttgttcataaaagattgttaattttctgtcaagtacatttccaaacactgcatcattgtcatcatcatcatcatcatcgtaagtaacatacatctgagagcttgacaatgtgccgtttattctcctaggccttttacgtgaatttatttaattttcatacttaccttctaggttaagtattgttgttatttccgtctaatatatgagaatgattaatttgcttaagatggtgtatctagtaagtgacagagctaagatttgaattcaggtagtctggtgccaaaaatccatactctctatctctaagctttaccgtcttagtaaatatttactagttcagtgtcataatattgactattatattcttactggtataatattgccctttttttcagaatttggacaaactgatgaaatcagcttcttaaaaattctttttgatctaatcattcttgaatggtcaaaaaggattttatgctctataagttatttacctatacatgcattttaaattatttcttttgtatgtaatctctattttggtgcaaaatcaaatttgataaaagtttgagtttaccaaatataaatacatacaactaggcagcagtactataatctatgtggatttttttggttttgttttctttttaattctgggcaagagatttgaaattttttccccttttggtgaaagcttcctaaatcatgttttttaaatcatgttgtatgtgtatgtgggcatgtgtgtgcaggcaggatttctgtgttgcccagactggttttgaactcctggccttgaatgatcctcctgccttagcctcccaaaaccctaggattacaggtgtgagccaccaggctgggccatcatgtgcttttttaagagagtatccactattattggagaaaagaacagcttgtgctcagtgaggactgtatgaaatatatttattatagtcataattataggagaaaaaatgaagtgatattggacctggagactctagttaaatagtttaaaaattattaacaactagttcttagtgtgctttctcctagtgatattttaatttcttttggatagttttaattttatctgactgttctgatctcttgctttagatttttgtcaaaaatagacttacagaaatattagcaactgcctgacttcttctttaaacagaaataatttttgaactcacatggttcacaggcatctttaaatttcttatttactaatttgtttctaagattttcaaacagtgtaatggatgtcatatttttatagatgagaatatcattgtttcaatagagaggctgacttttgctgaattatatatctaaagcaagcctaccaaggcaaaaggccttattagcaagcgtttgcaagaattagaaataatagggagcatggagattatttgggatgcagaggtgtcaactctttgtttttaggttgcgaaagttgcaggaagttcttttacattaaaacaaggtagtaaaagcaatgcatttttttaacctttaccctgctttagtatttgcagtatttactgactttttgcaagaattttgaaaagtctcaaaggcaaagaagaaaggaaatttggtgagcgtgcctgtaggatggaggtttccagttaaagccagctgaaaagtcttgaaagcgaaagggttggttacaactgagcttcataattacccagaaaagaaagattagggggagtgctctaaattggttggtctctggtgaatatataaatcgcagaaaacagttttacttttaaattgagtcacatgacagagtttaatagtaaaagtaactttataaattatgatctatttgggtgcatgtaaaagctagggtttctagcttaaaaagtaaggaaatgttattgtagcacatagcaagaagtccagaggtaaggcagatttcatggttggttgattcagtgatcatttctttctttctctgtgctgtatcatcattatagaattgactgcattcttgtacttcgacaaatttgctttaatatttgtatacattacatgcagatattccagaggaataaaagtagatttttttttctgtatgtctctttagaagtaaggaaaaattgcctagaagtctcccagaagattcctcatgtttcattagccaaaattgggttccatactgttcttaaactaatctttgttgagggccatgggagtagggcttcataattatttaggtgtgtatgtggggggatgtatgtagggagttcagtctccataccattacagtaactagtgtaacaacttaagtagattatgagtttatcaatacagcagaatcaggagtaaggaaaacatggtagaactttagtaccagccccaccatttaagagctgtgtgattttggttaagtttcttactttttttaaatacaaatttctggatttataaaacggagatgataatgtgtagttcataggattgtttttagaattaaatgagatgagacagcataaattctaacatttggtaagtgttccataagtatagttttattactgctgttagtacttttatctttatgtagttttgtactcaaaactgtataataatggaattcacatgttaaagttagtgttcccttttcctgaaaatgtgtcaaggacctagaccaaaattattggagctctattttcttctctagttctcttggatatgggtggcaaaaagtactggcacaaagcactgttgggggaaagagattaggatccaatgaatccatgtcattataggatgtaaagattaagaatttcatagttgaaataaagacaagtggtgggagatcacaaaaagaaaatataattctcctaatctttagttatcctttcctcttcttaattatatttatgataatgatagaaatgattttttaaagatatataagatcttttttcaatgaagtagaacatttattcagattatttatttttattttctcctgcttctattttgcagccttaaattgtcttatgactttttttcccctcccagttcactcccttttccttctttcaaggtctctaaccctctgataatgtcacatacgtgtccgttgaatgcaacagtgactttgtatctaatacatacagtgatgatgagaaacatagtacgtttaatatgagcttcccctaaagcaatttgtttgcatggttgtgtcaattaatattttactatttatatttgaggtagcatgaagtgaaattgaagtgatgcatattttatgaaaatgtgcttttgtattagtgacatattagtaatttcttttaatgtagccttttaaattttaatttttttctataataaataatgtaagtagttaaggtgtaattctttctcattcttcaatatttgcagatggcttgttcaatcagtatatcagtcaacaggaatataagccacgatggagtcaaatcattcccaaaagtaccaaaggtaagccataccttctagattgtagttctttttcattaatgtctcagtcttcagttttcccaaggtagttcaagtatcatagtactaagttaataaaaaagaagatgttggccagttgcagtggctcatgtctaatcccaatacttttggaggccgaggcaggaggattgcttgagcccagaggttcaagatcagcctgggcaacatggtgagacctgtctctacaaaaaattagctatacagccgagtgtggtggctcacacctataatcccaacactgtgggaggccaaggtgggcagatcacctgaggttagtagttgaagaccagcctgcccaacatggcaaaaccctgtctctactaaaaatacaaaaattagctgggcgtgatggtgtgtgcctgtaatcccagctactcgggaggctggggtaggagaatcacttgaacctgtgaggcagaggttgcagtgagctgagatcatgctattgtactccggcctgggagacagatggagattccatctcaaaaaaaaaaaaaaaaaaaaaaaaaaaaaaattagccagacatgttggcaggcatctgtggtcccagctgcttagggtactgaggtagaagggtggcttgagcctgggaggtcaaggctgcagtcagccgtgttcataccactgcacttcaacctgggcaacagagcgagactctgtctcaaaaaacaaaacaataaccacagcaaaataaataaaaagcagatgtttaaaacaaggcataggttccttaactaggtggcacaattcatttgttatattaaaattttctttttaaacctttttgatttactgccgtaacagaaggttgggcagcttttacacagaatatcattataaactgctttgttagaggcatggtgtaaaattataggctgtgttgtaatgccatacacatgttcttgaaaaccttaagttatgcaaaattatttgctaaacctagcaaggcatataagaaaaatagaaaggcagaagaccattctaaatctgtggaactttataaccagctactaataaaaactagtgtaataattgtaataaaaataaatatcagtacatttaaattaggtatttatattgaacatcatagtgtgtttagagacttaagccctgggctcatgcctctgtctttgaaatgtagatcctagagggcatttgcttctaataaagactgttttcatcaaaacttgaaatcggatccagagtatagtcttcttcatgaataccttattttcatataaggggggaggttttgtcacttcttcatctgtactcactgctttgccagataattaacatagtggaaagtgtagcaatttcttaatgcaactgtttgtgttaaaggaaggcagttctatggatactgagcttttttcattgtggtcttcatatattactaaggacttctctttagttgtgagaaagctttctcctgatagtattgcatattaatatgcaggggaaaattgcttaagaacctccataattgatgttacatgaacatcattctcctattttatcagtcatgtatgaggtaattttcttcaaagacacacatattatagcaaacagacagtaattgtgtatttgcaaactaatggattcaacatataaaatacaaacatactgaaaatgaattcattttagtgctttcttttttccctcagacctctcaggggtgaatatgctttctaaatctattcttaaagatggcgatacggtactgactgatgagggaaggaaagaagaaaagggcaaagcttcaatgataataaattgcacaatctaaaggcttaactattaggataaaggatttggagggaacttctggatgattagccgctgaatacagtagtaatgaaaagcttcagttttgtatcttattttctgtatataagaactgacatttcagtcattttcatagcacccttgtaaaattagtataaaattggatattctcaattttacattaggagaaagccaatacagggaaacttattagccaaagtaatatatttcaactaataggagaattatgaagaaagccttaggctttctagttcatatcaagtaagacattagaatcttacaaccttttgaactactgaaattaatttataacttttttttttttgagatggagtcttactctcgttgcccagccggagtgcagtggtgcaaactcggttcattgcaacctccgcctcctgagttcaagtgattctcctgcctcagcctcctgagtagctgggattacaggcacccaccaccatgcccggctaatttttgtattttagtagagacagggtttcaccatattggctaggctggtcgtggactcctgacctcaggtgatccacccaccttggcctcccagagtgctgggattacaggtttgagccaccgcgcccggccataactttatttatgtaagatttggtgtaaagtaagattagatacaagttgaataatagtgttctcttttggaagtttaaataaagttttactgattgtatttaaacctgcctattaagctctgtgatggaaataagaatcaaagtgaagtaaatcttagatttcctcagtcagttcttacataaaatagttggtaaattaggtgggaactgattgctgaaatattggcacaaaattaatacattatacattatacaaagttatataaaataattacacaaagtacaaaattatacaaaaattttacaaaataattgtatacattatacaaaattaatatcattaatataaaacttgatagcatctttgttttcagtaaatagtttgataactcgactttaaaactgctcatcatactaatgaactatgcctagaatatatacgggagatctaattttgtaattgtttttgaccttcactttggcactcaagtagcttagagatttttgttttatgtttttgtataatattctgtgtctttgctggtttgtggcattgatcataaataaatcaaaaataacttccaagttcattaatgtcctgaaagcatttggaaaaaagaacaagattattataaacacagatttgagtcatactgttacttttatgagtccttttacttattaatattttgaaaaaataagggtgggttatttttactactgattacagacttatgaataaatttactctggatatgctgttctttgttattcctttaaaagaaactattatttcttctaaaggtgatggggaagataaccgtccaggaatgagaggaggccatcagatggttattgatgttcaaacaggtgagtagcagttgcagtggaaagcaaaatcttcattggctacaggcatcgtctaaaccaggcagtggcaggtaaggaaggggcggggggtggggggctcttacacaaatgaaattagattacctaaaaaaagtttaacatgcggccttttatgtgtgtctgtatgtgtgtgtatgtgtctagtttatatgtgttgtattttcatggaaaactggtgtatttctggatttttgttgcacttatatagtagagtaatatgggaattactggaataaagagaactaagatatatttttagaggaagcagatatcaaattaggcagctaagtgttggtaagtccattaattgctaaaaactgttcacaagcctgtaaataatttagttgttgttttttgtttggttttgtttttttttttcctgtcttttaaattttgttctgaagcttggtagcaaacttttttttaagtttctaaaacctaggaaaacttaattaccataatatttagaggttaatgccaacattataataggtctcagattagcagcttaaaaagcaaataataccaataatctaccatagctatattttattattggattttagaaaactttactgcatagaataccactctttccaggcgtaatgaatgctcaattatactgtgtgttatgccaactcatagtgcttcgggaataaaataattgcttggagactcatattctaaaataattaagaataaaaatggttacaatgtagacactaagtcttcttgacatgaatttattttcataatttttgtaagaagagaaattataatttttaatttaaaattaaaagctaaatttctatgataacctctgaactggtttgagactgttattagggtctctttggaaaaggttcatttttaaggtataggaattcactttcttaattttggtccctctttccaaatgcctttctgccctgcagaaataggcttgaattagctatagagtcttaggcatctttttttctgcctgagagtataataaatattcatatgcttatttactaaagagctagatttatatacaaactggttttttatccagaataattatttatgaatatagacatgaaaatttgtttttagattgtctacacagtagcttcccctttttttgaacatagagtagaatttgtaatgcttttcttttttctccatcagtactataaggaaaatattattaaacacccctcccctgcccaacctttttttaaaatagagatgaggttttgccatgttgcccaggctggtcttgaactcctgggctcaagcagtccgcctgctgcaacctcgcaaagtgcttgtattacaggtgtgagctaccatgtccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttctttttttttttttgagatggagtcttgctctgtcgcccaggctggagtgcagtggcgcaaaggcctagatatttttctataatatttttgttttatgcattaggggtaggatttcagcaaagtcttgatggtcagggtccttacccctactccctttaaaaaaatatttcagctaggcacagtgactgtctcgtgactgtagttgcaacactttgggaagccaaagggggaggatcccttgatcccacaagttcaagaccagcctaggcagcatagtgagacccccatctctataagaaataaaaaaatcagctggatgtggtggtgtatgcctgtagtctcagctactcgagaggctgagtcagaaggattgcttgagcccaggattggaggctacagtgagccatcatcacaccactgcacacctgcctgggcaacaaagcgcaaccctgtcaaaaaaaaaaaaaaaaaaaaaaaactcaaagaggaaaaatgttatttgagtaactactagatttactttagaaattataagaaagcgtagcgagaatgactattgtagtcatggaattttactccagatgggacctttaaaagagtaatctctttttgatagcttctaaggatttattataggttagtgaaggtgtacaaagaaaaatcggcctatatccacacttcaatattgacactagtttatagaaagctacagaagtactttagaaatacacttttaagcaaatatttctaccaaagaaaatctggggaattatcctgttagtagatattttagttagagccattttgtacctatttggagtgctttctttttttcttttattcgttatgaattctgggtcaaactttatttaggcccatggttgatgacaaaactagatttttcagcctttaaaagaaatcatgggtggtcatttaatatacagttgtctgttgctcaagttctcatgcttttcagtatgttaccattgccacatatagtgtggaaacagtactaactatacgtggacattgaggtcgaaaggatttcaccagattcaggtggtccttgatatcagtaatagagatggcatataaaacatttggaggtggaattcctcttctgtttttttgtttttattttttacgttcaaaaaatatgtttccaagaagagctatctgaaaccttttgtcgacattttgatatcttagtacagaaatagggatagaagtgatgattcgttttaaatttatcattcactatagaggggaagactagaaggacacataccaaaatattgacgttagttacgtctggtggtacaattaccagtgatttaaaatttttttatttaaaatgtatttttaaaatttctacttaattataagttggagaaaattttactcaacagcattctttttaggaaaagaactgtatttatttgtgaaggtgctttggagtacaaagtaaaatactgagacctgattgtagaaggaactatttttgtaacactaagagaaattgtctcgttagcaccagagaaatggaacaagaaatagagatggccgggcacggtggctcacgcctgtaatcccagcattttgggagaccgaggtgggtggatcacctgaggtcaggagttctagaccagcctggccaacatggtaaaaccccatctctactaaaaatacaaaaattagccgggcatggtggcaggtgcctgtaatcccagctactcggggggccgaggcaggagaatcacttgaacctgggaggcggaggttgcagtgaggcgagattgcgccatcgcactccagcctgggagacaagagcaagacttcgtctcaaaaaaaaaaaaaaaaaaaaaaagagagataaatcaggggtgttcaatcttttggcttccctgggccacattggaagaagaattgtcttggaccacacataaaatacactaacaatagcttatgagcttacaaaaaaaatcacaaaaaaagtctcttaatgttttaagtaagtttacaaatttgtcttgggccacattgaaagccatcctgggcctcatgcagcccatgggccacaggttggacaagcttgagataagtggtagtagagccagcaggatggcagaatgccacatttcatgacatgactctgtctttactcaccaaattcttagaagttttctctagtaaaattgatttgggagttgatttttatttacttattttttggtagatactggtgagacaattaggtttggggttcaaactgaggtaggacagtagtgaggcaacttctgtggattccaatgtctggaagcagaaatatgaggaaacatgccctggaactcaataggaaaagctctgaactttcacaagactgaaattatggttcaggttaaattaaacaggtctctagttgtgactgggtaatccaggactctgatcaagagaaaacaaaagaaatcagaaaatactattcagaagtctaacaactttcatgccttggcattcccaatcttttatttcagctagctattgctgtcgattttttgttctgttctcagtcctttggctatttcatgtttgtttacatgaagcttcatgaatagattttaagggagcccatgatagtctttaaacggtgtgcaaaatttttgtttttgtgtagttttctgggaagattcattacatatatatatgtatatatatatatatatatttttgttttttttttttttttgagacagagtctcgctctgttgcccaggctggagtgcagtggcatgatctcggctcactgcaacctctgcctccggggttcaagtgactctcctgcctcagcctcccgagtagctgggattacaggcgcccgcccagctaatttttgtatttttagtaggacattgttgtgccatgttggccaggctggtcttgaacttctgacctcaggtgatcatcctgccttggcctcccaaagtgccaggattacatacatgagccatcgtgcctggcctcattacagatattcttaaaggacttaatccctatcttaattgacattttatggtaagtactgctgaaccaggtattcaaataaagtgtcttcatacaggtgatattcattattgaactgatattattacaaagtaaaacattgccacctttctactactcttggttttttttccagaatttttgttgctagatcagaggtatgtgagaaagagagtgggaagaggtgaagtcagagaaagagagtgggaagaggtgaaatcagagaaatagctgggggcacaaactgtgttgagttttttaggactttgtttaggactttaacctacatgcagagtgaagtgggaagccattgttgggtttaagaaatgctatgaactgaccttgcattttaacaaaacaaattgagtgaagggcagcgagtcctttaaggatcctattgctcacctgagaagtgattatagcattggcttatactagaatggtagtagtaatgttgaaaattggtcacattttggatgtattttaaaaggtatcatataaatgctaaatgacgagttgatgggtgcagtacaccaacatggcaaatgtatacatgtgtaacaaacctgcgtgttgtgcacatgtaccctaaaacttaaagtataattaaaaaaaaaaaagatagtatgtggaatgagcccatcagctggctgcttatgaaagagtagctattagtgagtatgagaaggtgaaagagaaaaagagagagggggagcacatggtggcagggagagagagagaaactagaaaaaaaaaggtatcatatagagctgacaggattttttgatgaactggatgagaagtgtgagaaaaagaagctaaggatgacttaaagttttgacctgagcaattagaaaaatggtgtaaccattctctaagatgggtacaacaagaggatccaatatggtaatatggtgggttgttcagcaacttgattttagacaagttaagtctgagatgccaattagacatctacataggtatgtcaagtaagcagttggatatattagtttgaggttcaggagatagatctaaccaaagtaataattccctctacatttatgtaacactgttcaaaccattattactacaataatttccacattgttttagagttgttcacacaagtattgtatataccattgctgtctctccagcttcccagcccccatggacaaggggggaaggacagggatcttgccttatttatttttatgactatagaggctagaatggagtagatgtgcactaaatatttgttggattggatcaaagttttaaaattcattttcctttgagtagaaagaaaaatatttacctggaaactgtattcagatactgctgtaaaccttgataagtagatcaggttattatgtcatttattatactaatattttctgtggtggatctgttttattggttatattcgaacatatttaaattttcagattctacttgttatgccatttagactatgcttcccaaagctgtaattatcattacttcgggatctaggtagaaaaactaaatatagagctttgcatttgttaaagtaaaatttgttgctttctgaacttggtttgggctcaagtgcacaatctggtgtatccttgggtttttctctccaaaatttcttctgtgtttctattatgactattagtagcataatttactgagggctttcatatactctaagtatctatttaatcatttaggtaccatagccctgttattgatcagcagttaccttaattatcaggttgatcttaatcactttcaaagagattgtatttatcatcaatctttgaaagaacctttctagtcagatcttaatgatatggcagccacatataataggtaggtgttaagtttgtgggaaggagagttgggtgtctgacatccctgggattgaatcctggctctacccctgacttcttattcgatcttgaatgaattgtattgattaaaatggtgataataaactaagtaattgtgagagttaaatgaaataatgtattttgtatgtgcatatattatttatataacatgcatttgatatgccatatattaatatgcagcagtgattaattatgctgagagaattttatatgactcaaaggaattttcttttgtgtgttttttgcataatttgacaaaatttcactatggaaatgttttaaagtaattaaaaagtttgtgaaaaagtttaaaacaacttgaaaagcagtgttgaggggaaaaagtaactcactcataattccacattctaaaaaaccaatgttattttggtatatttgtttaatcttttatataattggtgccttaggaagggacaccataaatatatttataatatttttgagacaaaatactaaagtgcatataagaattttcttgatgaagatcaggtaggtttagtagtgaagaataactttctctaagtagagtttgaacaaccaggaaattccatgttaacaaaactggtgcataagtagtaaaatatagtttaaagaagcccagttattactttaagtatgcattttaaagttttctagcacaaggattctttatctgttgaagttaggtgcaacatgttgtctgtttgcaaattttttctaggaagaaaatctgtggcttcagataatcaaagagactcttactaactcacaaaattaagaacactggccagacatggtagctcatacctataatcccagagttttgggatgctgaggtggaaggatcacttgaggctgggagttcgagatcagcctgggcaacacagcaagacctctgtctctgcaaaatattttttttagttagccaggcatggtgacatgtgcctgtagtcccagctctgtgggaggctgaggcttgaggaggatggcttgagcccagaagttcgaggctgcagtgagctatgattgtgccactgcactccagtccagtcgacagagcaagattctgtctccggaaattgttttaaaaaaagaacaccttcactagagtaaaacttcataaagttaatttcagcttatttaacatggcttatattttaaagcaattgttgcttcccggtgtctcatataccttgttttcttagatattagaaacttaatagtacctagcttttgttttctttttttagtctgtagggttttttttttcccatattgctgtcttctctaaggatacagtgaccattttaaaaggtgtatgatggcacaaattttattatttaattttcaaagctttcttccctcctaagggaatcctatcattcatgccatggtagagaaggaatgttgtattctgtcctactgaatttgtcctactggatcagttttattaattgtaatccctatacctggcacctctccacttaagattcttcaactgtgacttgggtttcgactgggaaaagaacagtgaatagaaagagaaaagccacgtctattttgtttcagtgtggaagtctgttgagttagaaatatattaataaatttccattgtgttaggctgttccttgttgtgtaactctcattacgttctgagaacctacgatttaagcctttttcttctttctcaatcagaataggtatgaagacttaggcaaagctctaatatttggtatctacaaaagaagttgatggagagttgcttgtcacttggaagagcctttctgtagaaatttgaacctttaactgttctgtagctattatatgaaagtgcttttattattatttttatttatttatttattttttgagatggagtttcactcttgttgtccaggctggagtgcaatggcacagtctcagctcactgcaacctccacgtcctgggttcaagtgattctcctgcctcagcctcctgagtagctgggattacaggcatgtgccaccacgcctggctaattttgtattttcagtagagccaggctttctccatgttggtcatgctggtctcgaactcccgacctcaggtgatccgcctgcctcggcctcccaaagtgctgggattactggagtgagccaccacatccggcctgaaagtgcttttatttttttacatgtggtaccacatagtttttcttgatgttccttaaagaaacttttgaagagagtgcctaaacatgggttttggttgctattacaaatttattcatatggctgtacttctgaaagtaatgtgcatctttcttttacactgttaacagaaagaattctgaaatgcagacttcattaggaatacaaagtatattgtcataggcataacaattcagccttttagtaaggaaagtaactgtatgttgaattcacccaaaagatttagatagtgttgtaatcatagctttatgtaagaatacagttctatttaaaaagggaggcagtgaattcagttgatgatctgctgggtcatgatacttcaaggggatggcttaagaagggaaaggtaaagagcatataaaatatttttcccctcttcaaaaaattcaaaaatatttctgtcttcaaaaattgtcatgttaatttaagtcttactgaacttcacttttagaagcattcagactctatctaaatattatagagttttatttctatcttaaagataaatttgtttcttaaaacctttttttaaaaaatttttttctctcggtgtcttaactaagaattaaggtaacttctttcaccagcctgttaacccttcccctgcctcttctttttgatacatgaattttgtctaagttttgggcccaggctatgtcaatgcgtagtatacacatcctatacagtgtcagagtggaaaaactgatttaattacaaaagtagtgtgccatcttgtggaggattatgcaatcagcacagtctgatttatcctaaaaatcaaagtagaagacagatattgcacttgggcactaaaaataaaaagcctattccattgtgcaaaaagacactgagatgtctttatataccttacatttctacattatttttagtgcatataagatgtgtagattggtactactggtagtcggtagctccagggtttgttttatactggtaccaaattggtacatgtactataccaaagaatgtggttgaattttagtttttgtggcctaagtaatgaaaaatagattgattggtgattgactcagtgttttagaatgaaatttgtttgccgtttcgaacataggccactttacctccaatccctgtcattctcaactccttcagtcagtcctgtatgctgcaagttcagatgttaccttgctacccctctgcctaagatcttctgtggcttctccactgtctgtgtggagtcaagttcaaagtctttatcctgttatttaatcccttccatgatctggacacacctgtcttttaacctcctctccacctcctacctatgtgttcttttaaatcaaacagtgtatttattcatcacacagtttaaccatttaacatgcattatttaatttaatttaattctcacagcagctttatgggatagatactgtatcacatcttagagattaagaaaccaatagttaaggaactgtgtggtggtcacatagctgtggtgatagagccaggattgtagccaagatctgcctgactagagtacatgttcattaaaacacttttgacgtgtttttctgtctctatacttttgctattctttttactctgtttgaaaagccctcttttttttttgttctgtatcctgccttcctgctggtgcataggtcaaataccactgttaccatgaaatctcttctgagtcccctcagccagatatactgtcttccctcttttgaaccctcatggtgctttttaccttgtttatctttcttatgacatttagtctgccctgcgttatgttgctctatttgccttttgatattcttggctagattgtaagttccttgaggatagggactggggactatgtcttctttcttttgaattctctaaagtgctttgcgaattctcagtactcaaaaagtgttgaataaacattcctcaaagtgctgggagaaatggatagacactatagcctatatcccattcagaaaaaatatagagaaggggtgaaggggttgctccttgaagaggatcgtactaccccagatgtacatgaattattatagaacctataagcatgagaatgggcttccataaaccaatctactaccctactgcaaatattaatgctttcttttttctttctacttccttctctctacagttctctccaattatatccataatttttaaaggtctttgatatcctttgtgcattaaataataccttttctggtgtctgtttctggataatagttcttctttgcatgacttaaataattagatgaattaattaaaatttttgttacgcattttcattcaggtatgtcagaaggctcagtttccatccgattcatttaattttactattaaacttcagctgggaccacaaagctttcatggataggaatgacatcttggcttaattccattaggatgcttactgcgtgccagattttattttgctcagctatcaatgaggctgttgtggaaatgtgggttttctttgctgtgagaatttatgcgtacaaagagacctgcttttcagaaagaacattgagaacccagagcccaagaggaagggttattaaagttaatgaaccagggtaaccttatccagagggtgcccagaaacactataaaacaaaaggtcaattgctattgctattttagttatataccccctctccaggcttcagaatttaacagggttaatttcctttatagtgaggacttggcaaataatttttaagccagatgaaaattctttaattttttttttctgtaaaattatgtgtctgagtattactgtgtgccattttggaaacagaatgttacttaacgatgataatggattgttttatagttccaagataggacagtgttttttttgtagtttaaaataattggcattatttcacacttatacagtgccaaaagtgttttatgtactgaattagacatgtagtcagttataatatcatttttattgtacttagtaactacagagtgtttttcatttttatgtatattttaaaggtggaaatgatgttcatacttgacagccttcagaatgttttcatgtaacttttttttttttagatggagtctcgctgtgttgcccaggctggagtgcagtggtgcgatctcagctcactgcagcctccacctcctgagttcaagtgattctcctgcctcagcctcttgagtagctgggattacagatgtgtgccaccatgccaggctaatttttgtatttttggtagagacgggatttcaccatgttgaccaggctggtctcaaactcccaatctcagatgagccaccatgcctggcctcatataacttatatctgaaggacttgacaacactgagagttttgcagatgaaaaaaactaaaacctagggagcttaaatgacctgtactgatcacccagttagtactagaactcagtcctgctccagtggcctgttcttatccagaaagcagtgaagcatttttttatttcccgtggtatttgggggatagaagagacaaatcacttgaaaaatttacttagagtttgaaattatatgcagatatgacagaaatcttgtagaagatagcctaactctgtgaatggcaaaaggttttcttaaatagtcttctagcatttccaagtacactttgaattgtaaccctgcatggtgggatgtaacttagatgacagcttccatatgtacaggcctaaagcgtgttagttagagagtacatgactttacagttttcgtatagtgttttatttaacattaaaagataataattggtgggcttatacaactggtagacttaaaacagttacaaagggggaaatatttgaagaaaggaaacaactttttttttatttttcattttttgagacagagtctcacactgtcaccccaggctggagtgcagtgatgtgatctcagctccctgcaacctctgcctcccaggttcaagtgattctcctgcctcagcctcccgaatagttgggattacaggtgcccgtcaccacacctgcctaatttttttgtatttttagtagagacggagtttcactatgttggccaggctggtctcaaacacctgaccttgtgatccacctgcctcagcccctcaaagtgctgggattacaggcatgagccactgtgccaaattggaaacgcactattattgcatgaagaaggggctgaatggggtggctcatgcctataatcctggtactttgggaggctgaggtgggaggattgcttgaggccaggagttcaataccatcctggacaacatagtgagcccctgtctgtaacccccacccccccaaaaaaagttagctgggcatggtggcacattattgtagtcccagctactcgagaggctggggtggagggattgcttgaacccaggaggctgcagtgagccatgattgcaccactgcactccagcatgggcaacagagagagaccgtgtctcaaaataaataaataaataaataataaaaataaagaaggatctatgatacacaatgttatatgtaaagattcattattcactgaagaagaaaatcagttttgtcagcggtaaagtctgtgaatataatagacatttcagagtcagaagaaaccaaattctcaagatacttagaatgacttaaaggataatttctgatgagttaaatgtaccacaatatatctggaaaaatttctcccagtttttataggaatatcaaagctgtggatcactttttcttaagatatctaattttaacttaaagctagttttaaccattgtttttgatatagcaatagagagaaattgcctttaatatgacttttttcaaaaacagctaaatgttcttatgctgtacttttacactatatattcctctgggggttttattttttagaatctgaattaaaaaattccatagtggataaaaagtggctgcattattaaaaagctggtaaatgtaaagttttcaaggccaaacacagaaactccaaaccagctgcacgttaaatttttctgggatactttacaaatacagacccatttttacccattgaaaacctgtggaatcagaatcttgggacatgcctcctagttatctgtatttttataaatctctcaaaataatggttctgcagcatccttttcatatattcatgcctaggaaatattagtctagtatatatttgagaaagttaccaggttaaaatttttattttaaaatttatttagatgtagcttcttaagtggccttagaaacagctggctaggtttgggtgcttatgcttattttgtccttttttttttacacatatttttctgattttcatagagactgtttatttgtttggtggctgggatggaacacaagatcttgctgacttctgggcgtacagtgtgaaggagaaccagtggacatgtatctctagagacactgaaaaagaggcaagttctcagacttttcatacatctatattacagaaggggcgtagatgtgcacttgtttttcggcatgattatattcttcactaatgtctgtcagcagtagtagcaatagaatttgtggtaaacaagttttttttaagtactcttgaatttcagcttctataactggctgttcagctactgatacacaaccaaatctgttttatagagagagagagagtgaggaatggggatttttatatcattttgtttttaaactgctttagcctagaaatgtaactgtgtaactgtcttttttgcttatgtctccactacctctattcttatttttaacattcatcttatttttatttcttctggaatattgtgtttttgacactcactatctccctattttggctcctgttattttactatatgtcagttttcataaatgatatatattatcttttttttggagtcttgctctatcgcccaggctggagtgcagtggcaccatctcgactcactgcaagctccgcctcccaggttcatgccattctcctgcctcagcctcccaagtagctgggactacaggcgtccgccaccacgcccagcgaatttttttttgtattttagtagagacggggtttcaccatgttaaccaggatggtctcgatctcctgacctcgtgatccacccgcctcggcctcccaaagtactgggattataggcgtgagccactgcgcctggctgatacatattatctttaataaaaattgtatatatgtatgcatgtacagatctgtgtatgcacatatacataaagcatttccatagtgaataagatggcttaggtttatggctttgaattaagtgcatgattatatcctggaataaagtaaatgttaattcatttattattttttcaaatctttatagaacattttaattgcactctccatttaaactgtttcaggatataaagtgacaaatgagctataacaaaacagtaggagcctcaaatgaaaaggagataaaacggcctaattcataacccactgattttgatctaggaaggccatttccaaagatctagtgctgtgtcgttaatcctggggaactaggttcttgcttactctgaaattatgttaataaaaactgtccagggattaatcactggacagtttttattttttcaaatagatgttgaaattctgatttacttttcttaccccgggaaagtatgtgtaagtggccttcctgtttcagtattgaagtactgttctctgaaatgattatttctgtcttcaacaacaaaagacaaatcttaaattaaaaaaaaaactaacttttttctactaaagtattgtaaatctaaggcgatgacatctgtaattattcttgtgttaagcctaggtttcatcctaaaatcctccctcttcttcagtgaatgtgtctaattagtgcctaagatccaacagttctccaagtgcctggcatgatccaacaggtcatccaataccacatttcaaatgtcttttcctctccattccttttagcagttttttcaactttatggtttcttacgctttttatatctccattgttgacctattctgtgttcaccaacacagtctttaaaaagcatatttgggctcggtgtggtggctcacacctataatcacagtactttgggaggtcaaggcaggaggactgcttgaggattggaggtggagactgcagtgagccattacagtgtcattgcctccagcctcggtgacagagcaagaccctgtctcaaaacaaaaacaaggccgggcacagtggctcatgcctgtaatcccagcacttcgggagagcgaggccagcagatcacctgagctcagtagtttgagaccagcctgtgaccaacatggtggaaccccatctgcactaaaaatagaaactagctgggcatggtagcaggtgcctgtaatcctagctagctgggaggctgaggcaggagaatcccttgaacccaggaggcggaggttgcagtgagccgagatggcaccactgtgctccagcctggtcgacagagtgagactctgtctcaaaaaaaaacaaaaaaaaacaaccaaaaacaagtcccccaaataccatatttgatcctatgacacctctgcttaaaccctgtggttagcttcagcctttgtttcagttatcgtttacactgtttattacattacaagcactcaaaaaacttcagtggcatatagtaataagcatttatttgctcatgagtctacaagttggctcggtcattcttttggtttggccgggctcattcatttgtctaggagtcagctatctgtcagctggtctagtgtggtttcagctgggactgcctggctctgttttatataggctagccagagcttgttctcatggcaggtgctgggctgcaaaggggatgaagtagacatgagcaatccatcaatttttttcttgccctgatagcaaaaagcaatcatgtaaccaagtccagagtcagttggtgcaggatactattaaagggcatagatacaggaaattgtaaataacaacaacaataataaaacaatttatttatctcacttccttttgcttagagtaaaaactcgaaatttctcatcaagatttgctactcaattacttttccagcctcatctcccatgtgccagttaaagttgctggaattattcaactttctcgcctgtgtcctttggcaatgttgttttccttgtttggaattaacagagggaggctctccccctaactttacctaataaatacccacttattctttaaaactcagttcagacttcactttctctgtaaagcctttcttgaacttgccaagcagaattaaaagcttcctttgatgtgctcacttaaccccttttaatacttggatggcttactataatgattggtttatattcatgtttccctatctgaattccttaaaggcgtgaatcatattctttaaaatgtatgtattttaaggatgtgcacgttcttactctttagtgagtaagtaggtgaggtaagttaaatgagaaattaatactagagaaaagggaacgataaatacaaaatccagagagggtagggggtttaaaggtaatattaaatgttattcttctaaagcttggtatgggtagataacttcattccgttatttttttataccatatacatatgttgtaagtaatatttataatgcaataagtaattattttaaaactcatgctggaaaaatatagagattattttgatgagaacactttctgttagttcaaagtcagtacagatgagtaaagtggtgattcagtactggagctcagatttattatagttaattaatagactcataaaaacctccgcctcccgggttcaagcaattctcctgcctcagcctcccgagtagctgggattacaggtgcctgccaccacgcctggctaatttttgtatttttagtagagacagggtttcatcatgttgaccaggatggtctcgatctcttgacctcgtaatccactggcctcggcctccgaaagtgctgggattgcaggcatgagccaccgcgcctggccctcaagtggcatttttgtatagttttctaaatctctttaatgtttggctcaataaaagacatctggattcatatgcttctttattcagttgctgtatcagaaagtcatgtagcctctggaaatgttcacatatactcataagagaataagagtgaaaagacaaatttttttgttagtcatgtaaaaataactttgaccttatagactcccttgaagtacctaggagaccccagaccacactgagaactgctgctttaatctaatccacagttcctattcagatatagacaattatcccaataatgccccagtaatgttttttataggcatcccttgtcactctgcaaccccagcccagaatttagaccatgatcatgtattgctttttggtgtcatgcttctttagtcatctttagtctagaatagttccctaaactttctttgtctttcttgactttgatgatttttaaagagtacagggcagttgttttttagagtatccttcaactgggtttgtatgttttcttaggattggatttagatgacatatttttagcaagaataacccatagatcacattagcatctcctccatatatcatatcaggagacacattacatcagtttgtctgatattagcttcaatcacttggttaaggagatgcccaccagatttgtctaatttataattaataagtaatttatatggagacatttcaagattatgaaaatatgccattactcatcaaactctcacccttttatcatccattaatgaaacttaaagcttttcccaaaatggttataccattttatactttgcctgcaatgtatgagatttctggttactccctatcttcttggcccattgatttgctttggcaccttggccaaaaatcaattgatcatgtaagtatatatctctttttgtactctgttctgttctattatattttggtctcttcttaaccaatatgacactccctcgattactgtagctttatagtaattcatgaagtcaggtaatatataaattttagaatcaccaatttctagaactgttgggattatgatgggaatatgataaatctatatattaatttggagcaaattggtgggtttcattttgtcgtttgaattttttttttttttttttgagacagagttttgctcttgttgcctaggccagagtgcaatgatgcgatctcggctcactgcaacccccttctcccaggttcaagtgattctcctacctcagcctcccgagtagctgagactacaccgagtagctgagacccacctggctaatttttgtatttttagtagagatgaggtttcaccatgttggccaggctggtctcgaaatcctgacctcaggtgatccacccacctcaacttctcaaagtgctgggattacaggcatgagccactgcacctggctgcaaattggtgttttaatgatattgaatctttctacaccatgaacatggtttagtctccatttattttagtcttcattatctctcagcactcttaagagttttcagtttaagaggtctatgatattttcgttaacttgatatcagtgtattttgctttttgtgctattataatggaatttaaaaatcttttactttccatttgttggctggtaatatagagaaatacaattggtttgttaatattgcctttgtatcatgtcactttaagtctacttatttctaatagcttcttttttatttcttagagtattttaaagaagcagtcatttttcttctttctgttctcttttccttcattattttattttattttttgtttatttgtttgagacagagtctttctgttgcccatgctggagtgcagtgacatgatcatggcttgctgcagcctcgaccttctgggctcaagcaatccttctacctcagtctccccagtagctgggaccacaggcgcgtgcctccatgcccagctaatttttaaattatgtgtagagataggatctctgtatgttgaacatgcagaggagtcttgaactccttaactcaacgaatcctcccaccttggcctcccaaagtgatggggttacaggcatgagccaccaggcccagcctttattttattttttaatgccttccttattgcactgacttgaacttccagagcaatgttaaatataagtggtgagaaaagacatccctgtcttgtttcatatctaaacaggagagtgttcagtatgtcatcattaagaaaaattaaatttcgtacatgttatcagattgaaagtctttctattcctattttgctatgagttttgatcatgaataggtgatgaattttaccaaatgctctttttacatatgtattgatgtaattgtgttttttcttctttattctgttaatatgtcagattatcctgattgattttcagatgtaaaatcaactttacattcctgggataaatacctttttgttgtaaaatattcttttcatatattgctactgctgtttggtaatattttgttaaagattagttttgtctatgttcataaggggtcctagccatctgtaaatgatttctccacctcttccccatttcttcctccttcttccccttctcttccttctcctttgtaatattatttggtttcagtgttatgttggcctcataaaataagctaggaatggaagagaatgtggataaacagtagagtttttttttcccttgattttctgaaaaattttgtctaaaactgataccattttttccttaagtgcttgatataatttaccagtgtagatatgtgggcaattatgaattcagtttttcagtatgtgtaattccttcagattttcctctttcatctcatgtcatcttggtaagttaggttttttaacaaattatgtctgttttatctacattgtcagattttacctatgtttttgatagtattctctctcttttcatttctaggaagtctgtagtgttaatcttgctttcatttctggtactggcaatttgtattttccctccctttgtaaaaaattagtctgccagtggtttataattctatcagtctttcaaagaaccaactttgttaattttctctattttttttcatgttttctattctattgatttatctttatttcttttttcttggcatataacttggtcatcattttaatattatttgtgctaatttagttgaagcaagaagttctattattctcttattaaaatttcaagttttacactctatgcattatggcatagatttattatatgttactccgtctttgtttttgagattatttatggaggcaatcctttcttaaatcaaattttcaccttatttgctgaagatattctttgacaaaaaatattttaaaataagtttgaaaataattagtgtgaatattaaagtgtacattcacatcaacttcattgtcaaaatactgttcttcctgcctaatattccttcatttcacttaattaatactgctagattactcttcttagaatactgcctttttatgttatatcttgctttagaaaccaccagtagttctttattgcctacaagatcataaattgtctcctctgtcagtcattcatcaggctttctgtgtccactttatacatcaattctgttatttctgcaggaagaactcttcatctcagtcataactgcatagactgtattaacaagtatatttttgcctttgtttttcttctagaaaaaataatctgaaattgtgaaagagcccagtttttggctctggtacacaagggcgtagatttgctatcttacttcctagttttgtgacggtggactctgtgaaatggtgataatatttccatatggggttgttataaggattaaatggaacacacacatacacagtaatagtgtaaacagaacttgggagttgtttaacaaacattagtttcctttcctttccccctttcagctaattaaaccctatgcaattgaagttctttttccccgatgaacccttttgactatactacaatattttttatgttttattgggtcctgtgatacaagtgataccagctaattaatttattgataatatactgttcttaatattattccctatttatttactgtagctgtgctatttattcaatcaggaaaattaattttgcaatgtaaaggatggataaagaagtgatagacttggattcttattagtttctgtcactagcttattaaaggtatcatcctggtcttatatttccttgctaggcttgtattttctcctctttaaaaggagaaaactagagattttattttttttattttttatttttattatactcttaagttctagggtacctgtgcacaatgtgaaggtttgatagataggtatacatgtgccatgttggtttgctgcacccatcaactcatcatttacattaggtatttctcctaatgctatccctccccctgacccccacccctcgacagtccctggtgtgtgatgttccctgccctgtgtccaagtgattaaactagagattttattgatgtttcttctaattttgaaattcactgattctaaatattcttggagtacctcttttgtgctagattctgatgagaaatacaaaaatgttcataaagaccaaacatgtcttaaagtagattgtcatgtaatagagaattgaactctgcacaaatgactaaaatgcagtgcagtatatggtagaaaccgtatagatgttataaacagagtgccataagctgcagtgtagttcatctcatctttcctggtagattttaagcatttctaaggtaagatttctgtctcctactgcttactgcttttgctttcctttagagagttaagcctagtgttggactcatattggttgacttgatgtgagtttctgagaaaccttttaatgaaaggtaataaaaaatgacgtttaatttttctattatttgttctttgatttttttttgctctttatttgtttatttatttattttctctctctctctacagaatggtcctagtgccagatcgtgtcataaaatgtgcattgatattcaacggaggcaaatctacacattggggcgttacttggattcctctgtgaggaacagcaaatctctgaaaagtgacttctatcgttatgacattgatacaaacacatggatgttactaagtgaggatactgctgctgatggagggccgaaattggtgtttgatcatcaggtttgatgcacagttaaatatatgatggaattaatcagtgcttagtgattcttgcaattagagtttatgttagatgttatgctgagttgtccagtagtgctttccatgacaaatatctattgacagtaataattgttgtttcagtaggtataaagttattctttaaatttttttctcttgtttgttgcagggtagaatatgaagatctcaggacatagactgttgatttatagaaactttagcgagtagatggagcaatattaggaaaaacaaatttagttttataatacatatgcataaatcaacaataacaacttacccttttaattatatttcttattctacattcctgtgagaaatggaaatcactttataatgaactaggtgaaatctagagcttttcttccagttagagtgaaatatattttgttttgtttatagtcacaaaattgtataaacctagaggggaatttgacatactagattaaactcagcaccaatagaaattatacaataatgttgtagactagaagactgaacatagcctcattgtaagccattttaatattaatatacatgtagctctcattagccccatcattgtcattatcattgttacctgtctttgaatacttattccatacaaattcaatgtaggtcaaaaaagacagtaaccattttgaattccataagcaagtttttacctggctcaacccatgtccaaagttttttttgatgtattgaggagaaaaagacttcaaaaatctataactctgtattgatgaacataaattatctagtatttgggaaatgggaggtggtgctagaattatgacaaaacttaagtgagacctaaaatcttatctaggacatagaacccagggtctttatttattgtgtctttatagatttttgttaattatttgcttttaaactatcctattgccatatttctattaacatataattgttataggagaatggtaaggagaggaagagtgagttatgcctgtgaagttaagtggtaggtagaaaatcaaaactagtattcttggaaatactccccagcttaaatttggaacttctgttggctctatttaactgagctccacagagctatgcacatccctgctgacaccctcaatgttcttcacgtggaaaataagcatgccaagaaaagttaggctggttctgatcttttaaaaacatcagcagataatattgttagggaacaatttattctcttgttcccaaatggttacgtatttcttttacaaaagatgctgatgtctttttttttttacaggttgaaaaaagaatagcttaggagtagcacatagagagttcttgtgtgtggcctttgtttctcttgacttttataaaataggatgtttcttgaaagctgggtgctgttaaataatgcatggttttcaactggttagatggtacagcagaacactgggggtgaagaaacaaggatttcagtactaattcagccaacaactatccctgtaatagtgagcaagtaatctgtataatcctgcatttgctattctatttcatacaaataaagctataagttagaacttacacttgtagtgtttatgacactccaaaaatagcttgtggtgttcatgacaatttaggatttaacacaatgttcaaatttgataaaaatatgagaaagctatacgatacaaacatgcttaaaagctatttgccatttttaattttaacatatttaaaaaataaaatttaaagacatctggatttcttaagaacatagtggcggtttagttctcaagctttccttgatgttgctttgtgtggttttccaggaataatggtaatcaagcaaaaagatttaaacacacacacacacacacacacacacacacacacacagtctctctctctcagcaaaaccaagagctagagtaaacctataactcccaatgccttgtaagtttagccagaaacaactaaaatactcagaacttttgttgaagcccacaacagtataatagggagacctgggaaagcaaagggagcctagcagttgtatgtcacagtgagaagtgtcagggacagggcacaaattgcacccagggcagccactagaagaatcagtgaattaacatgtgtaaagtacccagaaatatccagaggtgatatgtgtcagaaagcattattttgtaaaagtgaaggaaacacagtgggaatgatggctccttttgcaatggccagtaagaaacctggggagctcaaagcttgagatcagccctgtaagccagatgagagtcatagaattagagaaggtatggcttcaccggaagtgccatattttgaaggagccattcaattcagtagcaacagaggaaggagttcttgagcgagaacatccaccttctatagaaatcctctgtgaagttatctggtccagggaaattcaactcaattacatatgaaaaactaaaaagcaataaataacaaagctttagagagacattctaaagaaaaacaataaaaagaaaaataacaataaatgaaagttatatcccagtacattacccctttcagaaatgaagacttatctacaaagagcgtaaagaagaataggtaatgatcatatagcataggaataagataaaacaaagaggtaaaaatgattaaccagggaaggtaggcagaggagagccaacatatatatatataactggagactttaaagaagaaagccaaaacaatggaaaaaacaaatatttatcaattgaattcaggaacattttcctgaagaaagattttactccgcatgtcaaatgggcatactatattcagaaaaagttgacccaaatacttaactctaagacatatattaataacactgactataaaagataagagatcattttatagcaagtagacaaaatgatcaagtcacctataagagaactaaaatgagactggtatcagatttctctacatctactttcagtgccaggagataatagagcaacatctagaagacattcaagaaaagacagtatgagccaagaattttatatctagccaaactgtccttcaagtataatcagtttttgtggaaattactagaaaatggaaagtgagctagccaagaagtagcaggaaaaacttcagttgaagaattgaagatctcagctcattgatattctcactgggtcatgaggcatttttggaggtttgtagaagggagggtggtaggttggacaacattggatacttagaagcctttatagcaatatcttcaaattttgtgaggagaagattattttgaacccagccaaacccttaccaatcttgtattcctgtgatgagtaaaataaagtcattttcaggttcaaaaaataatttttcccaggaaaataagtggttatccactattttgattttaaaaattaaatatctaactcctgacataataaatgaatagtctttaaacttttggctttaaagatttttttaagtctttgatggaaaagacattatcacacagagtttaataagtttactagcttttcagaaattttttcggagagtaaaaatgacaaaacaaatcaaaagcgtggaaatcgaatattaaaaggtttcttggtttaaactggtatgctaggaagaactaccaagataaagatgtttatacttcagccctgcaaacaaatgagaataaaccacatcaaaattaagcttgaatattctcaaaaagaaagaaactctttgtagccatacgaagtagaaaggtagggggttggtaacaaagattggccattagtatgaatctgtgagttaataaaaaatggaaatagactcatttaatgtgagtccctaaagattttcagcatagttcccagatatttggagtgattgagtctgaagtacttcagaaacggaaatgtgacccagctccagtggagccctcaacggaggcagtggatggggccaaactgagttgttttcagcagtgtgctgattttaactgtatgatcattttaaaaaataggaatacttccagacatctttgtttttcaaccatgtttaccaagatttcacccttggggaatagattttcatcttaatttatggaagtctttgagaaacctgggaaatggctaatgaggtagatctttttagtggtagataaaaattaggagatgttagaatctttttaataataactacagttttttaaaacaacatttaaaattatgaaaatagccaggcacggtggctcatgcctgtaatcccagcactttgggaggccgaggcaggcggatcacctgaggtcgagagttcaagaccagcctgaccaacatggagtaacaccatctctactaaaaatacaaaattatcctggcgtggtggcatatgctggtaatcccagctacccgggaggctgaggcaggagaattgcttgaacctgggaggcagaggttgtggtgagccaagctcatgctgttgcactctagcctgggcaacaagagtgaaattctgtctaggaaaaaaaaacaaattatgaaaatagccttttgtttaaaaaaatacataaatagcagaagtaatctggtaggagaattgaacatcaaatggttgggttttattttagcaaaacatagatgttttgtgtacacaatttattctttatgtaaatgccacttacgttcaacagctaattcccaacttggatttatgtgttatttgaaacagaatttgattcttattgtctcgtgacaaatggctgttttctcacacatttttatgaaaagttataatcttgagttgaaagaatggaagaataaagcttgacttttaaacatgaagtgtatagcttaattcaaagaaaattaaatagtgctatgttaaaagtaggcagagttcttcacattgtagaagtcagtctggagacttgattgttgtaaatgtccttttgtttgtttgttttactgttttgtaacataatctgaagggttttataaaaataaatgcagagaggtgaatttagcttcaccactcttatttgcatatctgatcgcttagtaaatggtagtaatattaataggatgcttgcctagaatgaaagaagggaatttttataaggagggtatgatcactattcacccagaatataagtattcactcttacatataaatcaacgcctcatgtatcattggttgattttgataaaaattatgcaatttcaagaaagcagaaagctctttattccaacatgtttttaccctcactgacaaaaatgacaacttgaaaaattatttagaaacttgcatatgataatcaggggtggtatttagtgtcattagggacaaagtttagggtttttttgagaatgtaaaactgtacatgttggttttgttttagcacatatgacaggaacaaactaaaactattcaatctgttgccttgttctgatagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcagtaagaacattccgtacattgcgtaaatgttattttgtcatgtatatctagataggaaaagaagtggtgaaatctaattctttaggaagagattagtgtagcaatgacagagaaagacaaaacttctttaacagtgaactgtttgctaattatgagactcttcccatcaacctggtaattcctaaatagttactacctggctaccaacctgggcaatcttatgactaatttcactgcttatgtagattttgtagctatgttcctttcttatgcctttccacttacgtctcttagtaattagaaggacaatttcttactctgttcttattttcccttctgctattctccattaagtacaaagaatttaagatttgattttatagaattagaatttaaatgtatcagcaatggtcaggagcagtggatcacttgattccagaagtttgagacgagcctggccaacatggcgaaaccccatccccagtaaaaatacaaaaattagcctggcgtggtgacctgtgcctgtagtcccagcctcccaagtagctgggattacaggcatgcaccaccacgcccggctaattttttgtatttagtaaagacagggtttcaccatgttggccaggctggtcttgaactcctgacctcaggtgatccacccgcctctgccttctgcggtgttgggattacaggcatgagccactgtacctggccactttcttgatgctcaaatttttctctttggctagtaggagcaccccccacaacatatttatgtatctttttttgtaagagaaaaattaaattgtgaattcatactgatatgtctgattcaaataaaatattttttatcttaatgtcttctattttgtaactttatatcttttctttttaccccgactggagcgcagatcgtagctcactacagccttgaatgtcagggctcaaatgatcctctcaccttagccccccaagtagctaaaactacaggtgtgtaccaccacacctgggttttgagtagtagtagtagtagtagtagtagtagtagtagtagtagaagatagtagtagtagtagtagtagtagtagtagtagtagtagtagtagtagtagtagaagtggaagtggaagtggaagtaggagacagggccttgctgtgttgcccaggctgtctcaagcaatcctctcaccttggcctgcccaaatgctaggactacaggtgtgagccaccatgcctggcctatttttgtgtcttttaaggttaaaatcctgcttcataacattagttgctttgtctgtctataatagctttcacagtaaagaaaactaacaacagaatcactgagtgctgtttaacgttgctttctgattatttttctgtttaggatttagacttctagggatgggtagtcaaaaagtatgtattaaaatcattagaaatactatttctgtgtctgagtatatctttatatacagataggtttatttgttggattttttttgcccaaattttagattttttttttgagttaattttgtcttctaattaaataaaagcatatacattgttctaaagtcaaaaccatacatcaaggtattatttttggagaggtcttcctgctctgttcctgccactataggtaactgtcttttattaggttttggtttatccttcctttgtttttcaaaaaaagaagcaatctctattctcgctctcgcttgcgtgctctctctctcacttttcccctctctcacattctctttccctctctccctctctttttgtctgatgcacagatattccttcttctccattcctacacaaaggaagaaggaacctgtatatattattctgcaccttgcttttcttctttaacaggatgtcctagagatccccttttagcaatatgtagagagcttcctctttcccttttattccagcatagtactccattgggatctgttataaaattacttttgtagaggtttaagtttttaaaggatcattctgagttcttcatggaagtgataagttactcctttctttttttttttcttctttttcagaaaaatcgttgcttatatgtatttggtggccagcgatcaaagacctatttgaatgatttctttagttatgatgtggactctgatcatgtagacataatatcagatggcaccaagaaagactctgggatgggtaagggcattgagtgatttcttctctcatgtcttaactactttaggtagaaaactgcagttcattctcttttctttctaatcatttttcaccctttctttatttctttaattgagtaattccaagtaagagaaagaaaattctaccagcttattcagttctatctatttttaaatatgggaattactatttccttcaagcagaaaatatgtgaatttctaaatgaattgtgtgtgtgcttgttggggggcggggtaggaagaatcaatatcttaaaaactttttattctgtgtttgctaatttttttcatcttctattttcactgtagtgatctttatattaggcactagcatagtagggtgtgtgtcttaaggggggaacttcatgggattggtaacaccttgtaagtttaaaagctcagcatctaggaggttattagtagtggaatggctggtttgcttagattatgcatattgccctggcataattattaatagtgctccattcattttcaaaagtgtcctgttttgatcatttatagttaccctacatagtagttgctttgcctgtgattattgtacctaaaagagtggctttaattaaggtgcaatggtttaaaatgctaatttgaacaatagagtgagaaattaaatcagctgcttttctttttagctgttgcttatagattggtgtttttattattggctcttttgccaaatgtggataaaagcacttgtttcacagacattgtttctggatattttattgattaatacaagcttcctttaaaacaaaaacaacaaaaatatttttaaattaaaatatttgttcacatttaagaagaaaaacttgttttaaaacaaacaaacaaaaaaacaaaagataggcaaggcacagtcgcatatgcctgtaattccagctagtccagagacggacatgggaggattgcttgaatctaggagtttaggaccagcctgagcaacaaagcaagaccctgtctctacaaaaaggaggtttccagataaaagtagactcaatagatatgttaagcatttggaagaaaaatctgttgatgagtataaatagcatctaatgtaaaaaacgaaggatagggacacaacaggaaaagcgaaactttttataaaaaaggagacattatcacagtaaatttcttggctttacagtaagcagtatttccctaatcataatgcagaactacagccagtttaaccaaaaattgggatgaaatatagtgggaagatagtgtaagtgtagtaaacatcttcgtctattacaacaggaaattagtaggtaatgtctaaaatagcagcttagcatgtgatttagaaatatggacctgaataggtaataacattatttaccctatctaaaattgtcttatttactcatttatttactgttgccataggagagtgtagagctatatgatttaatatttgactttctctggcttttaagagttattctaacttaccattaaaataactaggagggtcaggcgcagtggctcatgtctttaatcccagcactttgggaggctaaggtgagaggactgcttgagcccaggagtttgagactagcctgggcagcatagttagccctcatctctataaaataaaaataaaatagcaggagagaggtaatactccttctacaatcctaagatgggtctccctgaaaaaggtagtgaagatagtaattgatatgacaatatgttgaaaattatggcatgctgactcagtgctagactacggacacagtggatacaaggcaatcacagtctctcaaagtgcttataatctagctagtaggtaatgtattcccatggataataattactactctttatttagaccctaccatataccagaatatctttaattggtggtattattctaatgtacaagatgaaaacagttacacaactacgtaatgacagagctgggatttagaagtttgagtgcaaggaaggtgtttctgccatgctaaactactgcccaagattaaaagaaaaaagtggcggccacgtgaggtggcttacacctgtaatcccagcagtttgggaggccaagacaggtggatcacgaggtcaggagatcgagaccatcctggctaacgtggtgaaaccccatctatactaaaaatacaaaaaattagctgggcgtggtggcgggcgcctgtagtcccagctactcgggaggctgaggcaggagaatggcgtgaacccgggaggtggagcttgcagtgagccgatatcacgccactgcactccaccctgggcgacagagcgagactctgtctcaaaaaagaaaaaaaagtggcaatgcgtgatagtgacagagaactagtaaaataaaaattcaccatgacaagtaggctttaatgactgtcattcaaaacaattttttaatgagttaaaattatgtagtaatgtacagtatcgacaattattcttcaatcatggttatggctagctttagagcagtgtggcaattattctttttatttaattttgttgtggtcataaaagtaaaaatatgctcattgtagagaatttgaaaaataagatgcaaaaaagaaaatatgtcaaactgtccagagataacttgttaaaattttgatatatttctgtctagtctttttaaaacttatttattgtataaaagttgatacaagtttgtattctattttaaaatttacattaaattgtgggattttttccattattgtggttttattaatgtgaactggagatgttattagaaaagacaaatggattcattgtttgattactgctataatcaatttttctaaaatcaaaatcaccattttttactgtgtgtgttcagtgtgtaattggtttacacaattgaattttcccacaatgcaaataaattcattaataatatttgttgaccatctactagcatctaagtttgtccctctcccttcctccttccctccccacttagttcattgtcttctgtaggcccaagattattttaggcacttgggattcatctatggacctggaggataagatcctttcccttagaggactcacattctagtggagagagacctgcagttgtgttctaagtactgtgaataaaatacactggatgccgtgataatgaataacaagggaagtctcatttaaacagagtaggttgggaaaccatctttgaggaggtaatctttaagatttaagatgaaaagtagagaattaggaagaaccatgtgaagaactgagagaagaacaagtacagagttcccaaagcaggaaggaacctgggatgttcagaaatagtgggactggtacgtattgaggattggaaaagttggtatgaaactaggttagagctacggagataagagtcagagtatttagtgccttgttacaaatgcaaggagtttggattttttttctgaataaaatagattattcaaaggtttaatatcagtgtcttgatctaagttttaacaataccacttctttgtctaggtgtatattttccaagtggttaattttgacaatgttcctgtgagttgcattgttcaaaggcttgtttactgaggatttttatggcagggttgagcatctggttagaattacttggaaaaatttcccacctaaaactgttgcagttatacttggaattgaggaacctcagtgactctgttagcacattagagtgaaatggaaattattctctttttttctgtttttttttcccctcatctctgcctctctcactttcttccttttccctccttcccattctttttcccatgtcccttttactcctcccccaactttctctctcctagaggattctaatatgcggctgggattgagaaccactgttctagctctccggagtctatttcagtccttagttaaccttaagcaagttacctaatgtctcagcttttgcttccacatttgtaaatgacccaaattagattttaaggaaaatagcgtctctgtccatggctaccctaggagtagagatgggttaaccctctagtttcgactggtgttactgttgggtgccttaattttcacaagaggatgttaatactgctaccctcaggttcactaatctagccagttaacatcaagtcatgccaattttgcctcatcttctctctattcccattgctgcttcactatgaactagtttgggctaacatcacctatttggcctctgtctctagacttcctctccctatgtacccctccctgcaacccattctccacactgcaagcaggatacagctattctgtgttaccagtaaagaatagaaccatatgccttaacatttatagagcagatattttttggtcacctactaggtgccagacaataagctacgcactaggagtacaactgtgaatgagggccctatcttcatggagttatggttgtacacagagaggaaaaataaagtgacagccttacctttagattagtgctagtgaagaaaagaacatatttttaaaaatacaaacctagtgggttttcttcctcactttaaatcttttaatggtttctccctgccctcaggattaagtctaaacttaacataattcacagactcttttatgatgtgccccattttagttctccagtcctagtcttggtgtctgtactcttcttgccaccaactctgtttcacgaccaccgaatattaaatctttatagatagtgtgttttaacttgcctttgagagttgcccatgctattcctcctacctgaatcactttcctctcccctccaaaatctagctaacttgtactgcttacctctcagatcttagcttgtagatcgttgtcgcccaaaattctctaatgccttaagcccaggttagaaatataaaaacatgtggctctagccatcattgttaacgcaattctaggtattcatctggctgtaaaatcttgactgtgcttttcaaaacctatacaaagatcagctgaaatacacagacttgttcatgatttcttaaagagcattcagtggtttcagtactctagatctcctaaaagtcttttactgaactaaattagactgttcagaaaacctcacatcagaaccatggtatattatattgtcctcccatagaattattttacctcacttttaaaaagtacatttttttctctcttactagatttttattgtaagcagtgaaaagtacttttaagaaggcagaatactatttaaattcccacatttttaaaatattcttagaaaacaccaattttatccattatgtagatgctctgtagcttattaatcattctgttgtttgttaactgttgttctaaagattttttactacagttaattactgtaatttgagatggacttaacatataattactgtgtttatctgtgattcagtaatgtggcttatttgattaaaattatatttacaatgtgagtatcaaatgggattgtttgagctcatagagtaaatttgtttgaactattgagatcaccgagatggtatagctaatagtaaaattactgctgtttatataattctgtattgtcagatactataaaatcttaagttgttgctctttataattatctgaatgtaccatcttagatttaacatctgaagatctgaagaaactttaatgcttatttttaaactacagtgtaacaattttatgctctcctcagaagaaaattataatttaaatcaatggattggcagctgctttaagggatttattagcattgtgtctaatacatacataattacatcaaaattcagcatatctaaaacttgagtttatttctgagaaacttttggcaagtaagactgtgaacacaaggggtttagcagattccccatatgtaagctctgtatttaacactaattgaaacttatgtgtagaagatggtctgtcacaccaccagagttttgtagttttctatagaaactcagtctactatagtaagagtgctttctcctgttcgtattcattcaaggaagaagcatatattgaaccttcttcatttgccaaatgctaagtcaagtattggtaatactgaggtcttacaacctgatgcttgttctttagtagttatgtatttacttgttttgatttttaaattgtgtccactctgttttcccacatctgccattgtttattccatcctgttctaaccattatagcagattggtaccattgaaagaatagcaaattgagaatcagaagacttggtctctctttgtctgggtctgccactcatccctctgtaattctagaaaaattatataacttctctgaacctgattattcatctgaaaatgaggagattggaccagttgatcataagacctcatctagctccaaaattttgaaaattaaatttcattcccttctgctgttatcaggctgtgaaactaagatatgagggctatgtgagtttacatctacagaacttgatttatctataaataaatttttatgaaaaccttaaaagcaaaatcatactgattttcattttggccctgggaatgtgcttattgtgcttactgacattttaaaaaattagtatggtcataactctttatgtttctgatccttttatactttttttttttttttttttttttttgagatggagtcccgccctgtcgccaggctggagtgcagtggcacaatcccggctcactgcaacctctgcctcccgggttcaagcgattctcctgcctcagcctcccgaatagctgggattacaggcatgcgccactacgcccagctaatttttgtacttttaatagagacggggtttcatcatgttggccaggatggtcttgatctcttgaccttgtgatccgcccgcctcggcctcccaaagtgctgggattacaggcgtgagccactgcacccggccgatccttttatacttttaccaattaaatgagtaaagccaaactggcaacacagagaagactttgaagctgatgatttgctgtcattaacatagattagttactggactagaaaatggtagcgcttattttcaacataattaggcttcattgctgtcagtttagtatgttttgtatttgatgtgtcattattcaaacagagtatctactttttgcctctcaaaattattggtaataataactttccctgatttcccccttctaccctcccaggggtgtttttgctagttacaagcttacaagagtattttatatttttagatatgatatttaggttacttgatagtaaatgagaattaaagttcacatgtaaaaacaaacatgcaagaacactaacaacaattttgaaagttaatgaagtagtactggcactaccagatatttataaagctacaatttgccaaagtacagactaatgggatgaaatagagcagatagtataaaaatgtccccaaatacatatgagaatttagtatatggtaaagttggcatttccagtcagagagaaagaatagattaaacagtatatgacatggagacattgcttaagacttggcagtattttaaaaaaaaggaaaatctgactccagcctgggcaacggcaagactctttctctttaaataagtaaataaataaatatgaataaatgggaaaatctggatccctacttgacttttgtacatcaaagaaaattctaggtgaacttaagtttcatacttaagaaataaaattataattccaattatttttaataatctaggattaagagaagacccttctaaacatgccacaaacccagaaatcataaagaaaaggaatgtttgatttttgcaaaattaaaaaatataaaaaattgttaaaatatcaaataatgacaaactagcaattaagacaaagcttatttcctacaatgaacaaaaggctcttataaaccaataaaagtggataatcctgtagtagaacaatgacaaattatatgaatagatacttcgaagaaaaaataattcatattgccagtaaatttacacatgtacagatgctcagctttattcataacttttaagtgtaaattaaaaaatcactcagtgaatgttggtatggccatgaggaagcaggtgtcttacattctggttgaaatgtatttggtacagcctttttttttttttttaacagtactttatcattatctgttaaaatacaaaaaatatatttttttgactaagcattttactccacgaacttttcctactcatatacttttatagatccacaaaaaataagctatacagagatatttattgtagtattgtatgcaaggagaaaaaatctgaagacggattgaccatcaacttatttgatttttatttatttgattgtccaccagtaaataaattggttgatccattcaaagagttcagttttttatagcttaatacagctgagataaatcagtaaatattgttgagtgtcaaaagctagttgcaaatttacaaaaaataaatgatgagtggtagaaagattcaagtaaaataatagaagttagttctgaactggagttgttgctagtgcttaatagggccccatccaacatttaaaatgtcccaactttcaaagagaaggatgtggcagacactgttgtttgctttcccaaaagtcattggccctttcttctgttaaccaaaccataattttgtttaatggcaagttgcctaaccccagggcatgaatggttaatcatgattagtctaaaccagtcattattatcctttggcaaattatttcactttaccttcctcccatgtgacacaattctggccaatgagacataaagaaagtctactggaggacatttgacaaaaatgtcttccctgatgacagtagagagatgctgaaagaattctttgcctccctgctttgggtgctctatataaggatgtgatgcttagagttggtattggcaagtttcaaaaatgagaaggcggccaagaaaattgcagaaagttaacctagcaccatgatttggttgaactctgaaacaatcttggagctgtctacttgcaaaattttgttacatgagctaattaatctactgttagttaggttttctgttacttggagctgaaaatatcctaacaaatagtgaatttgtggaaagctattttttattagattctgtatttctgtgacagctctgaaaactgttcttttcctttgtcttagctaatcagtaatgaatatgtgcattggaccgtgaagcaaaaatagagttgagattaattcataagttaatgcaataacatatcttcctcaggaattcaaaggacttcgaaaatatttgttaactttttttttatcccccctcccacagggtttctttatgttaaatattctgacaatctctcccatttgcttagaggataaaccaaggaaggaagagaaaagatgtgattcagacatatagataaaatttttttacttcccctttagctgttctattttgagttttaaagatgttaaagaagaaatagagttgaaggattatcattgtaacttcctaaaacaattataaaaataacgagttggcagtgataattgttgtatcattcttattttctgtttttttcagataaatgttctttcaaaatatgttaatgattaacgtttactgatctgcttgattaatttttctttgtgagtcagtttctaaactggttaaggttaaagactggttaaggtcctggcatttagttgagctttttagcagttgaatcttaaagtttttaaaatcgtttatgttgcaggtcttttgtccttccctcctcccccgcaaatatacccattagaaactgttaaattggccaggcatggtggctcttgcctgtaatcccaacactttgggaggccgaggcaggcgaatcacctgaggtcaggagttcaagatcagcctggccaacatagtgaaaccccggctgtactaaaaataaaaaagttagcctggtgtggtgatgcacgcctgttgtcccacctactcaggaggctgaggcaggataattgctggaacttgggaggcagaggttgcagtgaactgaattcacattattgcattccagcctgagtgacagagtgagactctgtctcaaaacaaaaaaaaaagagaaaagaaactgttaaaaattgaaaagatagccttgttttcatcttgcaaagaaaatcagtacagaaaactattaatagttttgccatattagaatgaaagctgctttcttggttttgacctttagttttttttgttttttgataatgccgtttttatttaaccagccttcatttttattattataattattataaaagtaatgcagttcacatgatcaataaagcaaaactcaaataacatagaatgctataaaatgaaaagtacttctgccaaagtagcaaactgacacaggctgctgattcccttccccagaatcaacccagagaaataaaattgagagcagctggattccagaaactccttaaataagactgaaggctcactctcccccagattacccttcagttaatttttaccctttcactatagaaactagcagcggtagcctagcccactagtgtcagaattcggtgggcaaacattatgtcagtgcagaaaccctgctggagttcagagttgatgaaaacatgtggactgaccatctgttctcaatagttcatttcttcttctcttctccctttgtccagggagactgccttctccttcctctttaaacccttgcctgaagggtttaaaggtacaaaactgttgcataggggcgtgatcatatatggacatgattcttggttctttgtgcttatgcttcagaaccctatgacttttcctctctattttccttaatctctaccagttaaggcctggcctttgagtcctctccaatatatcttaccagaaagaagagctgattccctgaaaaacattaccttgcatactgatataactagacagttgaggactacaactgtctcaaaaaaaaaaaatgagtaaacttatacatgatgtaaagcagaattattaaaacagatgaacggccaggggtgatggctagtgcctgtaatcccagcacttttggaggctgaggcaggcagataacctgaggtcgggagtttgagaccagcctgaccaacatggagaaaccccgtctccactaaaaatacaaaattagccaggcatggtggcacgtgcctgtagtcccagctactcgggaggctgagacaggagaatcgcttgaacccgggaggcggagattgcagtcagctgaaactgtgccattgcactccagcctgggcaacaagagcgaaactccatctcaaaaaaaaaaaaagatgaaccaagaatttaaaataagcatgatgaatacacttaaagatgtaagagaacacactagtaatatgaaataagatccaaacattataaaaacagaaccatacggaaatagtagatatgaaaaatataatgaaaatgaagactacaacaaatgtaagtaggatggtatgagtgaattaatcagttggaagattagcaagagcactcttccaggaaaaagcgagggaaaaaagataaagaaatagaaaatagagtagagaaactaagaaagatagagaattgttgtacaagtgccaacatcttaaaaggaattccagaaggaaagaaaaataaaaatttaagcccgggcacgggggctcacacctgtaatcccagcactttgggaggccaagatgggtgaatcacctgaggtcaggagttcaagaccagcctgaccaacatattgaaatgctgtctctactaaaaatacaaaaattagccaggcttggcggcgcatgtctgtaatcccagctacttgggaggctgaggtaggagaattgcttaaacccacaggcggagattgcagtgagctgagatcgtgccactggactccagcctgggcaacaagagtgaaactccatctcaaaaaaaaaatgtaggtgaaataattgtagaaataatggagatacatttcttaaaattcaaaaatggtgaaagacttcagattggcgaaagagctcatagtgtaccaaatagaacaaataagggaaagcgttatacctaagcagattaaagtagaattaagaatagcagagagaaaattctgaaagatttcagagagaaaaagcagatgacctgtaagggaacaagaagatagacatttgacagttgaacagcaatgtagaatgagaaaaaacgataaagtttaaaagtagccaagaaaaacaactttgaatcaagaaatttaaatcttcctaactttgagatgtgagggtgacataaaatattctcaggcatatttgccttagcacatttgccgtatagatacccacagtagaaacccatttgggagcaggactcaatgaaaactaaatctaagaaatgctagaagtatgtgataaatgatgatcaaaatttgttgttgcctgaagaaaaacactaggaccaatattctaggtcaaggaaccatggcggaaagggaaaattggacactatataaattcaggtattgtgattagaatatagagaagaaactattctatattattaacactaaaatgtcatatacaaggctcaagagttaatggatcttgattttctttctaacttccttttcctgtgtcatgtatcagtgccaccgtctcttatatctcatgccatcttctttcttggattcctttttttgttttgttggaatatctccttaaagaagtttatatacatatatatatatatgtagtcatatgtatgaactttaaaattctcttattttgccctcgttaagattgctagtttaactggaaatggaaagttagttccatatctttttatacttctcagaattttaaagttgttattccattgtattctagcattcattgttactgataagttgtagggccaaaagagttgtgatacttttcctcaacccttttaagagtcatggtttgacactcctataataaaagacaggttaacaaaagaaagcataacaaattgatttaatcaaagttttacgtggcatgtgagccttcagaagaaatgacccaaagatacggggaaaactgtccatttttttgctaagatttaatgaagaatgaacagctggttagaaatatgattgggtaaaaggctatgatttaatgcaggtagactgaggtggggaaacccaacaaggcccgtctgttcagattcttcttggcccctctgtgtagtacttcttcctcctgggaatggggcaggaccctgctacagcaagggtcttgtgacctactatcagacaagggtagatcacagaatttctttatggcgagctcctagacagaaaggcagaggaaagttggatcagtaattctagtttttagaatttaaaagtctaggctgactttgggaaaaagaggttctagtttttatgacccaccttgaggaagaggaattctgatttgatgactcacttctagggagaatgagggaagacaggcaggagggcagaagaaggtgagaaagaacttggttctgaagctgttctgaggccttccagtgttctttagttcaaagtacttagcatgccagagtgtttgtgttctgagcccctgacaaggtctaatgttagtttgatttttattcctctgtatataataatctgctgtttccttctttggaagcttttagaatttttcttttcttcgagttttaacatttcatattaaggtggagatgtacatctatatatctacatgccatctttttaaaaaaaaaacaacatagatatatgtgtgcaccatctttttaaattaaacatgcctagcttgcagtgggctctctcaaacaggacacccagttcagggaaactttattttttcttctacattatttcttctttccttctggtctttttttcagataatttggcttcgatgggtatatcctctgtgtcctttaacttttccctcataatttctatctttttgctgtttattctggtgatttgtcagttttatctagagaccactgactttgtttctaactatgtctgtagtttcattctgtcatttgaattttttggtcatagtttcactttttagtatcttttcatagtccctgctcctttttatggcagcttattcttgttttgcacatgaaatattctctttaatctcctcaaggatactcatagggttttttttcccccaagttatgttcttttctgtgatttgtcttttcctggttgttctatttgttcatctaggtccctctcttttacactgttaatttttttcctcctgtctataattcatgtctaaactttaacatttatgaataaaggactgtatcaattaagaaaggtagttaacagcagtttcttttacagtgtgtaggtctctttttccagtaggtttctctcataaatgagacactgatcaaggtcttgtataagtgcacagcacatactgtcaaccaagctttcctatagaatgcgtaagctgagaataggcacacaagttgggaacatatatgattaacaaagtaaagattgggagttactttaagctctgctctcattcttatttacgcccctatgtccttattagaagctctccacagaagccttcctcacaatctacttcttctctttgtatccgatgacttatttggaagtttttcatcttttatctctggtgagttacaggctctggtaataattgtaggtgaaaacagccgtagacaacatgtaaatgaatggacattgcctgatttgaccctgagcagggcagatcaagccatagtttgccaagccatgttataaaatttttaattcaaaggctcactattaagacaaaatagaataatgaaatttaaatgcaataaatttaggcagttatacccttcacttctaccacttacgaaagtaattccagttctttactgtttttatcttccaaagttatctgaggagcagaggtcagaacctgagcacatcacttctgaaaatttaccatgccttattaagaaaatacaattgtcccttggcatccttgagggactggttccaggacctctcttggataccagaatcctcagatgctcaagtccgtgatatggtgtaacctacgcacattccctcctatactttaagtcatttctaggttacttataatacctgatacaatgtaaatagttgttataaggaataatgacaagaaaaaaagtctgtatgtcttcaatacagatgcaaccatttatgggttttgttttttgtttgcggtttttttttttttaatactttaaatttgtagtggtttgaatccttgaacatagaacccagggatatggaggttcgactgtaccagactttacatacactaaagactgtggcatgagggtgtaggctattattaagatcaggttgatatatgtgtgtgtataaatataaatattgtgtatgtatgtatacaaattgtatggtgtgtgtgtgtgtgtataattttataatatagttactgtgaaatgcatttggatagtctttaaaatgtcccaaatttgttgaataagaatgtaaaaggacatgaatttaaggtagactaggaaaaaataaatactggattatttggtcccactaaagtagataaagaagaccaagatcaatatggctggcatctcctgcaatacatagtattctaggttgacgtaaatatttcacttcaatctgatatttgtttagctttttgagcacatgataattgttcatgggtaaaagaaatgttaaaacaatgacattgttttagatcatgacaattatgttgtgaagtagctgagttcataatatgcactttatgtatatgaaattatatttcaaacattttcaaataagaataagaaaatttgtcatttgccatatcagtgttttacagattattgggtaatgcaaagtgatcatcatttatttaatagatttcttataaaaatacagcattattaactttggggagtttaagccactcaaggaaacaaaatggcatattataccccagaatttttatttatttatttatttgctttagagacagagtcttactctgtcactcaggctgaagtacaatggcatgataatagctcatggcagtttccaactctgggctcaagggatcctcccacctcagcctcccagatagctagaactacatgtgcacaccaccacacttggctgatttttagttttcatagagacagggtctcactatgttgcccaggctggtcttgaggtcatggcctcatatgatcctcccaccttgacctcccaaagcactgatattacatgcacgagccactgcacctggcccagaatattaaattttatttttggaagttattatatgtgatgaacagatattttaaatgactctgaccttattaagcaacgctgcgttttaccttttatcaaattttttttcccaggtcaagatttgaatatttaatctctactatcaaattagaactgtcccagataataaatcagttaattaaagcattatcctttccttccttatgtaaaaatgattatattgcatacctctttctgcttcttttttccctgtagctggcaattgacatttcctttagtctttccacaaatcatttagtaattgttatattcaggcactattctagacactgggaacaaaatagtgaacaaaacagcctctttccttgtggagctcatagagtaaggagaaggcaatatataattgtttattgtttagttaaaaagttatgtagtgtgttagaagttaagtatgtggacacataaagcagaataaaggtgtattgatcttttcaagagaaactagtaggggctggatgtggtggctcacctgtaacaccagcactttgggaagatgaggcaggaatattgcttaaggccaggagtttgagaccagcctgggcaacatagcaagaccccatctctacaaaaaataaaaaaattagctgagtgtggtggtgcatgcttgtagtcccagctacttgggaggctggggcaggaggatcctttgagcccaggagttctaggctgcagtgagtcatggttgtgcctcactgcacttcagcttgggcaacagagtgaaatgctgttctttaaaaaaagaaagaaaagaaaggaaggaaggaaggaaatactaatctatctaatgtgaatattttcatcttatttttttctttaatttgtagttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtaaggaactcttgtctctgctgcaatcccaatgtaataattatttgaggttgttggtttattcaaaaaagagagaaatgagagtattacgttaatttgtgacattgtatatttaaaagtcagtattggaaaaaaatcaatatcggtacctatgtatacaatgatgttcagtgaatggattttacctctgtgtttttcaagtagtagatggttcctggcctgggactcaagagaattgtattttagtctaggttccgttctcaagtagatgtgtgaacttgagaacagtgctgtttctttaatgttcccagatcttagttttcataaaacgaagaggcttgactatagcaaggaggggacagtattacttagcatttccaaaccatgacttttgtgtcatagagcatcccacagaactggtgctgcacattttgctttgggaaaacatggatccagctctgacattctgtgattgctccataagtgaatattgtgcagaacagaagcacttcagagagcttctccattcataatggggaatagtgctctgcagctaaggaatttattattttctaaataggacatttatttacagtcaaatgacagcaatgtatactgtacatttttattgtgcatacatagacaagatagcatctctttcagtctttagtttgagctttcatgtatgctgtttgtatttcataacaaaaagtaggatatgtgagctatttactggacatcaaaagaactttagaactcagttctaacaaattccgattgttttatgaataactagaactttaagatacgatgtgaacgcatttctaaaattttttgttagtaattagacatgcagttaatttgcttgctacagttgtattatctttgctgctaattctctagaatgccttaaaagcaatgtcttgcaggtcttgtgtctataagaatgatcaagctgcaaaggataatccaactaaaagtcttcaggaagaagaaccatgtccaaggtttgcccatcagcttgtatacgatgagctacacaaggtatcctaactacattgacctgtaaactttccatggcctactatctgaaacaatccccaaatatatctttgattgttttaaattggatttgagtaaaaagttaaaatacatagtagacattcaatagaataacaaacacccaatatcacttctccctaaaattccttaagagaataagcatttttacgtagtctgtaattcttggtacttttccttttttgaaaatagtcagtggcagcttcttagctgtatagatctagatacatgacatagcctattgtttctacaatgtgactatccaagtaaaatatgtacagttgtcagcatttaggtaccttgttccgtgatataacatggtttttggttttagattttcctattgtgtgcgaagtctttttaatcttaattttcctgatatactagtgatacctcttttaaatcagccttgtgaaatggtcctctgttgtgaatttttagtgtcatagtgttgagagttctttctttatttctgtcttaaacttaaccatgtacttaagtgattggacttagattacatagtaaattactgacagagaccaattctttctgttaagccatggatgatttatttaaattctacgcaatacactttgagacctttaggtaaaagataacatgggagtgagtaaaagccctttcttttataacctctcaatttaaggagtaaatgaatttccatccataggatagagataataactattatataacaccaatgaatataaatgtttttaaaattttaggaaatatttaaatttaaatttaataaatgtatacactaattgtaattaaaatatttaaatatttaaatgcttttgtatacatacagaaaaacattcaagtgcaataaatttaggcagttatacctctcacttctaccacttacgaaagtgattgcgtttcttcactgttttgtcttccaaagttatctgaggaacagataattgattaatgtaatagtgaaatcattataaattccttttgcatttcatttttggtattgaattatggaataatgtttttaatgttatttcacaaattatatgtgccatttaatatttggcatttcagttaaagcaaaattaagatgttaaaatttttttttttttgagacggagtctcggtctgttgcccaggctggagtacagtggcgcaatctctgctcactgcaagctctgccccctgggttcacatcattctcctgcctcagcctcccaggtagctgggactacaggcgcccgccaccacgcccggctaatttttttgtatttttagtagagacggggtttcacagtgttcgccaggatggtctcaatctcctgacctcatgatccgcctgcctcggcctcccaaagtgctgggattacaggcgtgagccaccgcgcctggcctaaaatttttttaaagtttctagttgacctgttgactgttaacttttagtgattcagcatttatgtcagaatttttaagatatttgttatatgatcaatattgtgattaattttatccccattatttgttgtcctcagcaaataatatcttggattaacttcttcctatcattgtttttgtttcataccttccactgtcattgtagttatggtaatataactcactttggcatatgtgcagttttttaaagtagccatggtgctttaaagcaaaatagaaatgagaaaaatcaagagaagcttttggtaaaaatgcagtataatttttaatttttttatttgaatgggctcaggaagttaacctgttatgcactgctactagaatatcttgggtatgcatgcatttttaaaaatctggcttattttgcttattataggttcattacttatttggtgggaatccaggaaaatcttgctctccaaagatgagattagatgacttctggtcactgaagttgtgtagaccttcaaaagattatttactgaggcattgcaagtacctcataagaaaacacaggtatgaaaataattcactgaaaacatttaattaacattatcagctatatttctcttggcaaatttaataatgagacagtgtaaatactatgaagatcatgaattttgtaaatgccctgttattccacttatttttgctttcgtttttcaaaagaagatacaaaatacagatattgatgctaaaaatttataaatacagaacaagtgaaattttgcagctgttaaaaaaatggaaaataatttctgtgaaggtgacatgcctacattgaagtaactaaaagctaactacaaattagatcagttctaacttaatgacacgtgcctgagcttttgataactctcttaactgtgaatgtagtgatatagttgactataccatatcttcctaatttgatgtgtcacaatacaatttcaaagcttgtagttttatgtcacctttattattaaattgcaaaatcatttaatcaaacattttcatatatatacatatacacacacacacacacacacacgcgcgcgcgcacacacgcacgcaggcaccctgagtcatgtttgatttttagcctagaaggtaataaactactaaaaaatgcagaaaaggatttctctccttttggttactgtagtgttatatggtaataaaaatttgctttagggccaggtgcagtggctcatgcttataatcccagcactttgggaggcagaagtaagaggattgcctgaggccaggatttcaagaccagactgtcaattactttatgctagaccctgtatattattctgtgacagagccaggatttgagcctgagcgttctgactccagagttcaccgcttaaccctcatatatacatacgtatcaatgaagaaaatgaacaaaaatctgccctcaagtgtccgttcttaagaagggagactaacaataaacataataaggaatttatattacatgttagatggtaagtacaatgaaaagaaacagattgagttattgtttgtacaggtgaggggggtgggaatatagttttaaatgagaatatcaggatagactgcacagtgaagatggcatttgaatagaaacttaagggacaaaagggactgaatcatatagctgtctggtggggtggggagtgttctagataggtaatagtcaaggctctgaagttaaaaagatgcctgaataatttgagaagtgaattgagaagaagtgtggtggaagtagaatgagtgagttgattgtggtaggaaatgaggttgaaaggactaggaaagggacagcttgtaaagggccgtcagcttttactcttaggggagattgaaagattttaagtagaggagtaacacattcaggcttgtattttataaaaatcattctgcatgttcttcccgaagaactgggtaaaactcgtggctgctttccctcaggtggggaattcttcagaaacaacgggtttatgtgttggaaaagattagttcaatttggggcactttaggtttgagaagtctgtgagagatgcaggcggagaccatctgaacatttggtgaaaagacttggcctgacattacagttgtgagtcatgggagaaggagcttgctcagggtgagcaagaagagtgaagggttgctgggtattctctgaggaccaccaccatttgagggacaggcagaggaagagacactccacaagagatcaagaaggcatcttaacattccggataaactttgaagattgtgccaacagaatttcttgatggatttgatatgggtatgagagaaagaaagcagtcgaggatgactcttagggcatcttgaaaatcttgtcaactactaattcagacaataaaaggcttattttagacctttttctctaccaagctgttagataaattcaagaatttgagggacatcgctacattatagacagaatagaagaagtttgtgtctatgaattgggtagaacacagaaattgcctttttaattcaaatgttaagcagatttatttttttataatacgggagcttgtactacactgttagactggcttatttttgttttgttcgtaatggaaaataaatattctgtttagttagaatataaatttagaaggagggaaagaagtatattgtgtgccaagtaggtacctccttgtttcttactgatgtcacttgatataataaataaaataccactattattttttcatacgacattcaggtttccaaacttgatgatttgagggtagaaatgggcaaaaaaaattgttataggattaatttctgttaatttaggaacagggcagaactgttgattaaaatacgattctaggctgcagacacaagtctgtgataagttcttgctggccaaaaatagcttagaaaatgaagatggagaacataactttcaggacactgatctctttactggatataggactgtgggtgtgtgttggttaggttatttcaggttgtaaaggataataacatgctttggatacctcagctgaaaaagaatttattattagattattcagggaattaaggcaccttctcagcatttgaacggtgaaactggatggagaattgtttaggatactggaacaattctagtagccaggtgctactgtagcttttccttgtacctctgtctgcttctttctccatctgcttgtcctgtcctactgactactgctgactttctcccaaccttgtggcctagatagatagatagattgattagatagatgcatagatagataggtagatagatagatagaggcatagaaagatagatggatggatggatggatggatggccggccggccagacggacggacggacagacagaatctgccatctcatggcttctgtttactgccttctctatttctgtctgctctttacatgtccttatgtgtctcacattcagattatcaaagagaaagaatcttcttagaaagcatttcctggggagagtgtccctattaggaagaattctgccaaactactttataaactgctaatcaaagcgtgggtgccaaaaccttggtctaatctaatctgttgtggacaagatggtaaagtaacatggtctttacctaaaggactctcatctgaaggctgtaagcctggctgtcactcttagggtactgcctggtacaagagagctgtaatattttgctagtctttgtccctgcgtgaagtacagaaaccctgtcaccaaggatgccatcaacctgaacaccatcgtgaaaggctcttcatcatctttcctactcaaagaaaattcatcttttccttgtctgtatattttgaaaagtataccaacgtattagaaataaacctgtatgtaattatggtataacagagacgttatctttttcaaatagatatatagatatagatacttatagatttttgttgttgtttaggagaactcatccagattcattctctgcacctcagttttgctttttttttttttgagacaggatctcgttctgtcatccaggctggagtgcagtggtacaatcatggctcactacacccttgacctcccaggctcaagcagtcctcccaccttagactctcgagtagctgggactgtaggcatgtgccaccgcacctggctaatttttgtagagatggggttttgccatgttggccaagctggtttcaaactcctggactcaagcagtccacccaccttgacttcccaaagtgttgggattacaggcatgagccacagcaccctgtttttttgttttttttgtgtgataaacgatgataaaatagatcatcatcattgcattattgtgagaatagatgaagtgatacatgtaaaatacttgatacaatgtctagcatattacaaatgcttgataagtggttgctgcagttgtttttactgactgagacatggacataatctcattaaaagtaatcagtgttaatgatattcatttaaaaataccctgcttatttcagtttccaaggtatctgttaagcatctccattagaaaatacacaaatctaagcaagtgtttttatttttatgtctacttgttttggatgaaacacattgggattttctgaagttctgttttataaaatacgtagtatattcactttgtttggtagttggtttagtgctaccttgtagttttaagagaagataggaaatgctcctacccagtctctagcaccacagctgcctgtgaccacctggcattaccattacatttccaagaactccacaactacactatctacctggcagtattgttaattctggattcctaaactgacattttctaaatatccagaacaactcctcatactcagtataacagtgtattttattccaggtctgaaagacatttctgatattttctcataactccagataattatccttgtttacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataagattcaagtcaccaaaaacccttggtccattcagaaaaggattatcaggtataaagttttaacttagttttgtgttttggaaagcaaatagaaatttttactttgtccatagtcccatgattattttacttaaggattacataatggttcaatataaacttttctgtggatagttaagatcccccaagagaggaaagaaaactcccctgttgcttagggagaaaatgaagagaggttggtgggagttagaatccttggtgccttaatatttagttatgtgaatgttgtagcagtattgtttgtctataggctactaatttcattcatcactagttgctaagattgagaaatcagttagccaatcattacttttcagttttttgttacataacattgggatagaaacaactgtttctgaagatttcatatccttaaggacatgtttgcttatccatggtgtgtgaaaatgcctgcaatgatttttgtgtttttgtcattttttccttttccaggcatccttgttcatctagcaatatctgaactgcagtgcatttgccttccactcacagaattcgtgctgattatatgtagttctgacccttaggtctctttccgtgttagctcctgccttgctttggctttgtaatagcagtatcaagctgtgcccggcatgcttgagcattgacacaggtgtcagatttaatgttgaatcactttcaggctccaggttcattgtactttcaagcaatagaggctgcatgtcttcagcaccataacaaagagatactctttcatagtttcgtactataaaattaagtcctaagtctctcaatattgattatggcccttcagtaggtagagaatctgcaggacatgctttagaacccccatgaagggggacagttaattgtctttccttgagttttcagtcaattcatgacactgtgcaaataggagaaataattatagttttgccaagtggcagaatatgtttgatttaatcttttatgacttataactgtacttagttgtgaagagtccattaatgttaattttgttatgccatgcatttgagagttatgcatagatttccttgtattttctccatattctatgtaaaatagctgtaactgggaacaatcattttttccttatttttgaagccaaaacaaaatatttcaaagtaaataatttcagctgtgtgagctgcaagtaggccaaagaaaacaagacagtttgttcttaaagttaaactaatggggaaaaaaaacaggacagggaggtatctcaagttcatttgagccatttttaaaattttggtagctggtttctgtttttcttctttttaaaatagtaacaacttaggattttgtgtgccaccagcttccattccatttcataaaagcttaatctagcaagaattggtgagccctagtagaagttagaaagaaatgttgaagtgtgtatgtgtgtgtgtgtgtgtgtgtgtgtgttggcatcagaatcaccttggacactttttaaaacaatgcccttggctgggcgcggtggctcacgcctgtaatcccagcactttgggaggccgaggcgggcggatcacgaggtcaggagatcgagaccatcctggctaatgcgatgaaaccccgtctctactaaaaatacaaaaaaattagccaggcttggtagtgggctcctgtagtcccagctactggggaggctgaggtagaattgcatgaacccgggatgcggagcttgcagtgagctgagatcgtgccactgcactgcagcctgggcgacagagcaagattccatctcaaaaaaaaaaaaaaaaagaaaaaaaaacaccatgccctcaccctaaggttctcctctgtctgctcttaaagaacagaaaatagaaaacattcctgacattgagaattactggtccatagtattaatattttgttttaaaatttgtgaacatatttaacttttaaaatgttttatatccaacagtctgtttggggggaagaaatcctctggtaacagttcacatgtatactcacgatatttgtcagtgagacatgtagatctcattgtaggaaatcattccactcattgagaaggggcttactgttcttcattttctatagtaacttgtttttgttctgtttatatgttttacagacatttaatgttattaaatgactttctcatttaagtctcaaaacacaaaaagtgttttttagattttttttttcacagttgttatgatcatcatcattgtgcctgttgtcaggacattgacagctgactatcaactatataacaaaaaaatgttattggcttcctccagtcttcagaacatgggttctgaattggtgatgaacttacaataaatcttataaaaaatgatatttttttctagaaaagccatgagaaaaggatgcctaatcaattataccactttcagagaagacttctataatagagaaggaatgagaataagttttcagctacaataacacattttatattcattacacttctgcggagtttccagagtgctggtgtcattcatttaacagttgtgtatcgattccccataataggtcaggcattctaggcagaggagctgtatcagcaaacccaacaagatccctgcccaggaggtacttacattttagtggagaaagacaataaacattaaagaagcaaattatatagtacattagaattgaataagtactgggccgggcacagtggttcacgcctgtaatccccgcacttcaggaggctgaggtgggtggatcacctgaggtcaggagttcaagaccagcctggccaacatggtaaaactccgtctctactaaaaatacaaaaaattggccgggcatggtgggaggcgcctgtaatcccagctgatcgggaggttgaggcaggagaatctcttgaacccgggaggtggaggttgcagtgagctgagattgtgccacagcactccagcctgggcaacaaggagttactgtagctcagcccaaagtaatagtagagcagtgagaagtaaaatagagcagattcttaatatattttaaagatagaaccaacagaattttatgatagattagatctagtgtttgaaagaaacgactcaaaggttttggcctgaaaaactggaaggatggagttactatcaactgaagtgagaaagttctgtggggaactggtttgtggggactcctgactggcattcaggagtttaaatttggaaatgttcagtttgagatatctatgagacagccaacttaagatgttgaggtgactgttggatatttgaatccagagtttgggaaagaggtctgtaatatcccttggtatgtgttaaaatccttaggccagtacatacagttcacttatttaatcagattgttaagataatagttttctccttatcctatatgtagagccaatacaatttatttttcaccttaggagttagaaaagaggaacaaattcaaccccaaataagtaggaaataagaaattcatgaaataggaaacaaacaatggagaaattttaaaagtgaaaagttggccttttgaaaaggtaaataaattgataaaccccaagcaagacttaccaagtgtattagcctgttctcacactgttgtaaagaactacctgagactgggtaatttatgaagaaaagagatttaattgactcacaggcccacaggcttaacaggaagcatgactgggagtcctcagtaaacttacagtcatggcagaaggtgaagggcaagcaagcacctttttcacatgatggcaggagagagagtgacaatgaggggggaaatgccacacatgtttaaaccatcagatctcatgagaactcactatcacaagaacagcaagggggaaattggcccctgtgatccaatggtcccccaccaaacccctcccccaattcaacatgagatttgggcaaggatgcaaatccaaactatatcaccaagaaaaaaagtgaaaacataaattatccacatcacaaatgaaaagagggcatcagtttagaccctacatatattaaaagtaaagtgggtatggaaaacttcattgacaagccgcaacttgatgaaattgacaaatactttaaaagacacagtttaccaaaactgacacaagaagaaatagaaaatcttaaggaactccatatctactacagagattgaatttgtaataaaaaattttctaacaaaaaaaactctaggcccataatagcagtaaattttatcaaccattcaaagaaggaagaaaaaaatacaattttacatagactctcagaaattagaggaaggcaatacttcttaaatccttttataagccaggttaactttgatataaaatcccaacagaagctgggcgtggtggctcacgcttgtaatcacagcattttgggaggctgaggggtggatcgcctgagcccatgagtttgagaccagcttgggcaacatagcaaaaacctgtctctacaaaaacatgcaaaaaattagctgggtggtgccatgcctgtagtcccagctcctctggaggctgaggtgggaggatcacctgagttcagagaggttgaggctgcagtgagctgtgatcataccactgcacgctgaaccttggtgacagagtgggatcctatctcagaataaattagaataaaataaaatcccaagagagacgttacaagcaaagaaaatcatggaccaatatttttcatgaacataaatgtaaaattcttaggaaaattttagttaattaggaatatattaaaaggttagtgtactatgactaagtggtggtttattctaggaatatatggctagtttaacatttgaaaaaaaattcagtgtaattcaccatgttaacagaatgaaggaggaaaaccatagatcatcttagtaagtgaagaaaagcatctaagaaaattcagactcattcataataaaaattcttagcaaactaggaataaaaagaaacttcttgaatctaaattcctaaaggacacctgtgaaaaacatacagctagggctattcttaaacatttaacccttttccctaagattgtgacaaggaaataatgtatattattagcccctctattcaacattctaccagaattacactagctagtgtaataaagaaaaagcaataaaaaacatatagattggataggagaaagtaaatttgtttgcatttgtaggtaacatgattatgtacattcgaaaccccatggtgtctacaaaacaatatactaggacaagtgaatttagcaagattacaaaaatacaaggtcaatagaaaaaaaaagcaattattagcaatttttatactagcagtgaacaattagaaaatgaaaagcatagtttatattagcatcagacatatcaaatgggtagaatgagtctgttgtaagaaattaaagaagaccttgataaatggagagatatatttatggattgaaacactaaaaattgtttaaagctgcccattttccccaaattggcctttattttaatgcagtgtaagtttggtctttgttgttgttgtcattgaggaaatagacaaactactataaaatttacatggaaatgcaaaggttttagactagccaaaacaattttgaaaaaagaaaaaattggaagctttatgctatctgatttcaggactctgtataaagccacaataatcaagacagtgtggtactggcttaaggatagacaaatggatcagtacaacagaatagagtccagaagtagacccatacgtatgtggtcagttgttttttgaccagggtaccaagtccaacggggaaaagaaagtttttaacaaatgatactgaataactggatatctcaaacctttctcactgtttactgaaacattaatttaagattgattacaggtctaaatataaaatccaaaagaataaggctttgggaagaaaacataggagattatcttcacaacattgggataggtaaagatttcttggacatgaactaaaggcagtaatcatcgaagaaaaatatggataaattggacttcaaaaaagttaaaatttctgctcattaaaggacttttaaaaacatagacattgccaggttcagtggctcacaccagtaatcccagcattttaggaggcctaggaggaaggattgcttgataccaggagtttgagaccagcctgggcaacatgtgagacctcgtctctaccaaaaaaaaaaaaaaagtcaaaaaatgaggcaggaggattgcttgagtccaagaggttgaggctgcagtgagccatgatcacgccactgcactcccaccttggtgacagagcgagaccctgcctcaaaaaataaataaatagacaagccacatactaaacaatctttgcagtagatatatctgacagaggactgatacccagaatgtataaagaacttctatacatttttaaatttttctttttatccccccttttcataactcttgcttagataaatacctatggaatatttgtacaatttctgatcttcaaaggaccattaatcagggcttacaaatgttggtatgatttaatatctgaaatgttaaaggctgcaagcatagatgtgaaatatatcctgaggacttggtgatactaactgctcaagtcttgggaagtgccaagtaactccattgaggagtttgtctgctctaattcattcctttaactggtctcttttcctgcattctcattcaagataaatacaaatagttctccagattttttattttgtgcctatttgttaaattgctaatgttgcaatagttttgtcttactctgtttcttcattgttcaattacattgtctgttttaaactaactttaactgacagcctggaaatctaagcaacatttacaacattatgtccattaaaaaaggtctttgggttttaacaatataattatatataattgtggaatctcaatctaagttgtaatttaggaatggtctatacatgctttttttctcagattttgatttacacagctgagacatcaggtattttacagtggcttacgtttatttttgagatgagaatgcatatatgctaaaaattcagtaacgggacccagggcaccaatctgttcatatgtgttagattcaaatgacagttttcttttttattttgttgtgctgttgttccttaataagtacatactttaatacatttttaaaataaaataattccaggacatggcccagtattttagaaaatgataatagcctagtagaaaagtcattatattctgtaatctgaatgtgttcttcttgccactatttggtgaatagacctatgtcacacatatgcagaaatacgtagttgctgataaatggtcaaagttatagaaggctattttccttcagtgcacttagccagctaatttgctgcttctttttttttttttttttttttttaaacagtttcagctcctggcatcagctctattcaaatctggttcagattttacagctctgggtaagtattgcagtataatttatccagctagatgccctagcatttggaaggttggattttggtttcttttacgtgaaacatcaggtgagatgtttcagtcaaatagatgagcaaatgaagtttcaaggtatcatgcaaaatttctaataacctgctacaaggttgctttgaggtatcattttgcagttcagtttgcaatgactattataccaattgctgtgttagtatgcaaacagatagcaatagaaacacagtcaaaataaattaatttgtatagcactgccttggaatgcaggctgttttactgatacacactatgagataatacttgttgattaaatagtttttcctctcagttcgttctttgtggaattgtgtgtcgtcaagagaatagcgatggggtaggcaatgttttgggagcacagaagatagattatctctttcctgaaaatgggagttttgttatcttaattgttcaagataacttctggttgaaactcaagtttttctcaaacactttagtcttaatttagtaatactctcttttagtattaatgaattattaactagactgtaggccgggcacagtggctcacacctataatcgtagcactttgggatgctgatgtttgagcccaccaggagtttgagccaagcctgggcaacatagtaagacctcgtctctacaaaaaaaaatttttaattagccaggtgtagtggtgtgcgcccatagtcctagctacctaggaggttgaagtgggaggatcacttgagcccaggaggtagaggctgcagtcagccaagatcatgccactgcactccagcctgggtgacagagagaaagactgtctttaaaaataaaaaataggccgggcgtggtggctcatgcctgtaatcccagcactttgggaggctgaggcgggaggatcacgaggtcaggagatcgagaccatcctggctaacacagtgaaaccccatctctactaaaaataccaaaaaattagcagggtgtggtggcgggcgcctgtagtcccagctactcaggaggctgaggcaggagaatggcggtaacccaggaggcagagctcgcagtgagccgagattgcgccactgcactccagcctgggcgacagagtgagactccgtctcaaaaaataataataataataaatttaaataaataaataaataaatcagccgggcacggtggctcacgcctgtaatcccaactactcgggaggctgaggcagaattgcttgaacccaggagggggaggttgcagtgagccaagatcgtgccattgcactccagcctgggcgacagaggaagactccatctcaaaaaaaaaaaaaaaaaaaaataccaagactgtaataaagtgggtggtctctagaacccagacctttacttgggtgaattttcaagggcattttcatcaggataacttatgatagcttcattttttaccaagataatcgtcttgaagtatggaaattcccagctttcctctggtcagtgaatgcatattaatcccattgatgctggtgcagttattatttgccttagagttgagcaatagtattgaaattttccattgtatgtaatataaatactattttttatgtttggaataaaataacactttgggatatcaatttagtttcttcattatttgaccttttatctcttgaaagtgaactgtacctcaaagaaaaaagagtatatataattctggtgcttttcactgggatgaaaaaatagaggtgttcttgaggtcttgccctttatccatagcgagtgattgaggcttctcgactgatcaaggcaactccagtcctaagttctaactccagaatatgtaggattcctcaggactagactgagcagactgctataaacgtgactccagaaggttctcctaagaatttagataatgatttaccactattcatacactcgagttgaagaccttaggctactagaaatccccagtctgtgagctggagaacctaggtgtaaacattattttggaaagttcatgcccttctgaattctagcatttgaaacagatgtactgatacatgaattgggggtctggcatatattctgtttaaatgattatgtgccttatgtctgataccacagcccaggcccattattttatttattagtgcatagcactaaactatctctaactgacttatttttagcctttagaacaagaatttcttggcagcaatttaaatatatcaattagggtggtgtcagcaaatattttaccttcagcttaactcctttcttttgactctgacctattcactgccaactaatatattttgtcaggaatagtttgttttatttggattctaaacaaacctcagatatactgagaacaatacaaacacaaaaagagaaaaatacaagcaggggaaattcctgtgggatgttgtttcctgtcttgtctgaggggaggtattatatagcctagtgattaggaggttggaatgtgagatggtggttgagagtcaggatctcttttaaaagtgatcttgagcaagttatttaaactttctaattatcagtttctttatctgtaaaatggaggtaatgggaatacttacctcaaattgctgagagaattaaatgaaataattctgcaagatagttatcacagtaaagcagtaaatgctccattcagggtaccattactattgactgccttaaaaatttaatcttctagccaggtgcgataactcatgcttgtaatctcaacacttttggaggccgaggtgagatgatcatcttgagcccgagagttcaagattaaccagagtaacatagcaggatcttgtctctatttttttaaaaaagtcacctttgtaacactggtgaatttggataaggagcaaattcagattgtatgctaattttaataatgagaaatttgatttagtatttataaacaagaagtacttttcataaggtttcatgcctatttagagttcctggttcttgttcttattaattttctgtcagactgttctatctttgtgccaattagaatagaaataaaatgggttatttactgtacctttcattgtataaatgaatatttcattttctaaggtctgcaaaaaaaaaaaaaaaaaacctcagccgaactttctgaatgacttcctccagaaataatccaatttatgttcatcccttagtgagaattaaataaaagtattaatattgtatgtaaaattttaaagaatcagaaagatggaaggtgacattatcttagttttggaaaaatgagtgatctcggagaaaatctccaaggatcttgattttagagcttctggtggctataggcacttttaaggttgaactcagtcactttgctaagtttaagagctatatcttatttctagaaagtatgaattggagcaattaaacttattttcagcagggtatgtgacaagtaggaaaaatctggtctgtaaagcatgttgcctatttatttatttattcattcattcattcagacaggatcttgctctgatacttaggctggagtgcagtggtgcagtcatggctcactgcagcctggacttcctgggctcaagcaatccttctgcctcagcctcccgagtagctgggactgctggcatgcacaaccatgctgagctaatttttttttccttttttacattttttgtagagatgagatctcactgtattgcccaggtttgtccttttttggtcctcacaactctttttagaagtttacagtccaaatataaagtttagtgttagaaataagaagtgtacatttaataatgtgtatgctaggaaaaaaatgagaattcatgttatttctcctttaccacaagtaggaaaatccagctacgtgtaggatgttaagttaaaagtatattcctagccaggcatggtggtgtgagatggaagaatctcttgagcccaggagtttgaatccagcctgggcaatgtagcaagactccatctctaaaaacaaaaaattactcctaataggtcactttctttttagagcagtcattgtcatcagtcatactactagtgatatgctgatagctaattaatatttattgagcacttactatggggccaagtgctcttctaagcactttgcatgtcttaacgcatgattatccccacagtagccctatgaagtagctactgtatgatccccttttgtatatgaagaaactaggttacagagaggctaaactaacttgcccaggcatagtgctagtgaatggcaaaccaggattaaaaccctgtcagtatggcttcagagcgccttttctaaaccactaaatatgctacctctcactgagctttaccagtttccactgctcaaatggttacttcctctttccattttactttatttatgaaaataaagtaagataaacatagtgattaggagcatgaggtttagaatcaatatcatcacctttttgtcctagcagtgccatttaagtagttgtggtactgttgatgagtttcctagatccccacccctttttaatttatttttagaaaaaaacattgattacatataaagcttagaattctccttaaacaactttcctcaatctctgtattttaccctcaagtataatcacttatacgtaatacatctttacacacacacaaccatatacacagacatagatgcagttggttctcattattcaaagagtacagagttaggttcctacaagcctctggtcacaacattttatctactgattaatatataaccacgtattatgtgtgtttctgtttaaagattcctcatttaatatatattgttgattcactaacattaagttcatggtcaacatcactctaactcatacctgaaccaagcttatctaatgtgcatatttttccccataaggcctttttgcacttaggaatgccagacagcactttggcactacatttgggggccattttaaacagtgaagccaccaaaaacacaaaaatgtggcaccaaacagatggtgaaagggctgttgtggatagtaagagctgaaactagaaagcagcagagatcacagagttcagcttcagctggggacgtgtgcatatggtaactcaaatattttgccactttgcacatgtctgcaatgaccacagaaataccacaagtattggtttgggggttacacatgaattttagcaaacaggcaaattcacaaatatggaatctgtaaatgatcaagatcaactgtatatacgcatgcatacactcatataaatatataggtttgtatgggctgttttaatttattatataatgtaaaaacatattctgcagcatagtttttttaagttaatgatgtggcttgtagacgtttttatgaagctacactagatcagttgtattcttatgaagtgatacataattattcataatagggatctaccataatttaaccattcgtctaatgatagtgtaagtttcaatttcctcataggtaaatagtaaataaaaataaaagatgtgcctttgagagttaaatgagcttagtacattgccctacaacttaagcacttaatgagtgtgagttaataaaaattaaagggctttggagtcagacagacatgggttccacattccatctcttccctccctagctgtgagacttcactgaattactgaatctctttctgtgtaaaagaggtagatgaagaacaaaaatagtaataaccttaagattattgaatctctctaagtcatctcatctgaaactggagattataatacttcattgtttgtgtgacaatgaaatgtaatcatacctaaagtacctaccacacaggaactcagtgttttttccttcttagataatttgatctcaagaaaatggtgttactttataaagagtagcattacagaatcaatatcttcttttaaaaatataacacagcattgtacttctacatactcagaacgtaagagaaagaactaagccattttagtacagtgcttagactgtatactttcagtgaggtatagtctacaaacaaaagcaaagaaatgttgagtttggttggtagtggtacatatatagcaaatctagaactcttatgtattttaagttgagcaaatgagtacatatgatgttgctgggagtcagggttttcttggtggaagaaaggagatatggaatggaataagagaaggaagaatcctctggggctttaagaaattagaattaacaataaaagcatgaactataatagtgtaaaacaatgtatgcatatgataggcatatatgcataggcctagaaacaatgacaccctggcaattagcacagctgttcttgtttggtttttaaataatagtcacagctaaaagaaagtaggactccagagctgtgtaaagatgaatttggatatataccagaaagtaaggaagtaccccaaaattaatgggtacatttcaaaaagacacagaagccagctcaaaaaggctctcactggtcaaatctaggacaatatgagtatcagaatgaatgatgacagtaatgagtataacattgagcaagagaagaatccctgagtacacagtgatgcgaacaaataagtaaaatgggaggaggggaagaaacagctcttctttacaatagaatgtcaacaactgtagaaggagtcatagagtcagaaaatcaccatcatataactgataattgtttcagcaagaatcatcaatgattgctaaattattggatgcagggctgtgggagaacaggatatttacacagtctcaaactatctccctatcaatagtttattaattacaaaggtagaaaagaacacctttaccttggagaaacttggcatataccaacttaagtagatgatcaaagttaacatcatcagtattgggataaactgataccacatgccttctgaggtgatgcactgaggacacacaatatcacttctgtagcattcttgccaaaactgcataaactgaatctgatcatgaagaaacaatcaggcaacccaaattcaacacattccactcataagtgttctgtactcttcaaaaatattcattaaagtcaaagagaggctgaggaactatttcaaactcaggagacttggaaactaaatgcagtgtgtgatcttggattggattttagattagtaggaaacatgactgtaaaaaagtgactgaaaaataactggtattattgggacatcaatgttaaatttcatgaatttaatatatattggttatgtaagttaatgttcttgttctgagctgaaattagtttgagcctatagggggcaaagctgtctaaaactcccaaatagttctgcaaaaagattttcagtggggtacacacatggagagagacagagagagagagagagagagaacatatttgatgaaacattaattgatgagatgaatctaagtgaaggctatatggggtgttcattgcacaattcttgaaacttttctgtgggtttgaaatttttcaaaataaaaagttgaaaaagaagcaatttggaaatttcaaaaaaaaaaaagcataaaataggaagactctaatctcaccgttcagagataacctttgttaatattttggagtatttctttccattcatttccatgatccgatagtgggctttgttaaactcaagctcatctcaagtaaacattctccctcaaacttaaaacaatatatttttaaaaaataaaaaggaatgtgctgttcttgaggtattgtttattttccttccaggaaactggtatccttggcaatgttatggtctattcctgttcttttacaagactaaaacaggttggacctaaaatggtactctaagttgaatgaaaagcagtctgatctgaagtcactttcactgaacaccatggcatatataactcttgatggctctgtttctgtttctcatggcatttagcagcgctctcatgtctcagctatttcagggataggggaaattatttattttattttatcacttaaatatctcatttgtatgtaagaaatctgaagcagctgagataaaccaattgatgaagacagcatctcactgaatattcctttagctggaatgaacttgataattgaatgtttattagaggttaagggaaaaatcctttagattaacagtccctaccttttaaaaatgtcatatgctttctaatgtgtatcaggataaaagtagttcattgccttattcctcacataatgtgtgcctagcatagggcctggtacatagtagcataaaggtatagtgttatgtgcagataccattctgcatattgtacatgtatctccctcagtcgtctctgttaccactcagttccctgagactacttccagctgtctcagagacattaatgattttagactaatttctaaagacctctttcattttgattttattatatttttgttactaaaaaacttttttagtggttcagaagcattaacaagtcagaaaagacaagtggaatttcctcagtggaccagcagagaaaagacctaataaggaaaaaaagagagatcagtattatttgtaactaaagtgccagtccttctgctagacgcttttcatgtaactacatttaatctgcacaataactgtatgaagtaaacaggattatcacatacttacagctgaggaagcaaagtctgaaagccagaaagtctgactaatttatctaagatcacaccacagccaggtagtagaactggggtcagatcagtagtgtctgcctggttttgaagcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagatttttatttcttttttttttaattgggggaaataagcactattaacagattcagcactacaagtattttgaatgttgttgctgttggtcatttggcctgccttttcccttcctatttcactttgcctcccatcacacaactgcgtgtaaatggtgtcacttgttcacctctttacttcattcttaacaagtgtatagttctctaggacagttgatgtatgttaaggtgatatctgtgtctgtattgacttgtcttgtgttacattaaacagtaggcagaactgaggtctcaagtttgcactcttggccatagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgagga

SEQ ID NO: 17423 - DNA, 9279 bp, Human
tgtggtagttgtgacaatgacatgaggctgcaaattgctgagagtgcttgacacatagtaagtgttcagttgaatagtcatggtgagggggaagaagtatagttttggtagagagcttgggatttggccccataagagacccaagttcaaaattgtaactctgttgcctggcagcggcaaagtccttttgtcttcatagtaatgagacagtggacagttcctactggcaagtcagtggtccacacaggggccgcatatcaggctatccaggtatcccagccctcaaagtgggttataaggtatccatccccgctacccccattccaagaaagtggcttctggccaactcaggagggggctggcagagttgcactcatgaagcccggcttcccttcaggaaagctacagagaagtgactgccctgaaatctgaaacttaacgttttttccccagtttcacagggttttgctttcaggtttcttttgccctctgccattctgggcagagcaaactgagccctgtcttccctggatgctatcgttcaggcccttcaacaaggccaggggtctgtcatccctgcccaggatctcagagctagactcctttctggggaccctgggggcacacactgggagggggatgggggtggggagtggaccctgcaacctctccaaatcccacagttcttctggcccaagggtttggaggagattcacagaccctacagtccttcaagatgctccatagtgaatccagtgaactgaaaaaaggtggagagggtcctggtaggagcgtgggcttctgattcagagctgggaccaagctcttaccctgccatttcctagcatttgttccctggggctgtcttctgtccgcataacgggagcaacaccagttgtagaggatcaaatgcagcaagtactccctgtagataagagcgagtgttactactctgcccccgccatcccgccccaacctctatcaccctactcccagattatctccctatgttttgagttgcaggactctctctcagcattttttttctggcggggggtgggggtggtaccaacccagagtccgggccatctggggctgtctctgcttgctttctcaaatctgtagtctcttctcccctgactggcagggccggccagaaaccagtgccagccaagactggatggtctgcctgattcgaaaagttggggcgtgctttctccttcaactctttcaaagaaaacgttcttgtctggatctttctggctgtggtgaccgccggcttgacctcagtggacccactcatttctggaactgtcctctgcaccccgccctgccctaagtcccgctccagatctcaccccatgccacccaatccgacacccgacacacagagtcctagggtccaggagcggccgtcccaacacggggcgcttgcacacgccgacagacctccttggaggagccgctcgcagggaggacaagcccgggactccgccccccgccctgccacgagttccaccgcgagataagagggcccttccccaacgacgcagaatgccagaaggcaatctgggcgcgggttgctgagcccgggcccctccttaacttccccgacccggtctttccccactgatctctccgacctgcccctctgggtagcttcagccccgggtccacgcgctgctattggccctccccgaccgctcggctccaccttcagcgtcgcgattggtcagctcgcggggccccgccccgttttcctggaaagttcttggaaatctgtcaaagtatttcctttcactgctcagggccccagacccggcgacggggcccgcgcaccccgcccgggccccaccgctcagcccgcggttctaggaagacgctgcttccgggaagggctggaacgcggcagacaaaggattaggcagcagctcgccccgccccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtaagcgcggctctctgcccccttcccggccaccacgaggggcgcacgggagaacaggggcttcgtgctagctgccgggcattgggagggcttgacgggccagaggtgactgagcgcagacggacctcaggagcaaggctctgtgtggggctgtgacactcccactccccgcccccacacacttacctcaattcccactgtggattgggaaaccgggggctggccggctaaaggaggaactcacagggtgggctcagcctgggttctcattggagcagatggatgctaacggcacggcgtcccccaagatgtggccaacaatcccagatattcttctgggcccagagcactctacgctagcctgcctgctgccctgcctgctagtaaccttggaccagcccctggccccctctgtcctggtgtcccctctcctgccccaggctagcaagtaggctcttcttgggaagccagccgcagatccttgcctttcctcaggctggccacctgatggtctgcaactctcgggaggccctgggtttggcctggtcctgcttggggtacccccacaatcgtctcacaaccctgtctcagcccagtctgggatcccaatgtgagaaggaccttggctcctgcctctcatcttcaaatttcccagacttgaggtaagggacagtggagaggggatgctgataagacagagtcttgacctgagctgagcattcctggccatccactctgtcctgaacctcagcaaccccttcaaccaaagggtctgatgctggccatggtgatgtgacaggagctcaggaagctccaaggagagaggaagaaggtataaatgggtgttctgcactcagggaggactgggtggctgtgcttatcgcaactggcctggtgccaagtgagggagggtggaaggtgaggccaaggaagaggacatggaggtgctgggaagactacttctcccttgctgtctccagcaagttccttcctcctgtctgcattctgggactcctgaatacctgccccaccactgccttccaccccaggagcctccccctgcattccggggtcccatagcctctttcactttttaccctaggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccaggtacacactcaccaggagcttgtggtgatcaacacagctattcatacacccagctaccacatcagccccaaaggtgcccacacctacatgtgggatctgaggaccggctaagctatctggacgtggccacccacagaggttccagcctgactggctagccaccaaccatgctcctgggaaggtagctctgggccccagcaagcaggtcatctcaaaatttggcctccagctctccaagagggatttccaagatcccacagtacagccagggtaggtgtggaaaagtttttgtcaggctgtggtgtgccagagttgtgtggccctttctcactgtgagtggtcatagggccatgatttgttagaacctagagggtcacctataacctacacaggagtcaggtctggctcctgccaccagctcctgcctgcgccttcctgcctcacaagcaatactggcgctgtttgcccatgctgtcctctctacctggggtcccttcccccagctccttcctttggcctggaagacacagctcaggagcaagcagaccctgactcccccgtgacacctgcagttttatgactttgcattataattactcttagtgtcatcttccccagccagtctggttctccttgagggcaaggccatggtttcattatggcggtgtcctgaggcccagccagggactagacccagaactaaggcttggagatgtattttgcaaggagtgagggaggagcagctgtcttcctggggaagtagagccagtccctgctgccctcccaaggaggaagccctagtatcaccctgctgggtgggcttcccctaggagaaagctgctactcagattttggtcggctcagttcccccaaccccagccatccaagaatatggtgttactgaacctctcagtgcatgggttggtgggaccctttattgcggaaaagggaaactgaagcccagtgaagagcaagctttgtacaagatcgtagagcctggtagggctggcttgccagggtgggaactggagtgtggattaggtccctgcccttggtgggagctcatactgacaggaggtgagacttgccagtgcctttagaggccactgtccaccccagaccctccactgggagaagcagaggccaggataggctgacttgtatgggtaggggattatttcagtctctaagtcctggccagtgtggacctaggtccctctgagagacactcctatccatggggaggtagcgtgtgacctcaggcagcctaccataatcctggggcttctctggaggaccccacacagatctatcataggataaatctacttgtctgtcgtagatctatctcaactaggaccattcatcagtgggccatttaatcagcccacttcagccaggagggcacaaacatgaagctactttgcactgaatcctatcagtgtggtgagaacattagacatgcctatagggaatgatctgtgtttttggttgatataaaatagagagcaattaattactgtttagtaaatgcagggcagtggaaaagaatctttcaaaagaggatccccacatggaaacaatcaaggtggcttttgtgatgacaagtggggaacgagatactggactaactgagcccatggctgggtagaggggaagctgaggctcatagtgagatgggccagccagaggtcatgaaactagtctggggcataggggggtctctggagatgggggaagcatgggtcctccactcactgctcatccactgccttctagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggtgagtctgacgggggaggcaggccttttcctgagtagtctggtgggagaagcttagttctgcctttgagtctgatttgggaggcatagcccggcccaggagagtctgatgggagaggcacagccctctctagggaagcgtgaagctggaggcactgccttgacttgccctggattggttaccccagctaatttccactatgtcccttggccccctctgcacttgcctaggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccaccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctttcatgtacagagccctcaatggggccgattttcagttgtgtacacagtgtgtcccctttgatcttgttatcattagcccccatttgatatttgggctagcggagaggcccagaaattctatgtggctgagcagtccctgctggggactcattaaggagtggaggagacagggagcagcctctcctctcatctcccctgggtccccttgggaaatgggagctaggagacaaaggccagttagactgcctgcagggtgactgccctggccactgccaggcgagggctcgggggagggtggcagaggtgcatcagccctgagagatgtgtaaacaagaaatgccaactccaaatcgcaagtggagaatacccagggagagagagctgtggactactcctggggtcagtgtcttgagatgaggaaactagtagtcagagaagtcagggctggttctcccaggaagaaggtacagtgagtgcaaaggcaccaaggcatgactgggaggcacgtgttcctgacacacagaactgaagagggcttgctctgtgcagtggggcagggcaattgaatcggggtaggggccagtgagctggcagagtctgacctggggcggaggtgtccgggttctagtccagactggttgggattgggggatcctttcttctctctcagggttcagcacaccaaaagtgtgtggaagagcaatttcaatgaaaacaccctccattaccggacagtctgactttggaacactatctgttgagatcttcctgtgtcccgaagttttccgcacctttgcttgagggccccacaggaaagcttctctaaagctttctaacctttattctggaaacaatcctaaccttcctgttgtcttagccctcaagcaattagaagtcttagagtagaagagacacttgttggcaggttgagagcaaggaggggtgaggagtgacaggctgattacagggaggggtaaggacgaggatagacagcaagaaccatggagttcacacaggaccctggggacatggaggcagtcatggcaaagaataggtctgacgttaggtgagagtgagcaagaggtgggtgatggagggagggctgtctttcctggatgtggtgcccagacccaggtggccagccacgtgccttccctgttactggcggcggcctgagcgcttggctgtctgtagggccagatggcacgcttcctccaggtcaccatgacccagccaggggtatttacagttcctcattccttcagtctgaatttcagctgcttcattgcttccagaatgcctgaggtaacccctctgtctgcttcacccctagatttgagtcacctagcggatgggtagtggatacagaggggccagtgtcaagctgttcctcacctggtgctgcagcctggacagaaagctgctgtggctagaggaagcacagaaaactgctttgtacacagagagaaatgtctcaaggtgcctgccaggtgctgggcatggggcgagggcttgcacctcatgtagcactcaccacaactttgggagtgaagtccaaatattacccacgctacacagatgaggaaaccgaggctcagagcagggaaggggctgaccacggccactcaacaagtggggctcagggcagagctaaccctggggggtcctgactgaccttttgtcccccggattactacatgagatggggaggacagggatggtggcttccaggcaagttgctcttggatgctgttttctatctcctggtatccctgcctgctgagagctcttggccactggcctggccaccaaggtcctgttctcttcaccctggcctcagctcaagccagggcccggctcctgtctggggaggggctgccagctacttctgacccccaacaggttccaggttccatcttcttttcttgtttccctgccagggcagtgaatgatgcctgcccagaccccaatcagagactcagcctaacagatgctgaagat

SEQ ID NO: 17424 - DNA, 36090 bp, Human
gcagtagaagattccagatcatagggctttcaaagaggctctgagatcttgaatcagattctcaggttgggctcagggacatcaatcctgggtccagctgggcataaatgcatgtgtgtgtgcacatgtgcatgtgtatctgtgtgcatgtgtgttatatgcatgtgtgtttatacgtgttatatgcatgtgtgtgcacatgtgtaaaggtgtgactgcatgtgtacatgtgtgagagtatgtttgcacatgtggctgtgtgaggagccagaaaggactaggagaggaggccatggtttgaggataagagcccagccctgaggttgtgctttggagttggaatgggggctctgtcatgacagctgctgacctcagacaggtcacttaacctctctgggcttttctgtcctgtgtgtctgtagtgtggggcagaagggatagtgtgacctcctctaggctctgtaaggtcagggggttgcagggagagcacattcccagcatctggtctgcaagaagtgttcactatggccagctgaggctattgtctggagcctcctgcttcactgaacactgctagcttgaaggttgcctgaaagaaataggggcagagccccaaccccatctccactcaacatctgcacacagtgggtacccactaataagttgtagcaccctttcagtcactcattcactcattcattgacagaagatcatctttccaagagctacttctctgatgagcctgcacatgcagcccaggggtccgtgagtgtgcgtgtgttaaccagaggggctgagggggaggcgctcactgggcctaaattccggagccaagagtaggatggctggaagacgcctctgagtggaaccgaggtcctggtacctgcagtcctgtagatggcctgtagatgacagcagaggcccatgcagagcccctgcgctgagccgcaccttcccagttccaagtgagccagctcgctcaggtccctcagcttccggattgggggagtgatgtgatgtgcgcaagtagttcagatctgtcccagaagacagccacagccaccctccctatggctctagacaagttgttttctccccaggggtcccagtttcctcatctgtgaaatgagagttgcttaacagccggtgttgggaaaactggctcaaaatacgtaaggtagtctaagatgggcttaacagagacttatatgtgcaaggcaaaactagaaagctaatggagaatatctgtcactcggatgggagacagagactttttaaacacgacgccaaaagcccaaaccataaggtgaaatgttggcggatctgatcaaatggcaactcgggatttctggtccccaggatgctgtatataccaaagggaagcagcgagtcaagggcataagcgggagctgcaaaaagggggcagtcgccagtgctggagactcccagagccaccagagactaaagagtggcgaattcaacaacgacaagatgccacttccctcggcatgtttaaaaagttgagtacgctgagggttggccaacactaggcaagtcggaagcctagcaagccatactggagggccacctggcagcgtgcagagcaaacacccgactcaaggagagctttcaagagaaataagacgtcctgcgctgtcacgttctaggttgcgagtaaaacccgggacccgcacagtagcggactgccagtacaggggcctccctgggtgtccctggaaaccgaggaagtaaccgccccctcgggaagccacgcctcctattttgttccggctcgggggcgggacccagccggggcccgcctggccctttaaggctgacctagcggggccccaagttgggatgacgcgcagggagcggggggtggagtgggggagtgggggagtgggggggtgggggggggggaggtcacgtgggcgccggcagcgcgactctcggccctgggatttctgcggccgccagctcccgcgaccgcctctcctgcccctcgccggtacctcagcaaggtgcgttgccgccaggtacgccctcgctgggccccctctgcggcctcctccggggacctcgcggccattaggcgcccggccccttcccttcttgacacgtgcccgggcggtgctcgcttgtaccccgccgcgcgaccaccgccccttgctgcacgtctgtactctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaaggtcagtgagccctcactgaggcctggggtatcctggagggtccacagcggaagcctgtgagtgaagctatgtctagcgcccctgctaagcttcctatgctcagcaacatgtttcatcgtcatactgtcctgtaaggtcaggcttgtggtcctccctacttcacagatggggaaactgaggcgtagcctagctaagctttgagtgtcccagtgagcaaggggtggagtcactatggctagagatgctgtatccggaagcagggaaggggtgactcctgactctgggattctggctggacccatgtgttcaggcccaaaggggatctcttgttcagcttggctgccccttccatgtgaagctcctctgactggaatggatctgtttccctttgctggaagctgagaccccaccaaggcttgggtgggactgcttcttccctgtggcccctgcctgtctgggctggagtggtgtgagcctcccagggctggccagaggacaaggctgatgcccactgcacctgtggagcctcaggaggctgctgatagactcctgacgagtcgctggtcccgtgttgaaagggacaggccctgggccaacccacccctggttcctgggcagagggcgggccagccatctaaccacctcagactataggctccctggagacctggcatgctgatataggtggcatggtgggggtcagggggatgctgggggcgggtacctggttccagcttaaggcatacagttctgggcctagggccacaccccatacccagaatcccttgaatctgtcatctctggggtctttactcatttgtagcttgtgccaatggatgggtagagcatggcagggatagtggctcctggaggctagaagtacagcaaaggcccttctcattttacaaaagattttttttttttgaggcagagtctcactctgtcgccaggctggagtgcagtggcacaatctcagctcactgcaacctccacctcccaggttcaagcgattttactgcctcagcctcctgagtagctgggactacaggcgtgcgccaccacgcccagctaattttttgtatttttagtagagacagggtttcaccatgttggccaggatggtctcgatctcttgacctcgtgatctgcctgccttggcctcccaaagtgctgggattacaggcgtgagccaccgtgcccggcctttacacaagttttaattatgagtccaagtgcagagtcctctagatatggctaatagctatcctgtgtttgccagtttcatgaccttggatgatatcctagactctggaagccaggtttctgcatctattcatggggaaagataaggagttgttgtgaacatgaaatgagattatacatttaaagcacttggtacaggacctgatacaggtctggagaggttacaggacttatttaaggcacaaggtcttaaagcatctgagcagggagctggacccagctctctgtgtctttcccaggaccactagggccaacagaggaggttgtctccccggagtaccttggaggggaacatgcgggtgggtctaggagaggatcagggttgggctggtggggctgggccccaggtatagcttctttgcccactaacccagcagtcgaatggggtcggggagcttttcagagtatcaggaatgggattctctgagtcttttagggaaaaagtggctcttctgagggcagacgggggtaagaggatgaggaatgagagttttcatccccctctgggcactatttaaccttccacctgtgctaggattgagggcaggctgggtgggtgagggattgaggccagagacccacttcttaataccaaggctttgaccctgtgggccaagactgagctctgaccagcccctgtggtgtccagatgctgtgggtgagtcagggatggggtgggagaccagaatttgtaggcccacacagtgccagctttaagtaagactggacttaaccccttccccatagatgctatgtctgatgagtgacttggggtaacttctgactgcaagaacttccacagcacctcatcagtgctctccttgttctggactgggaattgggtcaggcctggagtggatttccctctgtacccctttatgggtgagcatggctaaggctactagcttgggaccttcaggatctggccctaaattggccctcaaaggggacatggattagatgtggctcccactccaggaccttcctgttcttagtatcactagtgaccaagcctagaagtccttacccagctaagcaggcatttactatctcccaatattgggctaagcacaacctctggtacagttattttacctgtcttgtgagtggtagctgtggccacgaggaggaaggtgacatctccccacttatagcttctgcccattgcccaggaagaccaggacctggggacctcagtacatgggcaggcctgggcccagggagcttagccagctcatgatggatcacagtcctctccttgcatctgcctagccctctccccccagttgccccagctcagcctaggcaacagtcgtgggctctgtgtctttctgcctccctggtgatgtactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctcagtcatactcagtggctccctcccaaggctaccttctgctgccagtgcagccattctactccattgtaccccaagccctcattgctgtcctcttggcaggaactggaggactgcctttcttggagagggtgtatgggccaggcggtcctccagtgtctgcttctcctgctgacctcttgcttgtgccctctcccaggcttaactagttaattagtaccttcagctttccctctaactgggcacagccctgcagatttgtcacacatcagttaccccaccacatccaagatccagtccttcaaactttatcacatacatgaaaattgggacccaaagtgagtcacacggtttgaagtggggggtgtagcagaggcccgaattttcttccctcctgacatcctgcccagccctcttgtggtttttggcctcttggcaggcagaagtgaccatggcacttagtatctctaaataaaagcaataggctgggtgcggtggcttgtgcctgtaatcccagcactttgggaggctgaggcaggaggatcatttgagtccaggagtttaagaccagtcttggcaacatggtaagacccttatctctacacaaaatttaaaaattagggctgggtatgatgacttatgcctgtaattccagcactttggctgaggcgggaggatcacttgaagtctggagctcgagaccaacctggccaacctggcaaaaccttgtctctactaaaaataaaaatacaaaaatttgctggacacagtggcgggcgcctgtaatcccagctactggggagactgaggcaggagaatcgcttgaacctgggaggcggaggttgcagtgagccgagatcacgccactgcactccagcctgggtgacagagtgaggctgtgtctcaaaaaaaaaaaaaaaaaaaaaaagtagccaggtgtggtggcacacacctgtagttccagctactcaagaggctgaggtggaaagatgattgctcgagcctaggggtttgaggctgcagtgagctgtggtcatgccactgtactccagcctgggtgacagagtgagacccatctcaaaaattgaaagaaagaaaagcaataaaaggccttatggagacataatggtggggtcttctttcctgcccctgtgttatggactgtggggctgggggctcttcccctctgacccctaaagcattttggaggctcttctaggctcccagtgccctcttcttcccttctttgttaaggagagtagagtggtggggtggtggatccacatgtccaggagacctctgcagagtcctctgggtcaagtctttgtagcagccatcttccttctggttcccaggatctggggaggttgctggggctgctgcctctgggacagtttccttccccttgatgccagttggcttccgtgagccaggctgctctgcatgtgggatctcagtgatgcctcaaagcacaacacagaagagggcatatttctcctgacagatgggaaactaagctctggagaccaggaggagatctcacagggatttgagattacacagggatgctgggacttggctgtgtatgttctgagcctctaactgtggcattcaaagcctctgcagtccagcccacctcccttttctactttaggtgacatctttccttctccagcactgaagaatttcttctcatctgtcaagactcagccccagtgccacctcttccaggaagctgcccagagttcctggctttggggcaatggaaccttctttgacccctttgataatactcccctttgattcaaagctcttttatagcacctaggcccaaggcctggcatatatcagagattcatgaatgcttatgaaaatgaccaggctctggcccctctgagctttggaaggagcatcaggagctggactttttccaggttgcaccttctccacaggagaggggttctttgattacagctcagagataagccacagagaaatgctatttctactctcctaagatctgggaattcacaatggaatctaacagttccactgcctcaatagacctcatggagaattcctgggagaaaggaaatgcccattcatgaggccatttctgctccctgcctgctgtccaggctgcacctctgagtagacagaggggctctgtataaccagaatgccaaaaggaagatagaacatgatggatgcagagactgggaagcaatggatccagagcccagtaccctggatgcctcactctccctggggggatggtgcccactgctccaagggtgaggctggcctgttggggctggtactgttgagctggatttgaagccaggtgaagctgccaggcaggccaggccctttttcatttggcagccatcatcccctcacctaccatctccagaccggtcagatcagcctctgcagggccacttgttagagtcaacaaatcaggaggcacatggagggactatgcagccggtacaatagagtccctggaaatagtttcactgccccctgggttctcccaacgctgctccttacctagaaggaaagaatctgaggagccagagtgttaactgccagggatgagcaatttgctttttcatgaagatcctggggagggcatcaaaccctacaaaatgcaaatagtggaattttaggcagaggttgattgttctgagatggttcgtaccgtgcctggctggccttgcttactgttttcgaagctgtgctcccagcctactctcaggatcacctctgctggggcttctaggatcttttcccatcccatctaggaactgatgccagctctccaggattcaggccttggtgctgtggattctgatacccccataaacggctaacagtttttcagagcattctgcccagcgggccctgtccacagtgcacaacaaggcacagaatgagttgtcttacctaactcttatcactcccattatatggatgaggttcagaggtcagcagcttgcccaaagtgctcaactagtgggtagcagggctgagctgtgagcctaggcagtttgatgccagagtcctagcatctaagtcatctcactcctcatgcaagtctgtggggacacgggagggtctctgagacttggtccttggaaagatgctggcattgtcctctctggctccactgggagccctggcagccccagctgggccctgagtgatgctgccagtgtctacctacatctgctcagtcctcctcactgtatggaactctgtgccagtgattggacaggtggcagtcccatgaggccagcacacaaggaccatgatgactgtgaaggccacctcagaaaggtcgtgtgccttttcccaggccttgtgagtctcagacaagtgcagctgggcagagcccagagcaccacgggcaggaaatcagactggtgagtgggcgagtggaaactgtatctgggctgggccagctaggagaggcttcctggaagaggttgccagtttaattcagacctctggtttgagaaggatgtggatgacagaggaaggcacagggtgtatgtgtgtgcctgtgtgtgtgtgcactcacgtgtgtgtgtgtgtgtgtgtatgtgtatgtgtgtgtgcatgtgtgtgacaatatgcctggtttagacattcagcacctgctgtggagtaccagtttcccactcgcagacctgtgttctggcaggatgtggttgacctcagcagggccggtgtcaaagtcctgacaaagactgggaagctgagggaggaccagaggaatctgtggaggaagaggcgtttgtgtagggccttgaagggtagagcaccattgctgagggtgctgcagggactcctgggtcacttgggctgttgttcagactatatgggaaggactcagttttcattacaacagaggtctgttgtatctcttctgagcttcacacctggggaagtggagttagatccctcattttcctctgctggggacatcatcatggaagatctctgggtggaggcagtagttggaacatctggctctgtaagcccgcaacctcccttggctccaggctgccatgtctaatggtgaaggcccatgggcaagagctgaggacatccctaggtgagaggcattccaagcatacctgtgccatgagagtgtgcacaaagcgcttcctggagagctggctctgctgctctcaggacagtgagaccatggctcctgtgagcactggtgttttccctggagaacattagttctactgctctccctccatctattggacatcttgtgtggtcccagatgaaaggccccatcttggggttgagagaggaacagtgctctcggcttaaaatgctttctgtgacattctccccaagtgactttggactaaaggcagtttcataatcttttgcaaaaccatcatctttgtggtgcagttgaaccctgggtttgaatatgtggtggggagtaggatccagtctcggtgactgttactatccctgcattcatgctatgagacaacataggccggcagacactcagaaggcagggctctcatttggggtggcctgggtgcatttgctggtgaaacattattggtttttatgaggactcacttgggtgcgccctgcacctggggaacccagccccttgagggacaggaaagaatggcgtgaagggagctctgggtcctgggctcctccccaccctcctgcccgtttggaactaagtggattaggccctgtgcaattgtgattaaaatcctgctgtgtgggaaccgtggaggtttggcttagagcaggaacacgaggctcccgtttggggaacaaggagcctcaggaggccctttcagcactagacaggccagagatgctgaaaagattgcttttgtttttgaggcgggtttgggattagggttgcctttttctttagactagggctttgtctttgctgccttctcctcatggcactagcgatctttctgtcctctgcctcctcgtccctctcatttctccttttccacctgtttctcctgctatcgctctgtccccgctctcccgggccttgccagtttgcctgtctcgtgtgtttcaggcctcatggcctcttttctgcagcctggcaggctgagggcaggcggaggacagagcagggccaggtcaggtgctaaggactcatcctggtcagcgggcagctcactcccccacccccaccccaggggagggtgggggtggggaaggaaggaggagtgagtgctgtacccatgccactcacagtgtcccctcctgctgcccgccttgaccaggtgtcagcagccttggcagtcagaacagtggactcaggagttcttgggctgagctgtaacctgaggaggtcccccgccaccccccccatggcttgtgtgaagtcaacttcagctgcagtctctgctgttgggtctccttttatggcccaatggtctgagacttttgcttgggacaattgtgtgggactaggcacagtgcgacccccaagggttccctagccacagtgaggtatagacagggctgagatctgacctgagtcagagccttagagccagccagaggagctggtgggagtctgggagggctcaaggtatgaggtgcaacctaccgccatttttacagagggcagagctgagtgtgagctgcacctgcactagctggtgtgaacactcaagactctctagctggcaccctgcacctgaccacccttgccctgctaaggctcagaggctacattcaggggcctgagggaccaggaccttgagctgccacactcatttccccattcttaagggttcagcctccacaagagacccatagctcatccacagatgctcacccaacattaacagcccccttctcaggatgtggtagaaggactggcaggtgttctccgtgctttctggcaggcagtggcacagggggcagggggatggcaataagggcacccacttgctgagtgcctcctacatgtcaggcacaaacactgcagaatcagaatggattatcacgcccatgccatggatgcagagacaggttcagaaaggcagagtaactcacccagggtcacgtagtatggacatggccctgtgctggaacccaggcctggctctcagccattcctctctgcgtgtgtgctcctctggggatcaggagccacagtctgctcatcagcaaaatgagagcctgggccgggcgcagtggctcatgcctgtaatcccagcactttgggaggctgacgcgggtggatcacctgaagtcaggagttcgagatcagcgtggtgaaaccccgtctctactaaaaatagaaaaattagctgggtgaggtggcacatgcttgtaataccagctacttgagaggctgaggcaggagaatcacttgaacccgggaaatggaggttgcagtgagctgagattgcgccattgcactctagcctgggagtcaagagtaaaactccatctcaaaaaaaaaaaaaaaaaaaatgagggcctgggtgctctgcttggcaaaggcctcccttttggctgtgaagacatgttaggtgggcaatgatcatcggcagtgccagggaagcaggcaggtcgtgggggcctgccttgcccactgctggggctgatcttgcaagtagatagacagcatagagactggtcagagggtgccccaggatgcctctcccacaccagtcagcaaatggtgttgtcaggggaacatttggctatggtgatgccaccagcaagggctatattctgccagggtcaggagctctgagggttatgactcaggtttggagaccccttccgctgtacttcatggactaattaagtgcttgagtcaggctgagccagtaccagggtgtgtccttaccctaggcaggcccaggagagggggagtgagtcactgccgcctagtctcatggcaggaacaggcagtgtccctcagagctgccaggccaccaccctggtcccctagagggcagggcctccccctcttcctcatagctatggctccatggtgtgatcagagactaggaaagccttctgggagtaggctgggtgtcggtgccttgggagtcctctggctgaacgtgagcaggaggggagaggggccaggggccaagggagactggaagcctggatggctagtgcccctgctacccctgggaggagcctgaggagagcgatggctgcctgtactcacccaggcctgtgtggggagctgcagagacatgaatgaagccaaaggatgagggagagatgctgagcagatatgagatagaaggtcagtgttgggggtggggatggaaggttccctagggcctctgtgccatgcctctgggggtgagccagtgtatctccccacgcccacttctgattcctttgtcatctctgtgacatctcctccaggcgagagagaccagctgtcattcttctgaaagctggagagttttgggtcccctctctccagagctggccagaggcctggcctgctgagtgcttcagcaggggtcacctaggcgtgacctcacttgccctggccacccctgctagggagggtggtatggccctttgttaccctgtgtcagctatgtgggcatcactgccacacaactggccagttgggggcacatatttcattgctgctgtggggtctcttcatgaagagagaccactgatgggacattatttctgagattacaacaaaacacttgtgtttgctaaaatgttccagtcttatgatgaaaatgtcctatttttacactgtcatagaagaaataaaaccagggtaaagtttcacagattatgtagctgattttgatagaaaaatccccttttcctctttgaagttaaaggaagataccagaacctggatcttctgagtatgtactcagggggctcacaggtggtctctgtggcctcccccggccctctgtgggaaggctgtgggcagaatcctgggatcccacacctgtcaggggcagagggagttgtgatcctgccactttctcactgtagaacctctgggggaggggaggaggccatagctgtctcagggcctctttccccagctataacacaggagccatgtgggaggagagtgggtgcccagttcacagatgcaagctggggcttgggaaggtgaaaggactggccatggtcacacattttgcaggagggacattgttcaaaaggatgcgcagagttgtcgaggggtgtaaaggtgtctgccacctgggagagtagggggctgccacaaagaagtgaagatgggccccctcctatagttgaccaagcttgagagctgggtgagttccctgttgtgggtttctgttctttcagtcttggttcccattccccagggtcgctcccctaagatcagccaccctctctccaccctggagggtcttccccttccttattgagcctttcacagcaaaacaggattcgtggactcaaggttcttggtccacctttgaagagcccagtctggctgtgcccctctgaggatatgagaccatttcctgtgacctgctgaattggagaggttctgcctcccccaggtccccaaggctgcacctagctttccctgaattctgggaaacaaggaggggaggagtgtaaggccatttcaggaagacccaggggaatcctaaagccaggggtccccaagcaaacccaggaactgttttcacccataccatcatggcccccaataccttcagtgtgcactggacaccaagttcatctgagctctttgtgtgtgctctcattccctccttgtggctccctgggaacaggagtattagcactatccccactttccagattgggcctgtgaggctcagagaggctgaatggcctgcccaaggccacaggggagttgggaatagacctggacccctgtggctgcagctagtcctgctgtgcatggtccctggtctggggcactgggaccctctagcactcacgttcccactgttcttccctcttccttcctgggagcctcgctcaggtccctctttctagaagcatttccctccactcttcccatcccccagacttagcatttcagcctttgtttccaggttgtctggggctggtgggaagcagaccaactgaggccatcaaaatttagtaaattggaggaatcttgtcttcctaagacttgatgatttcaaaatttgtgttggctatcctgtcccagagcttcctgggaagacactaggcttggaacctcagctactccctcccctcccaagaactctggtgagaagtggtcaggtggaggttcccagcctgtcaagctgccaccctgccccccatcaggtgtcctggccttggcctagaaggggagtggttgtttaggggtcctcctttcttgtgagttccctcagaaggggctggccttctccatcttgcctgttctgccaggttctggttctggaaagaaaggagaagggaagggaaggagccaggaccagtttcccaggtgtagatgtcatcatcaagcatcccagttggcagtgactcatccatagacccctaaatccttgaggacagagtgcccatggcagcattcccagtcccagtccaggtctagcccccagacagggccagtacatgtttgcaggagttgggaggggatctgtacatgggcaggcctgtacagttgaatcctggttcccaaagaactctgactcagtggtggccatgtgcaaaccacgtgacccagagaatccacaaagcctccctgaccctcagtttcctcatctgaaaatggtggctaacaatgcagttgttgaagggcaagagctaatgggtatgacatgcctggtacagggcggggctccgtgaacatctgccattgttgtaacagccaccgagtagcagggcctggtccagaccaggggcgtgggccaagctctcggaaggagtggcagggccttctctgtttgttttccccaggctggtgttgtggggatgagtgcctgctccaagccttgaagctgcatggaaaaggggtgaagcagctatacatggtccccagtcttgactctcactgcccagctgtgtgactttgggcaagtcacttaacctcccagaaggacatttccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggtcggaacttaatgaagcgaggtctcatctggcaggaggccaactcatccatagctgcaaaattggttccattagctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtctgcttctgaactctgaattcagggtcaatcccatcctgacgtcttccctgcagagcagaggctgaggctgtgacccattctctgagtgggcaaagcagctcacaagggtcacactggctggcagggccgtgtgtgttaatagcccacacaggtgccagcagcactggcaggggtttcaacaactggctgtaaaataaattctgctattccagtggtgtctcttatatcatttgagatgtgatcctcatgggaaataatcccaaataatcatacaactgggagctgggagagatcttagagatggctgagtcgaagacttgtcaaggagggagtatggtaggttcaaagtgttttgtcttattcacggcctgcctctgtaagaataggggttcccaacaatgaaacctaaatttccctacaacattctctacagttttgctgcctgagatttcgtgttgagcacgtgcactgagatttaatcttcagcattctggcctgcctttgcctgaggctgggatgagacccttaggtgggacaggtgttggaggccatgctggtccctgctgctcctctcctatctgtcctctggcacaaaacaaagctggaatcccaagaaaataaaggtctggtgatgttacctcagcactcctggcccacatgccaggcgatagctgaggcatatgtgctggcctcagtcttcatggaggaatccatattagatatgttcatttgagtctgtgtcttttgcagaattgctgttgaaggtgttgccagaaggttttctcctatataaggtttgatgtgaaatcccttttagaatttcgtcctagaaaatgttcagtgaatatctgtgctcctcttcatgggggtaataaaagcagcagagcctaactggtttccttctttgcaagacttccaggaagctcagaattaaaatttgtcctcatttatagttatgaacttacatgggtttctggtgcattttgtctttttcttcattctaaagagaatctgctgtttttgtttggtttggcttctgtcttgttttagaattataaaatgtctgaaatactgttgttaataagcagggcttgcagaaataatggtgcttggagggcctcaaggggtggtgagaggaactagatccttggcctccaggaggaagttccctttgctgtagggctgatgtctctcatactgtgagttgtcacaaaatccagagcttcagcttcttaatttattactgcctcgttgatgggagagataagtcagctctcttaccccggaaacagtgggtgttctggcagaggccatacaacagcctggccggggctgcaggttaattggccaggggtatggaggttggggtttggctgcaagaggtgttggggaaactgcttgtccaagctggtagcctcggcgcttcctgtatgtgagagatggagatactgtgggcactttaacttgagaagagcccagcactggggtgagctggatggggacacccatgtgtgggtgggtggacctggatagggggcccttcctgggcgaggaagtggctggaggagggtgttggggactggttcccaagagtcactgcagacatcccagctttgttcgatctctaagaagacagacagagtgattttctagttctgggcaacaagaaatgttaggccctgccatggtgatggggtcccagtgggagaggaggtctgaatggaggcatctgggcttggtcaccttcttgcacaggctgtcttaggttgagttgtagcaataagaccccccaatgtttcttgggcacctctccgtggccagttctctgctaggtactttggagaagtagaaaatattagatgaacaaatggacagatggataaatcctgttctctgcgagttcaaagtcaatattgcagagactggagacacacatatgcccacgggcccacacacccacccccatactccccacacacccatgcacacacccctacacacgatgtatgcatgcatgcacacattcatgttcccatgcacacacacacacccacatgccctcctcatacccctacatatgcactcacccacgcactgatgtacacatttatttcagaacaagcttcctgagtcttgtgcaagctgtggatttggccagtgctgctccaacttggggccaccccctcctctcatctcccctcagggaggggttgtctgggtgctctctcaaaagtcctgttctccttcctcctccagccttgccatcctgcagccaggtggccacagggcaatgacttcatcctcccaagcccgtgtttcctcaatctgtaaattggggctaatggttcccaccctgcttgcctcacagggtggcaccaagcattcccatgagataagggacagcagagtgttttgtaaactgcaaattgttttccaaacaggcaaatggtgctgttgttttcccagctatggaactcaagaattcctccacccacaagtaaaccctgtccttgggtggaaagggatatagtggtgatagtgaggggcctggcctgttttgaggcccccacattccacctggtgatgctagaggggcacgggcccttctgctctcaaattttgctggggctcactagctggtgaagtcagtaggggtcttggccttctggctgctggctctgggggcaagagagagaatttggcaaaggaggatgaggggagaagggaaagtgaaaaccagtatatcagagcctgaggcctgtggtcactcgctaaaggaaacatcatctcaaattcaatgcttgttgagcttcagtggggacccacacctcaggtgcatggccaggaatccccttcctcaggaagaagcccagtttccacctcacaggggtgtgtgtatgtgtacgtctgtgtgtgtgtgtgaatgtgtgtctgtgtgtacctattgggcactagctggagctgtggagctgcccaagtgccatcacagaccctccagttctggtggacccctggggagctcagggaacataggagaggaatgaggcaagggtgggggcccgttgggttgtcagaaatcccctcctatcttcttcttctttttttttttttctgaggcaaagtcttattttcttgcccaggctggagtgcaatgatgcgatctcggctcactgcaacctccacttcccgggttcaagccattctcctgcctcagccttccaagtagctgggattacaggtgcgtaccaccacacccggctaatttttttgtatttttagtagagatggggtttcaccatgttggccaggttggtctcaaactcctgacctcaggtgatcctcccgcctcggtctcccaaaatgttaggattacaggcgtaagccaccgtgcttagccccttcctatcttcttgtcttcccagctgtgactgggaaccatgacatcattgcccatttcaggtagcccccagtgggctcaggcatgtggatatggaggccatggggacccagaggctgctccatgggggcaatgatgtgggagtggtactatggtaggtactttgcaaggaacgcctgtctagaagtctgccttgttacccacttatctcccccaccctatatagcccaagccctacagcttaactttggggaaacagaggcccagagaggaaaagggactggcctaaggtcatactgagaataggcatagaacctgggcctcctgtgtcctggccctgtgctcattctcatgcctgggaagatggagctcttactttgggacatcttttgtgaagaatagtgtggagtcatgtacctatgtgaaggaggccaacttgcagaaatgccttgtggaatggagcagtcatgatgggctccctggaagaggaggtaaagcctggttcaacagagagggtaggtgaggtacaggctgcccttgggcagcagggagaaagtttgccaggttgtcatgtctcccatttgttgagcctcactggggcctcctcaatttaatctttttttttttttttttttttttttttttgagatggagtttcattctgtcatctaggctgtagtgcagtggcacgatctcagctcactgcaacctccgcctcctgggttcaagtgattcttctgcctcagcctcctgagtagctggggttacagacgcacaccaccacactagctaatttttgtatttttagtagagatggggtttcaccatgtttgtcaggctggtctcaaactcctgatctcgtgatacacctgcctcagcctcccaaaatgctgggattacaggcgtcagccaccacgcctggccaatttaatcttatcttgtcctcatgataggttgtgagaggttttccccctcatccttactctatagatttattaaatctacaaatattgataggcacagtggctcatgcctacaatctcagtgcttcagaagccaaggcaggaggatcacttgagcctaggatttcgagaccagcctgggcaacatgataaaaccccgtctctacccaaaaaaaaaaaaaaaaaaaaaaaaaccaaaaaaaaaaaaaattagccaggtgtggtggcatgcacctgtggtcccagctacttgggaggctgaggtgggagaatcattgagcccaggagatcaaggctgcagtgagctgtgactgtgtcactgcactccagcctgggtgacagagcaagattctgtctcaaaaaaaaaatctacaactattacctgagttagtgctctgtgtcaggccccgtatcccagtactgggacctagaggtggccaggcagactggccctgccctgtgggcccacagtctgatgagggaggctgctggtgttggcctggctgggggatcagccatgtgatttggggccagttacttcccctctctgtgcctcaatttctcatccaaaaagtggtgataatgaagtcctttcctcctaatgtttataaagtactccaaacagagccaggcacattgaaagtacaatatctgtatgtgtgtttttgcttaaagagttatcaaaggaacaagctaattgtatgttgtgagcaagtgctgcacaggaagtgaaaagggcgatgatgtgagagctttctggggagctaggaatgttttctgtcttgatggaagtttgggtcccaagggtgtgtgcaatcatcaaaactcattgaattggacccttgagacctgggcattttactatatgtcaattatacctcaataaacaaagcatatattgaaagaaagaaaaacaaaggatgaagagggagggcttctgagaggagatgacattgaggtggaccacattgaggggaggcctggaggagaaggctctggctatggggaaggaagatgagaaaactgaggctctaggaggttttgggctcagggtcaactcaaggggtcaggagagacagctcaggggatttcttggcagctggacctgggcccaggctgagggctctggctcctgtgatgtactctgcagagaggccagtggggcgtttattatattttccggggacggccctctcccctgtccctatgcctattttcagggctttggcgtttgtagagggactattttaatccatgtgggaaatgggttcctaaatatggactcagtggggcagaagccttgagaggctccagctcagggcagctccacctgctcctctacctcagcaaagcacaggatgcaggcccaggctggaaggctctccagcccctccttggccatctaccgccctccttctttccctctggctcctcctatctccctccagtcctgggcccatcctcccatcctttgtttgctcggaagcccagtgtttcctgccaggccccagccagggacccccaagtgaacttgacctgcctctgccctcaagctgctcccaggctggtaggaggaacagaagcaaaaccagtaagaaaggtgctgggaggggccgggcgtggtggctcacacctgtaatcccagcactttgggtgggtggatcacgaggtcaggagatcgagaccatcttggctaacacggtgaaaccccatctccactaaaaatgcaaaaaatagctgggcgtggtggcgggcatctgtagtcccagctactcgggaggctgaggcagaatgacgtgaacccgggaggcggagcttgcagtgagccgagatcgtgccactgcactccagcctgggtgacagagcaagactctgtctcaaaaaaaaaaaaaagaaaagaaaaagaaaaaaaggtgctgggaggactttccagagagagaaagagagagagagagagagagagagagagatggagacagagagagagagagattgatcgatctgaattgagccctgaagtttccccaaaaagagggagttgacccaacagagaggatgaggcaagaatgcacatgacagggaccagcacagacctagacacagaggcctgggggagtaaggcctgtttgggaacaacatatatatttttctggccagaacaaagtggttttggcccagaggtggcaggaagtgaggtgggaaaggaaggcaagccctgcgtgctgggggaggacatttatctggaagatgtgaggaagtgtctgtggccacaggtggattagagtcataaggggagaggcagggctgaggaccctaatgaaagcattccagctgtgagcttggacttttaagagagaagaggaggactctgatgtgggagtgagatgccacaaggcaggcagtgaggagggagtgtgggagccagcctgggaggcctgacaggagatggtcaggtcagactggggaggagagaaccaggcagggggagggggaggaggcaaagaaggaacccggtgcagggagggaggatggtacctcttggctcctgtggctgaggattggggtacccctagctagggccgccacaggacatggtggaggcaagtggggggcactgagctttctggtcccagtgctgagaaagaagctggtgattgggaattgtgcgggcactaacctgaggggtgttctggaaggcaagggcagcatgagcaaggatccatggtgtccaggcaggagtgtctgcccacagcagccttgacgcacacccccagcctgctctgggtaatggagcaggggcacagagctgctagagggcttgtccagcccctggctctctgtattccttgcactgcctgtattcccaggctagggttgaggggagcagctccagaaaaggagggacagccaaggggcagcaggctcgagaaaccactgcctgcctctcccctctctgggacactgccctgacccagtttgtctttacctagagagcgtgcatggtcacagagcctgcccctaacagtgccctgtgtaaagtggcctggctctccccatcctgcagaggaggaaattaaggctggggcagcccagggtcctatggctgctgagcagtgctgatccgagccccggtcttgagcatcagccctggtccccagccctcctccattaggaaacacagtgtcacagatggtccttgagtgagcaaccctttttgggggtggcttgtccctgctgtccccattctgggccatctcctcatgcatgctgacttcttcttctccccctacagcagggccactgtgaggccttgttcatttctggtgctggttggcagccacagtccagggctgagttaacccgagcaaggatcctgatgcccgcccactggatgcttgccttggctgggacgcaccctgtggggatgactctgctattataccattttacagagttgtgggctgcagcttggagctgtgaatgtatgcctgaggtcacaccgagtcattggaggaattcaatcccaaacccacatctcactccactcagctgtcatctccctcaactagggtcctcccttcccccagtctctacctctgggtccttaccggtgatctgtaagcatggaatgagggtggaggctgggcagctaggtcaccttgagatggccccacctctctcacagtgcgatgacattgtcgccctggtactgcatagcagctcccaggaaggctataaagttaccttgggagctgggtactgactgggtggtcatgaccaagcaactcattttagaagcacttttcttggtagtgagagttttgttctcatgcccactcctggagaatctgaagtcttaattacttttacccctacaggagtgtggccttgtctccctccactctgggccagtttctttgtgggagatagattgacagacacaggcctcaacctctcctgcaggaagtcttccttctcactccagcactctcctgatcatgctgagtcctgtagggcagatttgcgtgttagtgcaccctctcccctccccagcctttccccagcaccttctgcttctacacttacatttctcatagatgcccagggtgagaatcacaagggaggcaccaagggcctactatgtaccaggtgctatcctgtacaatttacatgtacaatttccaaccctagcctaggaaatggaacagctgtgtcatccttatggtaaaaatgaggctcaagggatgtgtggcccctggcttggggtcccatggctgctgtgtgattagagtggggttataaaacccactcaatttccatctgagaagggaagcaagggcttctttggcctctgagcccctcgaagcagtcagccacctcctacggactccttgaactacctgccaagctgcttgagcccaggactgaccctcaagtccagaggctcactggaccacaagtcagagaaacctagattcaaattctcattctgctccttataagctgtgtgacctggggcaggtcacaggcctcagagcttatatgtttttgtctgcaaaatgatggtagagggctctgagcctgacactttctatgtgcacccacctacagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatggtatgctggcctgccctgtctccacaccccctcggcatccctgtggccctcaggctccctgccatgcttctaggggctttctttgtttttcaggtagcagatctgggtgccactgtagcccctgaggggcaatggagcaggcagccgcaggccctgcctgtggatctatggagttggccataaggacattccctcaagggtgggcaagaaaccataggggttaatatggcctccctgagtgtgatttctactctgtgaggaggactggaagagctgtcagagaaggctcccaatccctgaatatggatggatgggggatttggggaagaacaggacccacgcaattccctcagctttctctccttttgacctgggtatgtgctcccatggtcccaccaggaactgggtgcttggggcctagaaccaggagccagtggccttttccaccctgggcttcttcctgtaacaccatggctcagcaccagccatccttggaccggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtgcttgactccattctaagtggcccatgtgtattgcatattcaatctgcatgactatggggttggtgctgtcatccctatcatacaaaagagatagctgaggcacagagaggtgaaagaaccagcccaggatcacacaacagcgctcatgaaacgtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacctaagctgacaacccaccatgcaccaggttctacaagggacagggaggctgacagtggctgttcagtaggggaggagcggagcagcagggtctgaagcctgggcctatgatttggggcaggggcaagggtaggatgatgtgcagtttccccctctctgcttatagtcacctcttttacagcatggaaggtggtgagttgttcagcaggattcaggagcgtggcgaccaggctttcactgagagaggtatgtgcatgtagctggaccagcaggaggattcagggtgagaggtatggaccagagcgttgtgtgtgatgctaggcaagaccctgttcctctcagtcttcccatctgaataagaaagggtgagactcagtgtccatccccacaagggactctctgagtctgagacactttgtcgaacttggactctctatggctttgggatggaggcctcaaagcctcttgatgctgtctcgcagttgagctggggagaggtagctcaggactgaggaaagaagtttagatgggttgggggtatcctcggaggaaactggggtgtctggggtggcgtagacatcccgggatagagaacctggatagcaggagtgctgtcactgtcttcttgtcttgtgctggcctgttagactgtgtccaggagggatgatagggtgggggcttgacctttgactggcatcactgaccccctcctcctctgtttctgcagaagctgcagagataatgcgggatattggcactgccatccagtttctgcacagccataacattgcccaccgagatgtcaaggtgaggctccaggattcaggttgggggcccggggaagaggatattgtcccactccacaatccctgatggcatccaggacccactggatggaggccatgttccctagtcacattcaaagcctctgctctgtgtcccagactgcttttctcagcctcttctctagtttcagcatactcattctgttctcaccaggtgggtccccttgcttctttcaaacactgagtaatccaaatagtaataagaataactgactgcctgcctaaagccagcgggccctgacaagcaatctcatttcattctcacccagccttgtgagataagtgccattacccattttacagatgaggaaagcaaggctcagaaaaagattaagtgacttgcccaggggctgtgtagttgctgcactgggattcattcattcatttgtttacttgttcagcaagaaattttgtgtggatgcaatgtgccaggcctcaggcaggggctgcctgatgctgttggttttttttgttttgttttattttgttctgtttttttgagacagagtctcactctgtcacctaggctggagtgcagtggcgcaatctcggctcactgcagcttccgcctcccaggtttaagcgattctcctgcctcagcctcccaagtagctgggactacaggcgcacaccaccacacctggctaatttttgtatttttcgtagagatggggtttcaccatgttagccaggttggtcttgaactcctgaccttaggtaatccgcccgcctcggcctcgaaaagtgctgggattacaggcgtgagccattccacctggccctgttgcggcttttgtgaagtcacagccatagctttgacagatcaggccccctgataccagcattttaagggaaagaagccatttgctgagccctggaggaaggaacagaggtagtgccagttgttgggccaccttccagtcttgaggctggaagctcagctctccaaatttcctatcctgggaggactgggtcttagaggtcatctggatcagatggatgaaatgcaaaccaaggcagcacacacatgcatgtgcacacaagcatgtgtgagcactatcagagcagagtctgctcctcctgggccctctgccccaagcctagaacgttaccttccttggcttatttcctcctcagactgggcagaggcgagctgaggttacagctgctgcataaggtcctccctctggctgagcaccccaacctgtaaatccttgctttatttggaccctggcttttttttcccgaagagagaaaagccttctgcagaggagattcccttgaatagactaaaactgcttctctgtttttatcacaattgagaaggtcagatcttctcaaatggaacctgagaaatagcatccattggttctaaaccaccaccccatccttctaccaacaccccatccttctaccccggctctgcttgggggtctcttctgcccctctccatgggcctacatcctacctaccattcattaaaaaccagtttcagggacagacctccctactgccctcatctgccaggcccctggctactcctgggacacaggaagattgcccctgtgcagctcctggggtctggggtctgagcaaccagggccttctcccctgagcaacctcagatggggctgtccttctagccctgtaggattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttgcttccccttttgtgaatgaaggtagcaccttgggtttctctatatttggcccatgttagtgggcaaggcccgggtctttttataaatggacctggctccttctgcactgggatggagtcggggagtctggctgaagatcaccttggggctctgctcctgcctggttcctaactccaaaccaatgttttctctttctggcccagcctgaaaacctactctacacatctaaggagaaagacgcagtgcttaagctcaccgattttggctttgctaaggagaccacccaaaatgccctgcagacaccctgctatactccctattatgtgggtgagtccttcggacatgagttgtaactcctcaccccaacttatacagctgtattatggggtagccagtgggttgcagaaaccaaagggttaaagcccagcaaggagggagggggagaattctgtctgcatggaggcgggtgacgtggggggccggaggctgcaaaaatattctcccaaacttcagcttctgcttttgaaaatagatccaggaaaattctggctgtggcctgtgagctgaatgacatcacagcagctctaaatatatatgtgataaaaggctgccatcagcttgggacggagcccaaccgcggttgtttttctctagtttttgtcttcctgggattcatattcagaaagtgggcatgcatttcctcctaacttggagggacaaagggtaccagtcacctgccttgtgggagacggtcactaaagccagggcttggaggtgtgcacatactcatgcttcctggaaaagttcactgcccttctgcaagtgggcaacccccggatctgaaaatgttccttgccaaaactgccccctaacctgagagtggggtgatgacagagggcttttctccctcagaagaggtcttcctggagggctgctgaaggggtgggaagttccctgagacagttgaaatggcactctgttaactaggatgtgttttgcactaagtattttaacttagaaatcttctagcctacccacctcattgcacagggaagacaaaggctccatggattggtagccaagctgatgatggaatgcagagccctgtccctggttcttccttgcctgtgacctaggctatgcattcagggaggcaagggacacaggacagctggcaggccaagaccctctcacctacggcagcttcccaccaagccccagactggccttctcttctcttctttcaccaaggttgagactggcagaggggctcaggcccaagggagctaggggtatgtctgaaagtggttgatttttttccaggagctttctcctcccccaacttcacacacatgctgcctttccaaaaggtgccagacgccagtctgctctgccctacctcccagcccaggtacctgctccccaccttgcccaggctttaggctcctgcctgggctccaagacccttgggtctgagagccctgctgtccctctgccctggcagcccctgaggtcctgggtccagagaagtatgacaagtcatgtgacatgtggtccctgggtgtcatcatgtacatcctgtgagtaccttccccaccccctgcctccatctcctgcccttacccccactgtgagccctcaggaccacttctgtccccccacccccatgtccttggtgaggagcttgtgtgtgtcactcctcatgcaggctgcccttcccttttggtcatgggacaccactccttcaggtgcctgagggtctccccatgccaagggctgatggcattcctgggatgtgcctgggagtccggagggctggtattattgctatggtgtctggttgtctgtctccccagtcaggggcttttgaggggaaatgggtccaccctggcactgctcccaccctatgccaaatgacttaccccttcccccagcctttgtggcttcccacccttctactccaacacgggccaggccatctccccggggatgaagaggaggattcgcctgggccagtacggcttccccaatcctgagtggtcagaagtctctgaggatggtgagtgaacctctctgtcccagcctgactcacctggcccctgcggctttcattctgggaaacatcactttggtgtcaaactgacctgtgttcaaatcttggctccccctcttcccagctatgggaccctaggcaagtcccctaaccttcttgagcctcagtttctacatctgccaaacaggctcaaaacttgcctcctcaaaactccctctaactcctattcctcattcatattttcccctttgaggaccacaaacaaggctgccctgtatgagttatctgctgctgcttaaccaattatcctgaacacttagtatttcaaaacaagaaatagttgttagctcactctttctgtgggttgggaatttgggagcacatgcagcccctgccccagcagagcttgtggtctgtggggaagggtggaggggctggctctgcaatctcatctctcccctctcttccctggcccccctagccaagcagctgatccgcctcctgttgaagacagaccccacagagaggctgaccatcactcagttcatgaaccacccctggatcaacgtgagcccctcctcctcccatggcaggcagggtgtccaacaggagtggggctgccgggcaggagggtggtggctctgctttgaggccccagtgcagggctggaatgggcccatgcacacaggtagatactagggcctcacctacaacctggctttgtcactgccctagtgaggctccttccccaccctgagccttggtttttccatctgagtctgggagaagaggatggagtggggggaaccagtgctgtcccaggtgcctccagtttctaatccacgggcgtggggctccttccagcaatcgatggtagtgccacagaccccactccacacggcccgagtgctgcaggaggacaaagaccactgggacgaagtcaaggtgggtgggctctgcctcagtctcaatacaggtgccaggatttgggcaaaagggacttcaggggggtggctacccagggtctggggtctttggcccctttctatacctggagcacagggtgtcagtgactgtcgcagtggtccaaccatggcactccaaggattgggcctcactacgccattcagtgtggtgctcctggctcacttcctcaatgaaacggggctttggtaccaagcttggatgatgacctctcttataaccaacaacatttgggagggtggtcagcctggtttagacccagcagaggccacgtttgaacatatggagtagcagctccagtggcacaatctccaggccccagtgcgctggttgcccagcgagatggcattctctgcaggtcttgtggttctgtggtggaactggtttagttcactatcccacttacccttggtgtggtccgagggagtaactctccttttgtgccttagtgaataagctcagtgtctaccacagaggacggtagtgaggatcatgtgatgcaaagggcttggcccagtgctgggcacacagtgggcacagaggcagcacaggctgtcactgacattaaggggctgcccaggcaggggggtgatggttcctaaggtcagtacatcctgacctcttagtgcccaccatcctgtctgtccccaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttggctcctgggtttactctttgtctacaggggtggacaaaggtggcccaagggcagcttctcagacccactagtgatttcaccccagctggagggggtgcctcaggcctgataagcatgccatgctaactccaaggccagagtcctcgccaggcctagaaaggtcagaagagctgagggatggcagctgccacatgcccccagctctgtgctgcccctgtgcagtgtgtgtgacacctacccccggtcctgtgtgtgccagcatctgcccagagtggccacccccagctgtgtgccagcctgctgaagggcgggcagagtgcctgctgcagcgctgagctattttcagaaactgccagatttcatttggcagtgagaatatcgaggaggggagggggcggcatgctgcaagactgtcttttgactactccagtaagagagcactctcacccctccggagcccttgtgggtagcttcaaggagggccctaactgtggcatttctctcccagctcctatcttgagaaacctcccagttttccaagagctcatctgctgcctgcagcgctctctcctccacccccacttccttcagggcgtgggggagggtgcagagatgctggaaggcaggggacaggcaaacacgcctgagatgttctgctgcttcccagcctggtgaccttgggagctttcttggcctcagtttcctcagctgtgtcctggcgatgataatgcccatctcatggagtcatgtgggggatttgagcagatgatgtgtgtgaagtacttagtgaggtgccaggtgcgtggctcatgccccacactcattagctactctaacatccttagtcatcaggaaggagagaagtatctagagttatatctagagtatctagaagtctctagaagaaaaagcagccccaagtctgcctcaggaaggagagaatatctagagtatctagaagtctctagaagaaaaagcaaccccaaatctacctcaggaactttctatccagacaatcagggcttcctcacccatggggtttcatttccaagggcctgctccccagagcagcatcatgtgggcctcctgggctttgtctccagtactgggcttccaggagggtagccagataaattcaagagactccatggagcctgtggttcagcccagccttcctagtataccctacatttggaggaatgctggccagatgcaaaggtagatgtagtccatctagtctcaaagctgtggaggcacagatggccttccttgcttggctgccaagcatccagtgtacctgagatgctgtgctgggtgcaaggaaggctgcagtgagaacttcagacagggagttcacctcaaggtgtttacattcatgcgggagaaggtgaaaacatcacatgttgaaaaatgttaaattggccgggcgtggtgactcacgcctgtaatcccagcactttgggaggccgaggcgggcagatcacagagtcaggagatcaagaccatcctggccaacatggtgaaaccccatctccactaaaatataaaaagttagctgggcgttgtggcaggtgcctgtaatcccagctactcgcgaggctgaggcatgagaatcacttgaacctgggaggcggaggttgcagtgagccgagattacgccactgcactccagcctggcgacagagcaaaagtccatctcaaaaaaaaaaaaaaagtttaatcaaggtcttgatatgatctgtgatggaagaacatggttccaggagaaggaggtgtcatgggacagtttgagccaaagagagaatatatgcatcccagtgctgggaaaggtgcctgataggatacagggttgcaggcagaagtgcagggaccagggcctcagggacagagggtctccctgctctaggactcccgtctgccactctgctctgccagtctgtgcttcttcctggggctgtccttgatcctttgcctgcactgggtttttttttt

SEQ ID NO: 17425 - DNA, 25992 bp, Human
  misc_feature (1)...(25992): n = A,T,C or G
agtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacgtctgagcagtgcctcgtgggtctggccagtgtctcatgggtcacctccgtgcagggccacagagcctgcatctgccctcccctgacatgtcgcccccacggccatggggctgcttgttccccacgggggtcctgtcgcctgacttctgggcctttgctcaccctccgcctgagagccctccctgtgccgggctgcccactggctaccccagttcctacagcctccgccagacggccccttatcagagagccttctgtgtcccccaaaaggccaaggcgatgagcccaggagttcgagaccagcctgggcagtgtagtgaaatctcatctctaccaaaaatacaagaattagcagggcgtggtggctcacgcttgtggtctcagctacttgggatactgaggtgagaggatggcttgagcccaggaggttgaagcttcagtgagccgtgatcacaccacagcactccagcctgggcaacagaatgagaccctgtctcaaaacaaaaaccaaaacaggccaaggttggggaagagtagggaacggacgtcagaggcctggccaggctgaaatcgcccatctcccaggcccgcaggctggagggtgtctggggtgacagggtctgacctgtgccttgtagctccctctggtggccagtgctggggaggcactggggatgcggctgcagccagggagcccctgtagtggacggtggagagtggggcgaggaggagagaggccaacccacgggtggtgctgaccagggccccaacaggctaagcccccggggctggggcacagggcttgtccctaccccaggtaggggtgggcaggttgagggcaggaagcccccctcacccatggctgtggcttgtgggaaagacctgctggtagcttcctgccctgacccagccctgtggactgagcagagaaaagcaagtgccttgaggctgcgggctggggtgggaagctgatccctcactcactagcccagggtcaccttcctgctgcaaaggagctgggaggagtggggagctgtggcctcggaggtcttcattcacttgaggatgcgccttctatgtgcgccctgacactggacaccacacagcgctactccaccccattcacaggtggggaaactgagtctgggaagcgccgtcagagccacccatggggtcagcctgtcctctgtcgctctctacaggccacgcggaggaactgccccacctcccggggcgccccagcaggtgccaagccacagccgcagaaccgcctgatcccgaactccctgtgcagagaccagactcgcccgaatatggggagaaaaacgagccgcgtgcagcaggggccgcctcggtcccctgcctgctccgcccacggcgagcgttcctggggcctcgagtttccccccttccgctggctgctcggaatcgcgggacggacccacctggccgccctgcctcccttccaggtgggcaccacctggactccaagtgctggtttacaaagcacacaggagacccttacgggggtgagctggcccctcgccagcgtccgctcggcgcgccccggggacagtgaaggcttggggcgcctctgcagagtcgccagcgcggtgggcgcagccggatgcctctgggagaagagcgcagcgcccgagggtcccccggcctacgaaggctaagccggggtctcggattcgatgtgggcgcgtcgcgtgacgcccggcgaggggcggcccggaggcttcccggcggcggcgcgcgcagggtctcgggcccgggtcggtcccgggcgcggcgcgggcggcgggcgcctcctggcgggcgcggacggagcgcggcgcctttaagcgggggcgggcggggcgcgggcagagtcgctgtcgccgcggccgccggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgtccgctgaatcgcggtgctcggctgagtacggcacccgcgccctctgcagcgcgctcgctggggccgctgtgggcggggggcaagcggcgctcaggactctggctcgagggaggccctggttcccaggacagaaggcaggcctggggggctccattcagctgcgaggctccatggtccttgggcccagcctccctggggtcccggaggagaccctgtcccttccctccgtccacccctcccctgcccttgggccgcggcctgccatagaggttggtcccaggcatctctccgcctcccctcctggcacatccgtgacccttgctcatgctctcgccactgggaatgtccttgtgccagccttggccagcctgaatctctgcacccatttgtcctttggggtcagttctccccgagcctgatccactctgttgcctcctggtccccccacctgctctgggggctgggtctactgtttggagctgtgaaccccggctttcccagcactgcctgggcagccagtggacctgagggtgcaggacacatggctgtcagggacagaagtccttcgtggagcgaggggcttggggatatgggtgtcctgccatacccccagctggccagcttggctccagcctgggaagggaagggacacctcccaggccacaggcctggaccagcttaggtttctgaaggcccttgggattgtccaggccagggctcagagcaggtgggggcctaaggcagacatcctcttgcccagccagggcccgggcgggaccccttgggctgcaccagtccgtgcctgtttatctttcaacatgcactgcaggaaacccaggctgcagtcagctggggtggccatcatcaccatggctggcagaattcccctgggcacctggccttggcggggagcctgggttaggtacatgccctggccaggcacctggagctggctgagtggggtcccatggatcaggcctgcagcccctggcattgagtcactggggacagcagagcagggccaagggaacagggatgtggcatgtggcatgcattagtattagtccccgggggtggttgtcaggaaggtccccactgggcttgggagcagaggctggaatggtggcccctgttccagtggggacaatgctcagggaagggagtgtggcctatgagggcagctggcaagcaggtgggaggtgtgcactgtcctgaccgcaagagtgactcccagctgctggtttgggctgccccccaggacctttttgggtccccaccctacagggctcccagaggcccactgggccacagtggaggtccttagcccatggctggagcaggtggggaactgtttcccccagggaggctgagtccttgccaggcttgtgatgtggggctggggctggctggacactgggcacactcctgctgggtccccactttcctgggaaggatcttggacatcagagctggactcttggggccaagcttggatgacagaggtttgccctgtgtgccatgcgccctgctggggcaggggtgcaccctgggcagagctccaccctgggcagagctcagggtctggagggtgggtgccaaggacctctgtgctgctagcaggctcctccaagctctttgcctcagtttccctgtctgtgagtgtggcctatctcctcttagttagctggacttgggtctacccttgggctacaggctgctcttggtgcagggacagggtcactgtcatgaagtcactgggatggcagatggcagcgccaccctcgggtctcacctgttctccccccgacacagtaggcgggagctacagggaggggtcatgcccagagaaggcatctaggcctccaggcgatgtgaaggcactgggctggtctcgagggacggaggttgggccacctggaggcacctgtgtggggcacccagggcgtgctagacctgtgctgccgcctgtaaccagatgctgctgtggcgcccgccgcctgccagccaggactctcctcctcctcccagtagctcgtgcgaggccgttgctatagcaatgggggaggcagccgggcctgttgctgcagttacagtgcccatagcaggccgggtgtgggcggggctggcgccccgtgctgtgacccctgcctctgacattgcctcactcctgcagccaccctcgccctggtgcctgttggtgcccacagtgccttggcgaaccctgggctccgtcctggctcagggagcgggtggaggctggcacgggctggggcgggcatgggacacccacagcatgatgttcctggccacaaagccctattgtccaagcacagtaaacacagcagccgcccccaccccagggaccggggactcggcccgggccacacagcacactgggggctctgaagggttttgggatggggatgaggacaaaggatgcctccgagctgggtgctcgccctcgggctagggagggcagggcccctctgtcctgtgggtctcagagagggctggtctgccgagggctctctggagggtagctggctcaagctcctcctcctccctgagctgggggctgggacacaagaaccggtaaagtccttggttttcaggtgaagtgagcaaagcacctctttctcactccacgcaggtcccactagggctcaccttggtgcccagcctgggttagcaggagccgacctggggaaactgagctccaaggcccaagactggctgccccgggtcaggagaggggacagggcagaaagaggtgcctttgggccaggtgtggtggctcacgcccaggtgggcggatcacgaggtcaggagatcgacaccatcctggctaacacggtgaaaccccgtctctactaaaaatacaaaaaattagctgggcatggtggcgggcgcctgtagtcccagctactcgagaggctgaggcaagagaatggtgtgaacttgggggacggagcttgcagtgagctgagatcgcaccactgtgctccagcctgggtgacagagtgagactccgtctcaaaaaaaaaaaaaaaaaaaggtgcctttgcttcagggactggggctgttagaccccttaccaggtcttctccgaggctcagggccctgggcgcaggccaagcctctcaaccaggcctcctcatctccccaggccccggtattggtggggaggaagtgggaggaaggtgaacccggggcagtgtgggaagtgtaggcggggctagtggctcagatggtccccaagattttgcccaggtagccctggaggtggggagggagaagatgagctgggatatacatgggtcagagtagaccacaagctggccgatttgtccctgtaggccctgaggctcctcagagggcacgtaggcccagtgtgggctggggacgggaaacctgatttgctgagccagacaatccttaccctcagtgccctggaaggggctcagaccttcagtggttccgaagggcctgtgcccaccttccctggccccagggagcacgtggtcctgtctgggctgggccagccctatgggaggctggggagggcctaggcgagcacaggtctgtcctatccctcactgggcccaccctttccagtgggtcctggccttcgagatcttcatccccctggtgctgttctttatcctgctggggctgcgacagaagaagcccaccatctccgtgaaggaaggtgagtgcggcaggaggccccaggcacagccgggggagcgcggcacctcgcacgcctgcgctgtgtgtgcacatctgcacacgggtgtcctgctcccggagtccctgaggtgcggtgcctgctcccctgtgtggtcctgggccgtgcctcctggctgggctgtggaggtcggggctggcctgtggccgcgaatgatgatgccaacgcctcttcctggtgatgtgggcactcactggtctcctctgttctgttttgatccccctccctccccgcatggtctcttgtcctcggctggcatgcagtctgtaagtgagcggccacctcctcctggctggcctgggcagcagctgcggggggcccatgggccgtcctggcttgagcgccctccccgcttgcattaacagccctcccgggccccctgccggcctcaggaacagctggctccagatggggggtggcaggcagtgaagtgggaggtggtagggagtgaaaggcccggccacctaaaggcacagctggtgcctgggtcaagctgaggcggcatctctctgcctggccttgccttctagggctggggtgcctcggcttctgggctgagtctgggctgaggctgggctggcctgggctggggctggagcggcctggctactctcccttcatactccttcaggctcttgcactcactctgctaaccagctggccagaggtcagaggtcactgcccagagggggtcctttgtcctcccctgggctctgtaggcagtgccacacctgaaacgttttcggggggagagtgccagggcatgtgggcctgcactggctgaaaggaaaggaatgctctgggagttatggcagaaggggtggtgagtggttctttgacctctgacctgctggagtcattcgccccagaacgcttggcctgtagcccagctggggccagggctctgtgccgccttctccctaacgctgcttctccttcctgactttctctaaatttctcttctcggcctctgtctccctccccttctggattcctctctctctctctcccctttcacccccgaccctgccctctcccgtgggtctgccagccttctacacagcggcgcccctgacgtctgccggcatcctgcctgtcatgcaatcgctgtgcccggacggccagcgagacgagttcggcttcctgcagtacgccaactccacgtgagtgcccacccgcccctcggagcacccacccctccccagcccatccagtgagtgacatccgccatggtgcagggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacaggtgtgccctgtgcagggaagttggggggcagggctgcgggcaaagctctgctgtcactgggctgaagcccacatccactctgggcccctccacctgcactgagttcccagccacgcacaggctgcagtggcagagctgtggtgttgggctcggctccgagcgcatgtgggggcaccttgccaaggtgcagcggcctctcagcctcgccttcctgcctgtccagtgtcttccttctctctggactcggtggccagaaacccgcaggagctctggcgtttcctgacgcaaaacttgtcgctgcccaatagcacggcccaagcactcttggccgcccgtgtggacccgcccgaggtaaggcagggacagctcccagccctggccactcccttctgccccagccacgccccctggttgctgagccatcctcaggatgctcagcctgagtcacgcccagaccgtctgaaccttgcccccaccatctgagccacgcccccactctctgagccatgcccccaccatctgagccacgcccccacacgtacatcggagccacgcccccaccatctgagccacgcccccactctctgagccacgcccccaccatctgagccacgcccccacacgtccatcggagccacgcccccaccatctgagccacgccccccacaccccatctgagccacacccccatctgagccattcccccacacctcctaggtctaccacctgctctttggtccctcatctgccctggattcacagtctggcctccacaagggtcaggagccctggagccgcctagggggcaatcccctgttccggatggaggtgagggcatccatgtgtgggatgggcctggagtgctgcctgcctctgggggtgcttctgctccgtgggtgaggaaagggcccctttggtgacttggagctcctcctgggagagggggagggtcccaggggtctatggcaggcatgaggggtagaggcatgtcgtgggacccaggcagccccagagccagccagtgggtggggcagggtgaggcctgaggccctagtggttggggacaaagtccttgccgtggctccacggacccctgtgcccatcccaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcaggtgaggccctgcctgcccactgcccgctgcgctgcttgctgcctgagttgaaggaggggctgggaccgcttggagagctcagggctcctgggcccaggctgtgcgtgggatgctgcctgtgggtgggtatccaatggcaccatggctggtgccccactcctgctcaccatcccagctcctgtcctgggctcccgttacccaggctgcagactccctcccagcacccctagcttgtgtctccctgctgctgtctccctgctccactcctgacctatcacccacctgcagtccatctcaccccgcactgcccacgtgcctgtttcccctcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccggtaggtgggcggcaggggaatgggggtgaggaggacagccaggggcagggcgtgagccctgaatctaggctctggctctggaggtctcatttggcgccctgccctgtgccccgaagtcctgccccatcccgatgcccctcccactctcgcggccctgccccctaacggcctggcccggccccctgtcccctaccccagcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggtgcacgggtctgggacgctccatgtttgacaggcagagtgggagggggtctctgcaggcctgggacccctgggcagagggtgtcggcagaattgacacgggaggggtacggggtgcagcttcggatgggacacaggctctgcaggtgggggaccagggggtcgcttttcccctgggctccaggggagctccaggggctgctgtgggaaggcactggagagcctgctctggcagggtcctccggctgggggtggccggtccagggcagtgctggtggaggaggggtgtgtccagagaccttccagagtgtctcgtgggcgggcagctgggcagtttgggttctgggtgaggggtcctgtctggaacaagcagaggccagggctggacattggcctgggaggggagggcctgtggacgaggccaatcctgggtgtagagggggtccctaggatgagggtgggacagatgagggtggagcattgggtgcttaagggacacatggagacaggtccagcaaaggagctggtgggcacagctgggcagttgggggtccggaggccgtgctgccctgggagtggagggcaaagcaggtttcacctgagcgccgcagaaaggagtggagagcccgggcgtgggactcacgcttgaaatcccagcactttgggaagccatggtgggaggatcgcttgagctcaggagtttgagacaagcccgagcaacatagcggaagcccgtctctaccaaaaatacaaaattagccaggcgtggtggtgggcacctgtaatcccagctacttggagggctgaggcgggaggatcccttgagcctgggaggtggaggctgcagtgagctgggactgcaccactgcactccagcgtgggtgactgagaccctgtctcaggaaaaaaaaaaaaaaaaaggtggggagggttagttgttggcaatggaccagccactggggaggtgagtggggtgagagcccccaagtcggtgggggtccgtccagaaactccatgcccctgcctcaccccctgcaggccaacgagacttttgcttttgtgggcaacgtgactcactatgcccaggtctggctcaacatctcggcggagatccgcagcttcctggagcagggcaggctgcagcaacacctgcgctggctgcagcaggtgccaagggtgcccgcgagggaggcggctgtgggtggtgtggggagcccctctctgcccggctcggcaggcgcaggtccccctctgagccgcccctccaccccaagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcggtggggcctccgagccaacccacgacaccccctgcctcgcacatgcccacggcgggctccagcgatgcccctcccgctaggtgagcgtggacatcttcaagggcttccccgacgaggagagcattgtcaactacaccctcaaccaggcctaccaggacaacgtcactgtttttgccagtgagctgccctccccgccccgccccagccccccacagacctcttcctccccagcccagccccacccgtccccctgtgccctcccactccttggccgcgccctggccttcccccctcacccgccacttgccccttcccacccctgccccttgcaaacgggccnnnnnnnnnnnnnnnnnnnncctcacccgccacttcccctccccacccatgccccttccaaacggccccaacccacaacccgccccctccctgcacctccccacttctgcccacctttcccctggggcccccaccccagccctgtcccacctttccctggaccctcctgtccccgcccccacaccttggccccgcccccgtgccttgctttcccccccaccacgccttggtcccgcccctgcatcttggccccgccccaacctcccggccccaggtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccagggtgaggagcaggcccggaagaccggctggaggattcatgggggaggacaggtgtgaggacgagagggcctgcccggcacctgatggctgcccccacccacagacatgatggagcgcgccatcatcgacacttttgtggggcacgacgtggtggagccaggcagctacgtgcagatgttcccctacccctgctacacacgcgatgagtgagtgctgggcgcccggggctggggctggggctggggctgagtggcgcctgagcgcggcctccccgcagcttcctgtttgtcattgagcacatgatgccgctgtgcatggtgatctcctgggtctactccgtggccatgaccatccagcacatcgtggcggagaaggagcaccggctcaaggaggtgcgcgggccgggactctccctggaggcgcgggctggcagggaggggcggcgtcctccccggggcctgccccaagcccctggcccacccgcaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctggtgagcgcgggccatggtaggagggacctggggcaggcacttgcccagcaagctcaccccacatcctctcagagccccctggaccctggcacgggcctgcccaggaggccgggcgtgcgggtggatgacggtgcgcgtggcccctgcccacccagcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcggtgagggtcgcgggcaggcgggcggctggggtgccgggccaccccacgtgctgacaccactgccttctcagtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggtactggccagcccttggagggcaggggagaggcaggggtccccagccagggttggggaccagcagtctgtgtccactcctggatgcagcacgggtggctccctgggtgggcacgtggcccacgtggtggatggtcaccccaggccctaggtcagcctcccctcccctccccgacccccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttggtgaggctggcatcagaatggtggctggggtgggcgctgggttcagagtcctgggtggccttggcgccgcccccaccctgctgatccacagccctggtgcagaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtgagtgtcggaggggcagggcggtgggcatctgctgaccagagcaggagtcctagtcagggcagggtggggcccctgcagagggcgtggggtcgtgaccccgcccacctacccaggtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagtgggtgggctgggcggggggcggggcaggtgggcggaggccctggggctctgcatagcagcagccccatgccccacctccctgtcccaggatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggtgagtggggtgccgtgtgggcaggggtgcgggcggcgcctcccctgccccctgaccctgggtctggccttgtcctaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaaggtctgtgttgaagctgcctgagctggcttcgggccaccttctccccgggacccccacctgagaatccacaatggagaggctgggccctcaccgtcacccgctgggcccaggatgcctgctggggcctggcccgccctctgcaacgcccgtatcttggagaggctgggtcctcagcgtcaccccctgggcccaggatacctgctggggcctggttcttcctctccaatgcccatatcttgacccagttgggttcccattgggggtccctcctcccagcccctgagtgaattccttcctgctcccacgtcccccacagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccaggtgtgagggcgcacgggtcggggggcagttgcaggtggtggaggtgggcgcactcctgcctgggcgtccctgccgcagcctccccctccaccgcccctgcagcacctggagcgcagcctggatgcactgcacctcagcagcttcgggctgatggacacgaccctggaggaagtgttcctcaaggtgtcggaggaggatcagtcgctggagaacagtgaggccggtgaggggcctggaccacttgctcagcccaccccacccacaaggccccagctcgggcctgcgctgtcactcctgcctggtgtctgggggcgccaccctggtcctgggtggaagccaggggacgccccagggttagcctgcggtcctaggtgggtggtcctggtggccagaggtcccggacaggtgtatgagcctgggaactggggtcaagaccggggatgggggtcctgggcaggcctaggggccagtagccctgagtgtcccctcggcccttccactgcggcagatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaaggtgggggtggcagggtgaggctgggacagcaagggagggggagcagggttgcgggggagcggcatgagggcagccagtagggagagggtagcgtgcaaccacctgctcagcctctacctctctgcacagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtaggccaccggctggacgggggtgctgggcttgcctccccccaccgcccgctgggagccctgatgatgcccactcctgagcttcctgactctgggcctcaccccacacctgaggctgggcacgcaccggggttcatccgggagccctgtctcctcgggtcccagaccccaggcgtggatcccttggggttgggggaaggggaccgaggcttgggggccgctggccagagggcagaacctgctcaggcctccctgctcgccctgccaggtgatctgcccccgctggtcctgtcaccttcccagtaccacaactacacccagccccgtggcaatttcatcccctacgccaacgaggagcgccgcgagtaccggtgaggcatccagcgggggcatccttggtgggtggggcgagtgaaggggcggggacagccttggtgggccaggcgggcgagggggcggggctggcgaggggcggagaactggcagccccacctcacactgtcggtgcccgcaggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccaggtagtggttcagggggcctgctgggggggcaggggcagtgaggggtccttctcaccgcaccatgctgtgcccacagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtgagctgggtggggaggctgtgggtgagggtggccggccaccagccacctagtctcaactcctgcccctctagcctcactgcctgcctagcctcaccgcccctcccacctgcctgcccaggtatggggccatcacctttggaaacgtcctgaagtccatcccagcctcatttggcaccagggccccacccatggtgcggaagatcgcggtgcgcagggctgcccaggtgagcgaggctgcgggcctgggccccgctgtgtgtagcgccgcccgaggtctgcagggacccaggtctgaggtcctggggcctttctgtgtcctcttccttctgcaggttttctacaacaacaagggctatcacagcatgcccacctacctcaacagcctcaacaacgccatcctgcgtgccaacctgcccaagagcaagggcaacccggcggcttacggtgagctgacataggcagggcggggcggggtggggaggagctggggccggggcggggaggagctggggcctgaatctgccgcccccgccccgccgtgtgcaggcatcaccgtcaccaaccaccccatgaataagaccagcgccagcctctccctggattacctgtaagtgtggccagtgggggatgaggtggggcaggtgggcgctgcagccccggccgtgaggactgagggcttccttgccccaggctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatggtgcgcccggcgtggccatggggtgccccggcccttctcatcccccatccccgccctgccccgggtctctcaccagccgcccccacccctgcagctcaactacctggtccccgctacctgctgtgtcatcatcctgtttgtgttcgacctgccggcctacacgtcgcccaccaacttccctgccgtcctctccctcttcctgctctatgggtaagcggaagcggaggggggagcggcctcaggtgggaccggggctgcctggtgaccactgcccgccacctgcccgcaggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggtggggcggtgacgacatggtgggggtggcggaccctgcggaggctgtgcccctcaccccggccacccctgtgcccctgaccccggccaccccgcaggacctgaaggttgtcaacagttacctgaaaagctgcttcctcattttccccaactacaacctgggccacgggctcatggagatggcctacaacgagtacatcaacgagtactacgccaagattggtgagggggcccgtggggcggggaaggcggtgggggccccgcaaggcccagagcacaggccctgagctgtctccccgcaggccagtttgacaagatgaagtccccgttcgagtgggacattgtcacccgcggactggtggccatggcggttgagggcgtcgtgggcttcctcctgaccatcatgtgccagtacaacttcctgcggcggccacagtgagtggggggcggggtggggcgggggcggggcgggagcagggatgggttcgggggtggggcagggtaggggcgggggtgggggcagggatggggcaggagggggtgaggcaggggacagcagaagggcctgcccacccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggggtggggccagaggggcagggtgggggcaggatgccccgctgagtgggcaggctcctggccaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacaggtggggcgggagccctgggtgggcggggccgccgcgtcctcacgcgctgacagctgccgtgtccccagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtgaggatctgtggggcggggcagggagtcagcacgctgggtggccctgcctccactgacacctgcgttccctggccaggtggtgaagtgggctctggagaagctggagctgaccaagtacgcagacaagccggctggcacctacagcggcggcaacaagcggaagctctccacggccatcgccctcattgggtacccagccttcatcttcctggtaagtcctgggtgggtggggggtggctgcctggcctttgacttcctggtgagcacgggcaggggcagcgttcaggctggggtgtgtgggcctggcagcagctgagcctgccacccatccccaggacgagcccaccacaggcatggaccccaaggcccggcgcttcctctggaacctcatcctcgacctcatcaagacagggcgttcagtggtgctgacatcacacaggtgagggcgcccccaccccctctttgtgcccccaccccacagcaccccttccggtgccagcctgtgcatgtcccacagcatggaggagtgcgaggcgctgtgcacgcggctggccatcatggtgaacggtcgcctgcggtgcctgggcagcatccagcacctgaagaaccggtgagccggggcagggccaggggtgggctggggcgggcccggggggggcggccaggcagcggggccaggagtgggggtggctgcagggctgtgagggctgtggggccaggggggctgggggcactggggctggggggactggggcagtggggccaggggaggagcctggagggctgtgggggctgtggggttggggggctgtgggaggctatggggcttcctggggtgcctgtgggggctgtagggctgggaggctggggggctggggctctggctgggcggcgcagggctccgggccaccggcctgtcccaccaggtttggagatggctacatgatcacggtgcggaccaagagcagccagagtgtgaaggacgtggtgcggttcttcaaccgcaacttcccggaagccatgctcaaggtgcgccgtcccgggcagggttgtggagggggcgctacggggtggggggggcgctgccaggcctctgacctccccccctgcaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgagcgccccaagggcactgcgcaccacacctgcccctcccctcacccgccctgcccctcctcaccccagaccagccccctccccacacgcctgcgccacccaccaggtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggtgagcaggctgctctcatggctgtccagggctctgcccactggacccaggctgcctggtggctccagccccgggtggggtggggggagaactggccccaggatgcttgctgtccagaggtcaagggggcagagtgggcgagggacacttgcagacaggcctggagagacgtaactgcatggtccagacttgctagagtctttgaggggcacagagcaagggtggggcagaggggaccagagccggggaacaggggaccgatgtagactcagtggcccccagactcggcagacggaggcccgggagagcccagacacagagggagctcgtggggagaccctgcgtccaggcccagcctgcaggagggccggggcgggccagcacaagtgtcctcagccccagcagggggtggcacaggatgccccataagcctgacctcccctgtgcacaggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtctgcgggtctgcgtgtgtgggttgggaagggtggggaggatgggcgcatcaggtgggttagcgctccagaaggccctgcccctcaggcacaggtgctggcagggggtggctgggtcggtctggaggagggaaactgaggcagggtggttcaccatggttcactgtccccctcatcccaccctcaggggttgctcccggcccccttccccttagccttcatcttcccgtccacctgccctctctaagcctccttcaccccttgctgcccacgtggggcctgcagcagcctgggctaggctgtctccgtgtcatggaagggacagcgagggcttccaggaagaggcgacctccaggaggagaccgaagtctgtgaagattccttaagggaagggcatcccagccagagggcagggcacaggccaaggccccagggaggcaggacctggaagctttgaggctcatcagcggtggagcctggcacactgtgggcaggagatgggggaggggcatgaatggcccccagagctcacgccccgtgatctgggccaagttcagactcttgccttaggccgtttcaaggctcctcaggagggtagagggtggactcactgagggctggtgccacatgggggacaacaggggaggggcccatgggcttgagggcactgggtgggctgggccaacacatccacttgggttcctatgaggcactcactgtgaccacctgagaggcagtgggatgaccatgctggagtccctgagaggctgggtcactggggtgaagctgtcctgggccctgggggcggttcactctggaagaaccgagaggaacagtggctcactggaggggctggtgtgggtttggtggtcggccaagggaaatgcgtgggggagccgccagaaggcaggaggccgcagcagcctccgtcctgcaactgtaggggctgaatcatggcagaaagaggtcgagaaaggaacacggcccagccgaggcccagggagaccctgcgcgcaggaccaggccaggctggacctggacagccgcccacagactgacacagttcacgggggcatcgtccctagaggtttcattttcatgatgtgtaatgcagcattgaaagcaaacacaccccccagcatcttcctcagaacattttccgccgagcacggtggctcacgcctgtaatcccagcacttcgggaggccgaggcaggtggatcatctgaggtcaggagttcgagaccagcctggccaacatggtgaaaccccatctctactaaaactacaaaaattagctgggtgtggtggtgggcgcctgtattcccagctgctcgggaggctgaggcagaagaatcacttgaacctggcaggtagaggctgcagtgagccaagatcgtgccattgcactccagcctggatgacagagtgagactctgtctcaaaacaacagcaaaaagaacattttaaactttcaggaaagttgcgagaatagcagagcgcacgccgcatcttcagccgatgcgcctgtgaaatcttgccacacgcaccgtcgctctacccacttttgtgctgccccatgtgaaagcaagcagctgtgacctgccagccccggccctgcagcctccttcccccaagagccgccagggtagcccagagttaacaaggggtacagcaaggcttttcagggccccggtggcccaggcatgcccttttttattttttattattatttgtttgaggagacggagtctcactctcttgcccaggctggagtggggcacaatctcggctcactgcaagctccgcctcccgggttcacaccattctcctgcctcagcctcctgcgtagctaggactacaggcgcgcatcaccatgcccggctgatttttgtgtgtgtgtgtgtgtttttagtagagatgaggtttcaccatgttggccaggctggtctctaactcctgacctcaggtgattgccccagcctcagccttccaaagtgctggg

SEQ ID NO: 17426 - DNA, 9714 bp, Human
  misc_feature (1)...(9714): n = A,T,C or G
atccttgctgtggcctgtgcccccaccttcccgctgttctagccgcacgggcctgcccttggtcctgagggtggacaccatccctccctactgccttctgctctggagccaggcctggggcactggctgctgccctggtgtgccgtggcagcctagagtagctgcaggatggctggcccgagggaatgttcctgggcccttgagtcttctctggccagcagagttccccaaaaccatcacatccagatctgcgttggtgaccaaggccagactgaaggttgggtcctggtacagtgagcctgggggtgagggtagaggtcagggaggtggcggagagtgggtggcagccagccaggcggcttcctagggggcagtcagtgctggtagagactggcgggagggcaggcccacatcaggaggtggcacaggggtgggagatgagatcaggaccaggacccataggcaggaatcttgcacagaacctggctgtggagctgagccatgcaatggcacagggcaccttgcccttctcacctgggactgagtgtcctgcacctccaaaaggcatcctgcagccccagccaggccctgcagcccctccccaagccagttttctccaggatgggaaggcctggtcttgcccactcgcctcctcaccttcctgggaagtgagcttagacactgtctctatgctcagtgccctggcgaggagggtggtggttcttattctgctcttccctcccctcttcaccatttttttttaaagtcatttgataaacctgagggcagccagccccagctttggagttctgagactggaaggaccaaggggacaccccgggttggaggtctcactcttgttctctgaatgactagtcaaaggaggtttctagtgggatggggtgggcgtgctcttgggaggcaacaggtgaggtgcaaggggggcatcagagatgcccgttgtcagctgggcacagtggctcacgcctgtaatcccagcactttgggaggctgaggctggcgtatcacctgaggtcaggagttcaagaccagctgaggcaacatggtgaaaccccgtctgtactaagaatacaaaaattagcccagcatggtggcacgcgcctgtaatcccagctactcaggaggcagaggcacgagaatcacttgaacccgagaggtggaggttgcagtgggccgaaatggcaccactgcactccaggctaggcgacagagacgctgtctcaaagaaaaaaaaaaaagatgcccattgtcctgagggagctaaagggctgtcacctggggaccctgaacaccttggacagctcccagctccggtcctcagtggctccggatcactcttgccccctggtggcctcactgagcgcggccgccgcggctccagccaaagctgcagtcggggccggggccgttctgtgttcctgtatttgcttttcccgcgagtgggggtgcccctgcctctgtgggcacacctgtgccttcctgtgcacctgcccagctcgtgagcacctgtctgcgtgcgcccggcgctcctgtgtctctgtgcgctcgcgaggctaggcccacacaggtcctctgccccatcgcgggtgcgggtgaggggctcggagtcctaccgggaagaggccagaagggagcgcatcctggagaagcccacccgcggcccaaacccagccggacttctgggaaccgcaccggccccagagaccgcaggtgccgagacaccctgaggccgagagaggtccagcgaggcccggagaggggaccagaactggagcagggggagggggcgcagtctggagccgccctcccgccccctcaggtggagcgcgcaggcgcagtctccgcgtgcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccgggtgagcgagcgcgctgggcgcaggccgcggggcgccccggggccgggatcgccgggcggggaccgggttgccgggcgccgccgccctcgtcctgcccaggcccgcaggccctgcaggcctggtccgctggtggcgggggccccgcctcgcccacgatggaataaacaggcctggccggagggcgcagcgcggagcctccaaaaggccgcgccggatggggcttctgccggttcccagaggcgtaccttacattcatggcttcttccgccgggagcgcgtctggctcaggcctccgcgccgcggccatctggctctgggcgggcccgccgggagtctgcctgtgtgcgtctctgtgtctccgtgttcggggctcctgcgggtgtggggctggccctgagtgcccgccggcttcgctgccggtgcgcgtcccggggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcgggtgccagtcctcagttcaccggcctctgcagcttcgtgtctgcctcaccgggagacctggcagggccctccctaggcaactcctcccattcccagtgcccagtgcttggaagggagggccctcaggcagcccagacgttggcgggtggaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcgtggtggacggtggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaagccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggtgaggctcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagctactcaggaggctgaggcaggagaattgctttaacccgggaggcggagcttgcagtgagccgattcaccactgcactccagcctgggcgacagtgcgagactctgtctcaaaaaaaaaaaaaaaaaaagaaggccgggagcagtggctcacgcctgtaatcccagcactttgggaggccgaggcgggcacatcataaggtcaggagatcgagaccatcctggctaacacggtgaaaccccatctgtactaaaaatacaaaaacaaaattagccgggcgtggcggcgggcgcctgtagtcccagctactcgggaagctaaggcaggagaatggcgtgaacccgggaggcagagcttgcagtgagccgagatcgcgccactgcactccagcctgggcggcagagcgagactccgcctcaaaaaaaaaaaagcagcagcctgcagcctcaatgcccaggcctgtgccaggtggtcttggggcccctggaccttgtggggtgttgggtccaaggcctgggagatcctcattcactctccacgaagcctcccatcctttccaaatggaggtgggcccaggcctggggcagtcaggccctcccaggagaagggctgcacgatgtgaaatgctgggatggccacgggagaggaagggcccattctccccgggcctgggctctgcagggtctgcccagaagccctccaggcccccacttccccgtccccaggcagcttgctcttttccaccactcactgtcctgtccgcctgttggcaaatgttgaagggtgccagcactggctgggtgctggggatgccccgctcgccagcctgagccgcatctgtcgggatggccagtcactgagtgacttcaggtgtggtgagggctttgctcagaggtgctgggggtgggagcagcagcggcttcctggaggaggtgttgagaggagcaccgagaagtggctgtaagggtctgtgtggatgcacctcctgccaacctgggagcgtccacccagactgtgcagcccacagtgggtaccggtggagccctgccaccagccccacccctgacagctgcccccgttctcccaatgacctggggaggggtcccgggtgcttggcttccttcggcttccccccactccttggggagtccctgcccctctacccgagaaggtgcttggaggtggggaagcagaaggggctgtgctggccagccctttatggacatgggttggggcgagagaccccactccttcctccccgtgcccggtctttggacgtttccctagcacctcctcccttgccctgcctccactttccgggaagcactgcccctcacaggaagcgcccgcgctgtcaccatggcaatctgggagggagagggcctccaggcgtgtacccagtcctcaggctcctgggaggaacctgccagaagcggggaggccgggcctggggctacctcctggacggacccctccacctgatggcccctcaccctccccaggcgggggccggccccagcccagactggaagatgagattgacttcctggcccaggagcttgcccggaaggagtctggacactcaactccgcccctacccaaggaccgacagcggctcccggagcctggtgagacccccgcttcccctgccccacggccctgtccctagcccagtgctctcattctaacctgtcctctctcgcagccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttggtaggtcttggtcgggggtgggcaggggcagcagggcgccctgcagaaggccgccctcacacgccccctcctgcagtgctgatcctggcgttctgtgtggccggtgcagccgccctctccgtagcctccctctgctggtgcaggtgagccagtggccgcgggcagggcagggagggtgccacacgctcagaggtctcaggccccactccccacaggctgcagcgtgagatccgcctgactcagaaggccgactacgccactgcgaaggcccctggctcacctgcagctccccggatctcggtgtgtggcccccttcagccctgaggctcccgcccaactctggccgccaactgaccctcgcctcctccttcccacagcctggggaccagcggctggcacagagcgcggagatgtaccactaccagcaccaacggcaacagatgctgtgcctggagcggtgagtggccgccccggcacttgccacccacatccacccacctggctctgcatatctggtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17427 - DNA, 19677 bp, Human
ctggcagtctttcaggcctgggtttacgttttcagagatggggcagtggaggcggaggctgggctgaagcttgggataaagcttcccccattctccatcccaaggggccgcctgcaactctgtggttgcttggatggacattccctctagcctctggaagaaggcgaccggcagctctcagagccacatcctagctgtccagctgtccggtcaccacaggctgggctgggagattcggcaggtggtgggaaaggcctccgagctgtgtttgccctggctggggcccaggcctagcaacaacaaacagtcagcccctcccccagcctggccacaactggtctgacccagggaccccacatcataccctcctctgggcctcccacagcagcccagcccagtcagcccctgcttcctccagtctagattgaggaccccaacacccatatcccaggtgaccttgagccagccctggcccctcaagaactgccagtgggagccaccagccctttgcagatagctcctgtgagcatccagggtgtctgcaagtgggaggttgaggggtgggaggcaggcctgagaccctcgtcagcacctcttctatatggctgtcccatggcagaaccatgcccatttggagggtgggagtcaaagtgagctctgatctaaggatgatatcagccccagaccaggagtgaaaggcagccctttcccattttccagccaccagcaaggcagaagttcgagtggcttgaggttttcaggggttgccaccatcccaatgcctttctctctagccctgccagccagagctgagtcccctgcccggtctcacagcttcccctccactcattcccctcaggagaaaagacagccatttccatgtcacagagggaaaccaaggtacgccagggcttggctgtggtggttctgtgagtcagcaggagaaaatcctggagtcctgactcccagcccagggcaggggagggtcgggtatgtcctctcagggcattccccccgcactgggaagtggggcaggcatgacacagagaagaccagcttgaataggaacagcagaggccatgagattaatcggatcagagccagtgactgagaagcaaggggcacagctgttctgagaacccccccacttcaccccgaaggtcagcatctcccccagcttcctactggtggaacctgggaccttaacacccaccacccgtctctgagcaccaagggcctgtgtggaaagcaggcaggggtgggataaggagcccccagccaagaacggggccatcctaaaacccctgtctgtccccaggacaccaagtcccagcccccttcttgtggacaggctgacagctgtctcctacaccttctaaataaggacgggggtcatggtcggggggccccaggtgaggctcaagcaagccaagccttactccttgcctgacctcactgcccctgccctctgtgttccagcctcagcctcctctgaatatctggggtggagacagaattgatataagaagccctcccaccctcgcccccaccccacccctggttgggaagggggaggcaggtagaagaggtattttgttgcctgagtgtcgcctgaaagtcccccattcaagcatctctcactgaggctatgcattgccagtcctcttggcggaagctccccttctggctttggggggtgtgggcaaagcatttcaggggttaatgtgacacccacagacctcagagagaatctgctttggactgaagcattccccccacaagactcaacggagtccctctggcagctctgctctcccacctaggggctccctaacgctcaggccgcccctttgctcccggcctgccccggcccccgccattcccccgaccagcccctcctcccgcgggccgccagggattggcgggcggggggcgggccgggggcggggccgggcgcccttcatcccgcgtcgctgttgtcgctgttgcagccgagttcagccgggagcagagcgaaccgcaccggcccgagcggagcgccgcacgttcccaaccgcgaggccaggtaccgcttcgggagttcatccacccgcacaggggaatcgggtgggccgagccctactgtccaccctcctgtccgtagccgggctctgggcagctctcctctaccgtcctgacccgggcaggcgccccagcctccggcgagccaaagccccgcgcgctccaggcgctggtcttggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaaccaagacttggtttgcaagagcccgcccccgcccggttggccccttcgattggccacagcaaatgcgtgcgtttgtttacacccaggcagggggaggccaggggagggacctgcggggacccgcccttttccccccacggggacctgagtcctgagtccaggtatgggctctcaaacaggtctgagaaaggctaagtcaaaggctcttgagccctgaggaacaccatggaggacttccccactcatgcccatccttccttcagcctgccaaccctgtcctttcttccatgaccgactctggccacagagctgcccctggaaaaggcccttggacctttcaccccttcctgttctgttctgtaaaaggtctgggatggggctcatttccttctggaaaggaagcacatccctcggggctctcagtctgggggatagaaagctaaagagacccaaagatggttccattttgaatgggggaaattcggcacagccacggtacccttcctgcaagaagcatcactgacgggagggatcaggactggaagaggccaagcctggcacgtctctgagagggctggaatgactgaaaccagaaatgggaatctgatttcttgacattgggagcagggggctgaatctctggggagggtaggagtctgtatctcagaattttgttctgcctgggcccatgggacccatgtcttcgctggcttctcaagccactccttgttgtgtgctggtttttttggcccatgtcacaaatggtccccacaccagtccagggctccaggttgccagatcatgacaactggttgctcctgtccttgtgccactgccctagcaagtagccttgaagccctggacagttggagaaactgaggcacaacaagactggctgggtggttcatggtctctgggttgagtcagagaaggattttaagctgaactggacacaccctggaagtctgggctgggtgtgaggacaagcatccagtttgagagggaaacatatttggaggggagtggtgtggggtgggccaccagggaggtgcagttttggtgtctctgtgaacagaaagctgaggtggaatgtgcagtctatgctatagtagaattgggacccagtgggaggatgttttagtgtagacatggccaggggccaggcctcacttggagcaggtaagagggcttgccgagggcctcaaatgcattccattcgtttattttttttatttttttcattttttgaggtggggtctcactctgttgcccaagctggagtgcagtggcacaatctcgcctcactgcaaccgccgcctcccaggcccaagcaattctcccacctcagccttctgagtagccaggaccgcaagtgtgcaacatcaagcctgggtaattttttttgtatttttggtagagacagggtttcatcatgttgtccagactggtctcggactcctgacctcaagcagtctgcctgccttggcctcccaaagtgctggaattacaagtctaagccaccgcgcccggccattccattcatttaacatttgctgagcacctactgtgtgcccggggtacactcttgtctagtgggtgaagggtaggcctttgactctgggtggtaggacagacataggagaacagggtggggctctagaggaccaggcggggcttctgggggccaaagggaaggaccagctgctgggcaggaggggctttccggccagtggcctggggtggcttggttttgaatttccgctctgcgggccacgtcctgtacacagcctctcagccagcacgtctgcacacgtgcatggctgctgggaatgggggtcactccgactgaccatcatctccacatgtattttccattgctcaggtagacaagtcctgggtgctggaccagggatatctgagctttccagttgggcctggccttgtggccctagtgggctcagccccagcctctgggtgtcatagcacctggttggtaggggcataacctgctctgtggggacctggaggtgcagcagcctttttgtggggtcctccagggttctgcctggccatcttggcagtgcccattgggcctactgccccctcagctgggccccctggctccctctccccttctcgctctttctggggctctctttttcttcagctttctctcttttttttttttttttttgagatagggtctcgctgtgttacccaggctggagtgcagcggcgtgatcttggttcactgtagcctctgcctcccaggttcaagcagttctcctgcctcagcctcccgagtagctgggattacaggcacctgccaccatgcctggataatttttgtatttttagtagagatggggtttcaccatgttggccaggctggtctcaaactcctgggctcaggtgatctgcccgcctcggcctcccaaagtgctgggattacaggcgtgagccaccatgcccggccttacagctgtctcttgctgtcttgttgtctgtctcttcctccatttggctgtctctgactgggtgctcactctgtttctcacctccctggttgtttctgtcgctgtctgtctcctgtctaaatgtctgtccgctatctgcatgtggtttttgtctgtgtgtttttctgtctgtgtccctctgtgtgcatctgcatttccctgtcaccctgggccgctgcatctctgtctgtctgtctctgtgtgtggatcagtatgcatggacgcatggagctaatgactgtgttttctctccctgctctgtccctgtctatctctcttccctccctctgccttttcttcctgatgttggatgtctcccctcctccaggccgaccttgactttagccccccatcggactctctgatgagtcctgaactgcccgaggcctgtgcttcagcttgctttggggccagaagtccggctgtctaaatatttggccgcctccaggggattccgggtcagcagggaggagaatgggctggctggcgcagggtctcccctgcccctggggggccacagtcacgtgatgtcctgtcctttgcctcagctgggcctccggctgcacgtccttctcagcaggctggcaatgggtgaggtgggggctgctgttgctctagcccactcgtgaaccaagagcttctgactgcaacctctatgggtggcagcctgagcaaggagggtccagggctgggtgggaagggaggctgaggtgcctaaggttaggcccagctacaagcatctgttagaaaacgtacctggccatggccgggcgcagtggctcaagcctgtaatcccagcactttgggaggccaaggtgggtggatcacgaggtcaggagatcgagaccatcctggctaacatggtgaaaccccgtctctactaaaaaatacaaaaaattagctgggcgtggtggcgggcgcctgtagtcccagctactcgggaagctgaggcaggagaaaggtgtgaacccaggaggcggaggttgcagtgagccgagatcacgccactgcactccagcctgggtgacagagcaagactccgtctcaaaaaaaaaaaacaagaaaaaaaaagaaaatgtacccggccacaggaaagtctaccttccggccccagctgggtctctcagatcctcctagacacctccggatgcccagaacacagagccacagaccctagatcccaaggccagggagctgggggctgaggattaacatggccggtagttcagttctctgggccatctgccttcccctggatatgcccccgcctgcatgtcacttcttcagtattagcccagtgttggccacacactggccacttgcactgttgtgttgttgatgaggaggacatgaaaacatgggtctagaggagggtaagaggtgtcttttccctgttctaacaccctcctcccacctgctttgtccctagacccctgaccccagcaatcagctaccaccaattcctatggctgtgccttgagaacatgcagtccaaatgtctccattggatctggtttccccccttactaacaccttctcctagtagggggcatcttccctctgaagcctggaggagcaggtggacagaggggtagctgtccagatgggtaccagacttaggaggggggcaccctgtctcagccaaggaggggagtggtaaaaatgagctgagctggaactgggggcagccctcacccctgagcccccagggataatcacgatggaccctcaagccaggccagctgtctctctcctgagatcttggcggaggtcaggtagcctgggcctcagcaataagctccagagggtctgtgcctccactggtgcaagtcgtcaccaaggtaaaaagagtgcgaaggcctccctgtcaccagctcactactgccgacccagacccacttatgttcctgagcatggggaaggaaagcaaggctcagagtcctggggactccaaggaccttgatccctgggcagagagctgtgcttcctgtagctgcttgcatcagccgccctgaagtggcctgggttcctggggctcaaaatctttaattagccaaactcaacacctgccgaggtgtgcctgatgaattctcaccaggtgatgttcgcgtgggcgggcgttacctgctgcgccatccctgtggctcctggcccctcctggcccttatctcccaggaaaacaaacaggtcccagggcaatggcctgggccattgatttactgcccgggttcacactacatccatgacagatgccattctgatgacctgcccaaggccaccgtgatctccccaccctagctcctggccactctctgggcacccatggactgttctggggatgaaggctttggggaggctcctcactcatccccagctttgaccaagcctcacgggacccctagaggacagggatacactgaggtcctgagctggggagtaccctgcccctggccacacagtgaggcagggccaagcccagccctagagggtctactctgggctttcaccacaggggatcaggctctgctggcagcctttcttatgcaggagcccttccctgagtttaccccgattccgattcccggatacaaaggagcctgggaggccacaggcctgaggggtaggagctgtcaaaaatgggctggcagcctcagggaatggctgggggctccatgccaggccagtgctaatcctcaccctggcccccagcccccagccctcctccctgccctggaccaaagtccagactcctagacctggcctttacagctgtatcaggtttgtctgttgccacagaaccttccttcaacgcttacagcttgcctcgtactgcacctcagggcctctgcctatgctgtgctctctgcctggtacactctttcctgtttgacaccccagggtgcctactggaattttagtactggcttcgccacctcctccaggaagtcttccttgatgcccccatcctttttttttttttttttttttttttttctttttttttgagatggagtttggctcttgttgcccaggctggagtgcaatggcgcaatctcagctcactgcaacctccacctcctgggttcaagcaattctcctgcctcagcctcctgcgtagctgggattacaggcatgcgccaccagcccggctaattttgtatttttagtagagatggggtttttccatgttggtcaggctagtctcaaactcctgacctcaggtgatcctgctctcctcggcctcccaaagtgctggtattacaggcgtgagccactgcgcccggcacccccatcctcttttttgagacccagcattatgtggctcacactcagttgcagcaggagctatagagtagtgatgagggtgctatctggggggatttgtctcttccaggctggaggtcacttaaggagagatattctaaatcctttctgggatctcaggcctgcccaagacccagcaatgactgatcatgattgagtaatagctaccaggccccaaaggtctaggcccagctactgcaggggggatggggaatctggagctcagacctcagacacctcccacggcccatgccacagactgtggtctccctggaggcagtgcctggctgctacagaaggatattagggcagagaagggtgttttgtccagactgccagctcagcacactctgagggcctgtcccagcctgcccagggcagggggccgagagagggcacccccagctgagtgcaggggggactctggagtagctctggacgccagcactggcacctctatacccaggtgggacacttggagggatgctgatggcaaggcttagggcaggggcatgaggacatgtggacctaggcaaccctggggtcaggggagaaggctcaataagagatgctaacattgttatagtcccgagtaggtgggtctgggaggagaggaggtaagatgcttgcatcagaaggagaggcaggtttgagggatgcaagagtgccatgtgtggggtctccaggatccaggtgccagaatctgaactctggcctggggctgcctggggcagtgcagggagggagtcctctgaccagagaggccagaggctgctgtgacctctgctgcctccaggggcaccaggcctgaggcctgagcccagcctctcttgttcacccctagccctgagtgctacgtttgagttccccagtgctccagattcaagggcagacctgagaccatcaggggccggagtggggatggggggttcagggcagaattcagggttctccatcagagagggcaccacggattcaggaccaggttctggctgtcctgcctggcagggctgcccccctcactggtctccactctggcctcagctctcctcctggccaggctggccttcagggtgtccttacagaacctgggggcactatgcccagccacctctggttatgaggtaggcaattcctggacccagtgatgggagagaggggccagtgagttgtctgggcagcgggcaggggtggtggaggaaggagagctggttcctttgaggcccagcagggccaagccctgagagcagagaagggagactgatctggtgacccaggctcctctacagccggccaagggcctgagctcctggcctggggccctaggaaatgggggtctgttcaaagggtccactcctggacagcgggcccctgagggttgggggttccctgcctggcagtggaggagaggcttggaaaaaaacatggccctgaggccaggactgtgtggagggtgaggtgtgtgtggcacagagaactggccctggagcacccgtttcctggaaggccccctgagggccctttgctgcagccaggcgggaagggcccaggtgtccagccacccagcaccgcctcaggcatcctggctctggggaggggggacagcctctgcgcctgccgttcccagcgccagctctcagcccacagagggctctttgttctggctgccagcagtgcccgccgggcggctgggaacagggcccacagccctcaccctctcccgaggcctccagccgtcgggcagtgccattctaggttgggcaggaggcccctggacacagggccagtgcaggaaaccatctcccactattgatgtcaaggaggagaagtctgtcctgggtacatacccagagtgaagtctgggggcctgggactgagcatctggggatgctggtgccactgggctctgaactcgggtcatccagatgaccgtcacttcacagatggtgaaaccgagaccctaagggcttgcctggacgggtgtgcatgtaagaagtgcattatgtactggctagggtgtcccatcagaacgtcctaggaactcaggtgtctgagctggattcccccaacagcagatcccagggaggcagtaggcagagctgcatgtgtggatatgccccgagtgaccatctgggaggtgtgctatggctgcaggcctcaggtaggaggctaggccgtaggcccaagtaacggggctaaccagagggaccggctgctctgcagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagaggtgagtaccagagggacccagtggtggctgaagacagggcagggcagggatacagagcaaagggctggagctgagccacccaccctgacctgtgcctacagggtcgaggaccctgcacggagctgtatggagggcaagagcttcctacagaaaagtcccagcaaggagccacacttcactgacgtgagcagggcagcaacgggttttaggggacactgtggggagcttggatgcagtaatgaggtggtctctggcagcagtgggaggctgagggacagtcaggggaaggctgcgatgcccctgtcccttgctgactcctcccaccctccccgtcccattctggtgcctgcagttcgaggggaagacatcattcgggatgtcagtgttcaacctcagcaatgccatcatgggcagcggcatcctgggactcgcctatgccatggccaatacgggcattatccttttcctgtgagtgccctcagagaaacttctaaagataggggccctaagcaagccaccaatcatgacctcccaggacccgccagttccctgtcccagcatccaggctgcagtgggtgggcacttcttacactaacaaaccgcggctgaaaaaaacatccacagccaaacaaatatacctcactgcccagtaaaccgactgaggtcacaacacaggccggtcttacaggccagagactgtccttttggcaccttacacgtgatggccaagccccacggccaggccttgtgtgggcacacgtgtcctttggctgggggctctgccctgaagccagaatggaaaacatgtttgtttcaaggactcaagaggaggacgtgctcagagggcagtcacagggacactcttgacccagagggccccttctggggtgtgtcgcaccctggatcaaagggggtggtgttcatcacccctggggcctgctgagctggcatccatacctgttgggagtccagacacccaggtcacagaccctccacccccaggcctcccagagcccctcaccctctgccagccacggtagccccccagtggcctctttttcttccatcttcccatgtgtccccaggttcctgttgacagctgtcgccttgctctccagctactccatccacctgctactcaagtcctcaggggtcgtgggtgagcctcacaccagcctggaatgggcgggagctggtgggtaaactgggacaagctcctgacttcttgaccctgctcctgcaggcatccgtgcctatgagcagctgggctaccgtgcctttgggaccccaggaaagctggcagcagccctggccatcacgctccagaacatcggaggtaagagcagtgggcaggggcaggcagtagggaggtggacagccctgaaagctggctggttgggctgacctcagcgcctgcctgcccgcccctctccccacagccatgtccagctacctgtacatcatcaagtctgagctgccacttgtcatacagaccttcctgaacctggaggagaaaacctcgtgagccctggcgtggggaggggaggggaggggtgcggtgcagtgaggaggggtggggtggggtggggctgggtgagggtgggggggcccaggctgggctggtgggagagacaagacaaagcagacaagaagctggtggagtggggagagttgcccgcagagccagcattcagttcacactcacttgggaagcaccttggagacccccctccagaaggggcttgtggggctaggggcagggtgcagctgaggaagctgggcctctcctcaccccggacccagcctgtgagcgtgggaggctcaggcttagctctaagcgcctgctattcctgaccatggggttgccccccccaaccaagatattaagcccaggtgtcccagttgcctatcactttagccagcattgactgggcatcaaacgtgttttgtgggacagaggggacacagccaggccctgctcttgacagcccagcccgagcaagcagaggggctgggaggctgagagtagctccggcaagagggagagccaggattctgccgctggggccctgggcctttcccaaggagttggcctcagggcttgcctttgaggatggtcctggcccttatccccttgtttctctgtgccccgtatccattcctggtgggtagaggagggggccggatgaggcaaggcccagatgccagaaggaaccgcaaggagcacaggttattgcaagtgccagaaacccccgtggaaaataccacctccctctagaaccaggtccctcttcctcctcccacccacctccatccaaaggctgggcccagacctgtgtatcctgagaaaagcaacagcagtgcctacaatagagagggtcctgagcatgagctgtgtgccaggctggaaccttagttctcatgtcaccctgaaggacagtactgaaggcacgccctttgttttgttttgttttgttttgttttgtttgtgagacggagtctcgctcagtcgcccaggctggagtacagtggcacaatcttggctcactgcaacctctgcctcccgggttcttgtgattctcctgcctcagtctcctgagtagctgagattataggcgtgtgccaccatgcccggctaatttttttgtatttttagtagagatggggtttcaccatgttggtcaggctggtctcgaactcctgacctgatgatccacccacctcagcctcccaaagtgctgggattacaggcgtgaaccaccgcgcccagctgggcatgcccattttgcagatggggaaagtgagactcagagctgtggacaaacattcttcagatgtcactcagtggcaccattggtaactccagcagagggaggcaggggccccatcccaggctgaatggattctgaccctggctcccgactcatgtccctgcagggactggtacatgaacgggaactacctggtaatccttgtctctgtcaccatcattctgcccctggcactgatgcggcagcttggtgagtgtggaagggtcagagccttggaggggatgttggaggcatacaccatgggaggggccccaggtctcagagtgctccctccactttgcaggctacctgggctactccagcggcttctctcttagctgcatggtgttcttcctaattgcagtgagtcaccctccatgttggctgagaaagcgggcagcgggtctcctgggggagttccctgtcatcaggagggggcaggtgtctctgggaagcctgggccagaaggcagctccaccagtcctgatctagatgtggcttcatggtgacttcccaggcagtccagcctgggagtctctgacaccctcatccctccccactccaggtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacaggttctgacaggtcagggcaaggcgggggcccaatgagagtggcagactgccttgacacagccccgtgtttccccagacagcatacaccatccccatcatggccttcgccttcgtctgccaccccgaggtgctgcccatctatactgagctcaaggagtaggtgtctgtggctgggagtgggggtggggatgccctgagctggtttggggagaatggatgtggtcctgaatgtggagaggggagtgacaggagccaagtcactttatctgagatgtccttggcagccatgagaggtgattatgagcaagaaggagactccctcagatgctgaatggtgaaagtatggtgccagagagagcttggggcacatgggggtctcccaatgttacccagcttgtcaccaacacccacccccccacttccccacagcccctccaagaagaagatgcagcacatctccaacctgtccatcgctgtcatgtacatcatgtacttcctggctgccctcttcggctacctcaccttctacagtacggtggcaccggtgggcagaggcctaggctaggctggggggaaggggctggttgtggccatggtgccctccataccgaggcgtgtggtgcctggctgtgccttgccgctgtggaggtgagtctgcatgccaatccccacagtgttggggtcccctaggcagctcagatcccacctccttcctggggccacctactgaccaccctccctgcctgccacagacggggtggagtcggagctgctgcacacctacagcaaggtggacccgtttgacgtcctgatcctgtgtgtgcgcgtggccgtgctgacagcagtcacgctcacagtgcccatcgttctgttcccggtgagctggtgggcaggtggctagactagtggcgggaggggctgatggggccaacaggctgatgattcttctcacctgccccccaggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgagggtctggccctgctgtggaagcagggtattgccccagaggatttcaactctgcaaatcctggcagattcctgagcttacaccctacattaagtgcagtggccatgtgcacagtttggccttccatctgagcttttgtccataggctattctaatcccttttcagggctcagagccactgagtcagtcccccttgctggaggacaggggtggatcccagggatcagaggccgcctcaaaggatctcactgggtcttgtccacatttcacatgtcaggaaactaaagttcagagtgattaaaggagcagcagggccacacagctggtgaataggagccttgggcttgattcagccccaggatcactggactccaagtttgatgctccatccactgcctcattccagatggggctctcagctggtagagcagacaattctgaaatgtctttggggtgatccaactcagaggactaacaaactctgccaggactgacaaacagacctgggggctgagtgtcatggatatcacggacagcactcttcgttctctatgtccgaaatccaactcgaaatgaattaagcagaaaggaatccactggctcaaataacggagaagccttcaagtatagctgcagcctggagcccaatacccttaagccctcatctctctccatctcttgatttgcctttcctcattgctagcttcattggctgacattcttctgacaccaacatcaccagccttctatcctcatggatggagaacaagggggagaggctggtgggctagaatcaggcagagctctccagtggtctcaacatgaaactccctcaacaaggagtgtttgatctcattgaagagtccacccccgaaccttagtcagtaggaggatatgagccagcagtggccatgtcttgttctttgcaggtgccacatctgccccattcctcatcttcatcttccctgccatcttctacttccgaatcatgcccacggagaaggagcctgcaagatccacccccaaaatcctggtgcgaggggcctggaggccggtgggctggtatggggctaagggaactgccctgacctcggacctgaccctgacttctgattccacaggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgttttctattcttggtctccatggtccctggattcctggaaagtgaggtacgggccagaacatggatggtgatggagggcccccgtctccttgtctgggatgagggtggggacagggcaagtcccccacccaccccaccccctgcctcccaaactaaccagtggcacactcagacccagctctgggcctgggccaggctcagcacagacctgctttctcacgggttgaggtggggaggaattaatgaggccccaggaagtgggacagagagaggcctccggaaggaggcaacgtgaggtgcatccccagcagcttcagggagggtctgagctgggggcagctgagccctgagggagccccaggaagggccccctgccctcccctagctcccaggctgccatgtcaactctctgtcaatgccctgagtctggggacaaaagtccaggaatcctgtgccctgttgggctgatctttttatcaacagtaaaatccactacgaataaagtgggttagtagtccctgtgtgtggggccccaaatggcaaagagaggtgggagtccaaggtacggcaggggctgcaaggaagcaggacagccccaggtgtcctggccccggtgagactgggaagctgcccactgccttgggcaggcctgaaccagctgggatccagtgggatggagctgcccaggccttggcaccaaaccctcattaggagagaccctgcaccaggctaggccgccggggaaagggctgcaggaaagatccagtttgaatttgcaaggcagctgccagctcgggaaaaccctgaagaaagaacttcctcaagccggtggctgctaggcccacggcagtgccagctcagccgaggggagcttcctgagtcctgttcccatcaggcccaggcgcctgactccaggctggggactcacccaggagccctgtggccccaggaaagagctggtcactggcctagaggtagatgcagcgcagtgtgttctgatgagaggggctgccctctagaggtctcgatggggccataaccttgcctggaacccttggctcctgggcagtgggggtcaatgaagggcaagtccatcctgcaggcagacctgggggttttctcttatactccctccatccaaagaaggctgcaggtcagagcagcagcaggacaccaggtctggcttcaggcccctcagaccaaggggatgtgctaacagtagcaccccccatgcatacacatacacacaaatggggtggggaaggaccctgggccctggccccaagaggccagctctgcttgcccagtcaggcctcctccagcctgaccatgggcagcaggctccggcagggaggaggcaggtaatgtgaccactacactagattcaagagccaagtgtccacatgactgtttgaaaatgagtatcccttgtccctggctgttaaattccagacacttggcctccatgatctgcaggccctcaggcatcattaatcatttgagtatgtgttgaaaatttttccagtttttttcctttgttaccttttaaaaaattgttctggggccgggcatggtggctcacacctgtaatcccagcactttgggaagccgaggtgggcagactacttgaactcaagatttcaagaccaacctgggcaacatggtgaaacctcgtctctaaaaaaagaaaaaaaaattgaaaaattagcagggtgtggtggctcatgcctgtagtcccagctattcaggaggctgaggcaggaggatcacttgggcctgggtgactgaggctgcagtgagttgtaattgtgctactgcactccagcctgggcaacagagcaagactctgtctcaaaaaataaataaacaaacaaatagataaataaatagttctaggccgggtgtggtggctcacacctgtaatcccggcactttcggaggctgaggcaggcggatcacctgaggtcaggagttcgag

SEQ ID NO: 17428 - DNA, 11936 bp, Human
cccagctaatttttgtatttttagtagagacgaggtttctccatgttggccaggctggtctcaaactcctgacctcgggtgatccacctgcctcggcctccccaagtgctgggattacaggtgtgagccaccaccacacttggccttttttttttttctttgagatggactctcaccctgttgcccaggctgttgtgcagtggcatgatctcggctcactgcaatctccatctcctgggttcaagcaattctcctgcctcagcctcccgagtggctgggactacaggcgtgcgccaccacgcccagctaatttttgtatttttagtagagatggggtttcaccatgttggccaggctggtctcgaactcctgacctcaggtgatctgcccacttcagcctcccaaaatgctgggattacaggtgtcagccaccacccccggactcccatattctttttctctaccttttcggtggctttcatgtttcccaggcatccatcaataccatcccaggagctgcctgtggagaagggcttcctatgtgaagaaaaccctctctagaagcactgggactggggaggaattagcgggagcagcaggtggctcaggctccctctcccttcgctgcctaagaagcttccatcccctccatgacccaagccctctaacatgatagatctcctctacttgagatctgttattactcatgggacagttgctgctctgaagcgaaatactggctgttttttgtttgtttgttttggagacagagtctcactctatcccccaggccggagtgcaatggcgatctcggctcactgcaacctccacctcccgggttctagcgattctcctgcctcagcctcctgactagctgggattacaggcacccaccaccacatccggctaatttttgtatttttagtagagacgtggtttcaccgtgttggtcaggctggtctcaaactcctgacctcaggtgatcaacccacctcagcctcacaaagtgctgggattacaggcatgagccaaagcacccggcaatgctggctgtttctaacccctgttcagtatttcacttgtacatctacccaccttcccattcggggtgggcagatgaaactagcaatggacgtctgaccttgggtcggtcacttctcctaagcttcctgttccccactagtaaaaagagggaggcttaagatgatctacatgttcccctctgagtagtaatcttctgtggaattcatattttatcctccagcaccgaggggcaggggtgtcactctgcccccaccccctgcctcacctcttccccattactttaggacctcaaagcactttcactattagttcccctctgttgtcctttttatttcccagacaaagggaaatgactcaccccaaagtcaactggagtgggtggaatggtgtcatacaagcaaacagggagtccctacagacatccctacctctgtgggaactccttcccctggaggtgttctccctaaggcgagtagaagggaaagggggtcacatttcctttccttctctggactttgccctgaagcagagggcagcctaagctcctgactccagggaaatctccctccccggcttctctctctcccggtcaccagtaacctcaggacgaggtcagtcctgcaatcacgtgaagccctcacgtttgcaaggtttgcagaaagggcctcttagctttgatctcccagacagcaaacaagcttgccagtccctccccagaaattcacatgcccctgccatacaggctttctaaacacgccaccctgactcttcagcgcaccccatcccaccccactctcagctcctcccaggtcccggcaagcgctttgccaggcagaaagggtaaaggcacgcagtccgcccactttgtcggtggactacaaatcccgacagtcttgtcgttgcgcaggcgcgcaagagctcaacgtgccggctgttggaaaagtgtgtcactggggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgctaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtactgagatttctttactatcatcttttccctgtcactgtctccccacctccatctacgccttataaaaagaggaactttgtaagggactggggtgtccctcggcccggagatttgctaacgtgctgcggtgctttagtgtgggatttccagagcggcttgttcgggctggaaatgctctcagaaacgccccatcaccacccctcagagtcccaaagctcccttgagcctcgaatccctgggcaggaggaaatggagaggaggtacgggtggtgaagcgaagaatttagggggactgggagctttggaacagtgccccgaaacggccccatctgtccactacctgcagctgtagtatgcctggcctcagaaaacggaccccctcccctcttgtcttccccctcctctagttcctgcaggcgcgagggaatctgagaagagtggcgcgatggggttcagggaaggaggggctgggagaatcgttcggatctcactggggaatcctcagtgacaggagggagcgacacttgaggagtccagagcgtggtgcccggcccgagggagggcacctacagggctccggccgccgggagggctcacatggctctagagccgggcccacgtgctgcgtttgttttcattcagcagaagccgtggctgccaccccattggtcgttgcctcccggcctcgttacataatgagctccgcccccccggtcgcctcggcaacgcgtgttcccttctctcctcctctaggttgtcctggccctgctatcgttcggggtccagcccacgacctggtggccggggaagggcgggtaggaggcggggcgactgctctcgattgacgggaagcgaggagggcggggcctcgagttccggggttcctcgttggggagccacgtgcgagaggcacacgtggagcagggacgtgaggccggctgagggcccagctcccgccctgccccgccccgccgagatctgggtgaagctgggctgactcaccgcccccgcctgcctccttttccggtccgcctgcccggccccctccccccatcaccaaaacaaagtaacatggagccattcctgacctttcatggccttctgttttacactccctaaagagacctcacccctaaccacccttctcactcctttccacttcactcttatttgcacctacttcaccgtactgcatttagactcagcttccccacattacaaattcctgttccccaagcttctctctccttagttctgcgagcattgtcttacccccatctccaccagacaagctgcagtttgcctactaagggctccccaaagcaactgcaccccacaatcatagctgaaatgatactgtcctttttttctcacagaaaggaaaactgagacccaaagaggggagttgatgtcctctaggtcacaaaataagttggtagtgatgggtctagacctagacctagactcttgagtatgctcctcacttccacgttggaagcctctgcatgaaggtctcactcctttttgggggatgggtgaactaggtcaacttcatttactgccaactaatgattccatcccccacctcagccctgaaaccgggggagctgatctgttgtgcaactattttccaaggagctgggttcaccctgaccaaccttgagctattttagggccgccctgcccagttcagtgtgtgtcagtgggtgagcaagacatgtgcctctgcagacacagtggcatggcatgtgttaggtcacatgtgtcctgggatcctcccttctcccaccccgcccatggcagaccaatctaggtgcttgccagaggtgtggcaggcaggtcacctttttctcctgctaataccacgggagcacagccacctcattggcaatgtaaccagagggtcaaagtccctgaatggccagagagccaaggtcattgttaccaggctgagatctgaagggggaattttagagccccaggctggacagtttgtacttccacctcctgcaactcgcacctcgaagtcctttttggacacagggatagactccactgtggctcactctcttaagaggccaggggaaccaggctgggcagattccttcccttcatttccttcagagaatatatgtccccaactggggggaatgtgactgtcttacttttgtaaaccctccattctctttactgttggctacctatctctccatggtccatggtctcattcctggaatggtcttagtgttaaaatcagcagctgggtttttgtttttggaggactgggcactttgaatggtgctcagctgcccatcccatccccagatcttcaactgacaactaagtcattagctgcagtcgatattcccaaggaaggcaactaaggaaggggggcacatatgcgagatgccacaggggtcatgcctcatactgaaagcagaagctgaaggtggcctgcaaagggtcgtaggtgttgcttggccatgccatgtctactgtgtgttggggaattgcttattaactccaagattaggggctccacatggtgaactgagtggccagcaatgttttgggcagacaggtggggatgagcacagtggcaccctaggtccggagacatggcggctgacaccccctttccttttgttctctctccaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccagtgagtacctttccagctgattcgggggaagggaagcaggccagggccagattgggaatgggtttttacgtgacaccagtcttgccagggcctattctggcttcagggatttctcctagagtggcaccagcccctcttcagcccagttttgtcactccagtgcccctcaacactggagttcctccttagcttttccctccctggatctccggcccagaaagcctccacacctgtggccactcagcctggcctctcctgctcacctgctgcccgtctcttccacagagctgaatggcatggtgttactgtgtaaagtgtgtggggacgttgcctcgggcttccactacggtgtgcacgcctgcgagggctgcaaggtgaggcggactgggggtaagggcaggggcaggtggccccctccccctggacacagaggcccagccatgatggaggtggtcactaaccacccctgccctccagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacggtgaggcagcatccccacatcctccccctttcttccgcccaaagtttctgaattaatccttccctttaaaaaagtcacaaatggagacacatcatactgtgaatcacatgtgccaggggatgtccatccttcatttgcttgggtcaacatatacttctatcccattggtccctcgggtcacctcctaccagcaatccctcctagggaaacccccttgatgggtggggacttgctggttttagttttgatgtgaaaccccaagccttcagggccttgccctttcaggaggaaggaaggaagagaagcacgtgagcatggttgagaacttcctgatgctgttctcatcctgttgcagctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggtaagggcatgggggcgggcgagtgcgttaagaagattgggggggcctggcagaatggacttagtgtagggcagctgggggttcctggaggctgagtgtggggatagcatcttcccaggagaaaatgtcttgccttgcagtctggactctgcctgggaatccctaatctccacctggcacctaattgctactttatctgaaagacccatccttcagggccacagcccctagcccaggcagaatctggggtccagctctgctcggggcgtccatctgacccagcctggctgacactcccctccttcaatcttttcctcccccaggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgagtgaccgtttatgcttctggtttttgttttttttgagacagagtttcgcttgtcgcccaggctggagtgcaatggtgcgatctccactcactgcaacctccacctcctgggttcaagcaattctcctacctcagccttccaagtagctgggattacaggttcccgccaccacgcttggctaatttttatatttttattagagacagggtttcgccatgttggccaggctggtctcaaactcctgaccccaggtgatctgcccgccttggactcccaaagtattgggattacaggcgtgagccattgcacccagacgcttcctgcttttgaccttgggaaggatccaacagaaagccctgctgtctggggtgggcaggacctctgaaaggttttggaacccagtatctttgtccttatagcctgattggtgaaaggggctgagcggctcctgctgcttcctcttgatggctgggacttctgtcatctcagctggaatttaatcacaacccattacactgaaataatgccttgggtgcactgctgcccccattctagacaagagcagattaactttggtgaatgccttgcccaaggtcacaggtagtgacaaagctgacactcagattcaggcttattggatcccaaagccatccttccacctgggctccctcattggccattcagaaacaacccccactctactgagaaatcgaaggcagcaccgctaaaccctctggcaaactacaggggcgatttggtcagtgctcctcccaccacacccaggatgactgttccccttccctcctaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcaggtaggtcaggctctcgcctgacccgggggaggaggcagacgcagttcaattcaacacaccttttatggagtacctactctatgccaggccctgcaccgggcactggggatacagacatgattcagacacagtctagcttgggaaacagactcatgcccgactaattataaaacagtgagataagtgtcacagtagaagcatgaaccaaggaagcacagacaactatttctgcctgggggagctggggaaggaggtgacacttgagttggggcctcaaaggacaagtaagatgttgccaggcagagaaagggggaagggcatcccaggcagagggaactacacagcaaaaagcaagggagtctggccatgtttggcctgctgaggaagggaaggtggtcttacgggatgggaggtgaccagccctgctgagcccacgctcccagctttcaggcacctcctgctcttggggcagaggcctgggagaaggtatggcactccttctccttccccatcggccttctggggggcttcagggagaggctgcattgcctgccaggtcctcgcagacctccggttcctcctcagaggagctcggggagtccgcctcactgctgtcgtcttccccacagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggcttctgtggtgtgtgctcgtttggggggtggggtggaaatactgccaaggctggggggggccacctctccatctggtcagtttgtggggtgggtactctgccagcagatgggaggatatagggaaacagcacacaagtctaaggggggtgcccaagggggttattttcatcatatatttattacataaatatatagtaaaatagacgagcaacaattaccataaaaatatctttctttaaaatcctgacccaaaacacaacggggtgaaaaatcgcacataacagacatactgattgtcaacgtggggcaggagtaggagcccctcaagtcacccctgccggtcccacccctccctggggaagagacctacctccttccctgtttctggccacaacccccctccccccagcccagcaccagcttctcatacattcagtagcgcctctgggcagtgtccccctcccccccgcccaggagttcccagggcaggagttactgtcctccttatggacggtctctctctcacaacgccctgccctctcccagccctgcagacccgccaccaggagaaggggtaggggctcctcccccaccctccccaagtctgagcagggaggaggctggatgaggtatgtgtgttatgagtgatgggaggggcaatactgagatggagaggcgggtggtgggggcggggtagtggtcatggctctggcaaccccttgtcctggcctggccccctcgtcctattcccagcaacccgtcctcccaccgatactgcacctgctgctccaccctgcctgccctagtgccccgggccaatactgggggaggcatgctgagcacccacatcaaggccatccccctcattagcaccaatggcccccaggagagggccctgtcccccacttccacagcagggactgggacagctgccgctctagagcaggtgcgtggcactcctgagtcgccctggctcctcccctaccatgtgtactcactcacacattcacgcagaggaacgcacacatacaccccacatcaccgagggggaagggaggggtccggggaggatgggatcacagctcatatgattggggagggtgggggagtcccaagtgcctataagaggctaaggctcttcaaggccttttctctgccgtgtccatggctgagaatggggatggaggggttggggtggggatggagggatggggaagacagcagacaggtcaggaattccactgggcccccaggcgtggtaggaaggtacaagagggcctacccatgggactggagtaatacaggattcagtactccaggagagagagagaggatagagacaaagacagcgcgggcagcccgaggccccagcagggtgggacaggcacatgcacaggtgacagcgggtgctcctccaggccctccacccctgttggaacacctgaacgattggggaaggacagtgccctgacgggcagcatagcattgccttcccatgtccgtgtgtgcatgtccgtgtgtgtgtgtgtgtgtgtgtgtgtgtagggggctgtggcaggctgagggtcagggtggggtggcaggttccccactgcttaagacatttttgccccaatagtgcaaagcgcaggaagccctggaacccttccccccaccccctgccccaatccccatggcttccgggggcatctgtgtccacccatccatccctgccgacatgcagccctgagcccagcaccctctggtctgctctgtcccaccccacctcctgctcccatgggaggaccacctcctctctccctctctcccctgaggagtgggcggcagccacagggagggggaggaggacagctcacccaagtgcagaccaacagagcaccctcaccaggagggcgagaggggctcaagccaaagtccctgaattagagaaaagaagaggggaaggggtcccggggcagaggggcagctggccaaaagagctttaaagaaaaaggagcac

SEQ ID NO: 17429 - DNA, 14992 bp, Human; identical to SEQ ID NO: 12686

SEQ ID NO: 17430 - DNA, 9422 bp, Human
acccagaggcccctccaccccttcagctcctgccagcttccctctgacgctctcccaagtctgccttccagggtccctgagtccatgccaggaaggggcgttcccccgccctcactccgtctcaaagagagctcagcctcagcctttgtcctggccgctctgggctccctgcctctccctccgcaggcgaagctgggcactcggccatgagcctgtctccccggggcagagtccagctcccctctccctccccatcctctcaggcctggcagacctcccactccctggcttgagctttttgtccatgaaaagagtccagaacaccaggaagccccgctgggcctggagggaagcggggtaccgcaggccagtgggggtcgcagcaccctgcctctgggcggcctttgttccttccttttcaggcatgatgtgcactgtgcgtgcctctccctcctctgggcggtcaggggtggaagaaaggcctggggtgtgtggggggaaactggggcctggggcctggagcttagcaccggcaacacccagagattgcctgctggagccccgccaggctgggctgtgaggctgaggcagcagagaggcttcccagggttcccacccctccctttggggtcctgagctggaagaaagatgcctttactgggcctgtggcgccagaccctcagcccaggcagcaatcccagcacaattgtcactgcccgttccagaaggccgggcatggtctggaccctgccccatggggctgccctttgggccccagcagcctgcactccctggtggccttgcctcgtggctccctgacgctgtgtggctggaattattgggacaagaattcccactttgcagcaggcgcaaagggggtggcccctggccgggctgggatgcggggcctgtgaggctgcagagccgaaaggccagccatgtcgtgggacggaggagcagggcttgcgtctggggccagctgcgcttcgcctgccccagccgtccccagaagcctgttgctgacccgcaccccaagcctggcctggggaccctcttccttgcctttcaggccacgtagaggccccacctgtttccgtcctggggaagcctcctctggcctccgcagcccaagcctctgttcccctcaggccgagggggcagcaggcgcggccgaggccctgggctgggaggtatggacctttggcccggtctgtgctgcttctcctctgtttctcggctcggtgtgacctgggccgtccctccccttccccgttcctgcgtcctcaccttcacctcagtacagggcccaggtgaggtggatctgactgggcctcaagggtagttctggcctgggtcagctgcgtgtctctggagctgacctgcgctggctcagcgccgcaggctggcggatccttgctggccgggagggcatcccgcaggccagcctggtcctcaccagccctgggagttggcgctcagggccctgctccacaaacaggtgctgaccctcggcttcctcctgagtccccagcccgggccccgcgtggctccgcagccgacagtgcctcattcctgcaagcgagtctggcctcctttcccgggcccgggaaaagcgcggctctccagcacaggaccctccgagccagcctcgcccgcccacccccacgccaggtctcctgcctccacggccgggggatccccttgctgagtgggcgggaaggggaaggtgggccatagccgcggggcgcccgggctcagacccgggagccggggggcggtgctggtgactcagccgcgcccgcgtctctcacctgcgcgggccggacggcggaagcttgggagcggaggcgaaacctgtccgcccgtgggcgtggccggtgatgggcgggcccgcccggcctcccgcccctcgtcccgccccggggcccctaccccgcggtcccgcggccccgcccgcctccgcctccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaaggtgcgcgcccgggcacccagcgcacgtctggggagcagcgggccgggcttggagccggggagggggtgcggctgggaacctgagcaggatcagcccgggacccccaccgtgctctgctcctggcgggctgggtggggtcccgggttccgcgctctgcgctccccgaccgggtacgcggagggggcggggggcggtggcgcttccagggcgacgcggtgctgaaggaacaagtcccgggagttccgcgcccgccgccgagtccgtcaacgcagcccaggggctgtgtccccgctcccgggatagcccagcgatgccccctgggtgctgccggacgcccgcccccaggcctgtgcgggcccccaggggcactccgggccacttctgccctgtgccgccgccccggagggtgcggttagagccacatcgactgggtattcagcccagatggggatccacaagccccaggacccagggcccccgccaggacacgagagtggcccagaaagacaggagggcttgaccggagcagccctggccggtcctcaaaaggttggagcaggctagcctggatctccactccagcaggcccagggacctcctggtcggcccctttaaccctttattgggcttgtaggggggtggggtggagagccaagtcccccagcctgatggggagtcagaagcagggagctctgcggccctgcaggacggccatgtggcggtgcacgcgctgacctgttgatgctctgggctctggggaagccttggtcgggatggactggtgcggccctctcggaggctggaattggcgcccgggcctgggaggctggtccccagctttccaggtggatccaggatgatggggcaggagctggaaaagggcatttacaagctcgtgccactcaggtctgcaggaaggcccacccagcacccccaacaaggcagggccagcctctctctctggccctggcttggaggcctagggagagtgtctttagagctgacctggctctgaggcccacggccagcctcggtggaccttcttcacctggggccctgcctcctgcatcctcaggttgggctgccgtcagaggagctggaaggagacagaggaggaaggaagaggggaggaaggaagagggactctagggagctcctcttgcagaggagcttcctctccctgagcctgggaaacttgtgccccagggaaaagtccctggggaccctctgtccctctgtccctgactcagtccctcagtctgcccttgccaggaaggctgctgcccagaccctggcatgctggcttcaggtagtcaggagggaagagtcacctcccccccacctccctgttctccttccaaccacggcctcagaggaggccctggcctcctctgagcttcagcatgaggcttggcacatgactgggtgggggggggagcggtggcaaactggaggaacccaacttcacgtttggtgtcagggtgtcagggcccccggacaccccaggctgactccctccccctcccccgcagtatggcatcgtcctggacgctggttcttcacacacgtccatgtttatctacaagtggccggcagacaaggagaacgacacaggcattgtgggccagcacagctcctgtgatgttccaggtgaggcccagcccagcccagccaggacgcccactcactgcagggtctctgggaccctctccagccttagccagtgcaggtccttctgcttagtgttgggtggggctcactccaggcagaagccctggaaagagagaggctggtgcccctgcgcctgagtggggccaggagtcgtttgcattctagaaaggaagcctaggcagcaggtggggaggtttgagcctcgccgggcccagtattggcttctgtgccccagatggagcaggaggaggtctgggggcctggcggacacacccaggcaggcctcaggaggccaacctgggttgaccatgcccagggctttgtcctagcacctgcacccacaccctctcagcaggcagcagccttggtctccgggtggcacctgggcccctttgtctccaacctgggcgtttctgggggcttaagcagggaaggtgtgccacctggtctgggagcccacggcccccacccccaccctcactctcctggcctacggcccacctaggggctgcccgtgaggcataggctcatctctctgcctccctctaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaagtgagtgtgcctgtgccctggccctgtccccatgatggcctttggctgtgaccccttgcagggcggactccgagcacccctacagcaggctcacagccacctggggagaaggcctcttggagttctctgtgttttgcagcctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaaggtgggcccagcagccagccaaagagccagggggcgtgggcgccctcggcccctggttgaccccacactcccctctccacagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccaggtgcccctccaccctggctcacctgcactgcactgttccctcctggagcagagcctggacagccactgtgctgtggaaggcttctccaggctgggctttaattggctggaaagacaggtgggagggtcagagcatgagcaaaggcccagtggctgggctgggcctggagaagggagggccagggacggctctcagagggagcctggtcaggggcgttgggatctgtcaagcaggcagtggggagccatggattgcccctgagcacaaaagtgaagttgccagagtgagacctgtgggaggtttgtcaggctggtcctctggagcggtggtggtgccaccctgtcacgctggtgattcccccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggtgagtaggggcaggcgggtggctgggaactttgtcgtgggtaggggcaggcgggtggctgggaactttgtcgtgggtagggacaggcgggtggctgggaactttgtcgtgggtagggacaggcgggtggctgggaactttgtcgtgagtagggataggcgggtggctgggaactttgtcgtgggtaggggcaggcgggtggctgggaactttgtcgtgagtaggggcaggcgggtggcggcaggtgctctgagccgctggggttcggtcacagtgtgactgcgccccctacaggccttctctgccttcttctacactgtggactttttgcggacttcgatggggctgcccgtggccaccctgcagcagctggaggcagccgcagtgaatgtctgcaaccagacctgggctcaggtgagccccgctcccactccttcagggctgtgcggaagggctcagcctccgcctccgcatgcctccccagccctgcatggacaggcctctcggagcacccgctgcagtgggggcgatggcaggcattaggctgactccagaggtggcgtggctgtggccggtaggctgtgaacaagtcgggcgggttggagaagcttcgccaggcccgaccctcatcccagatctggagggcagggggaggccggtgcccaggtttctggcttctgccactggttccctccatggtaccacacaagggaagatggaagtgggtctgggcaccgcgagtgtgcccaccggagactccaagagaaacgtacgagtcgtcccaggaccggggtggtgagcgaggccccattttgtcctcccagggcctagtctcagacagactggggtgagggaggtggggacaggcggcgagccagcgggcagactcaggcctggagctcgtcctgttcccctggccacacaccaaggtgttgctgcctcctgctccctggtggccatgcctgctgtccctcctcactggccttccaggcatgggcgctggctggggagggatggaagcgtgccctgccgggggtgcccctcggactcggtcttgccattcgtgtccgggcctgtgtggtggtctctggcctcgcacggcccgtgtgtgtctggggaggggtgaagcacgccgccggccccctctccccgtggggccgagacctcctggtggtcgcctgcctgatggtgtcccgcccgcgtcccagctgcaagctcgggtgccagggcaacgggcccgcctggccgactactgcgccggggccatgttcgtgcagcagctgctgagtcgcggctacggcttcgatgagcgcgccttcggcggcgtgatcttccagaagaaggtgggctggggcggggcggggcggggccgaccttgcggggcggggcctctcgggagctgaggccacgcccttccccgcaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaaggagagtgtctgtggggtggggcatccttgctgtggcctgtgcccccaccttcccgctgttctagccgcacgggcctgcccttggtcctgagggtggacaccatccctccctactgccttctgctctggagccaggcctggggcactggctgctgccctggtgtgccgtggcagcctagagtagctgcaggatggctggcccgagggaatgttcctgggcccttgagtcttctctggccagcagagttccccaaaaccatcacatccagatctgcgttggtgaccaaggccagactgaaggttgggtcctggtacagtgagcctgggggtgagggtagaggtcagggaggtggcggagagtgggtggcagccagccaggcggcttcctagggggcagtcagtgctggtagagactggcgggagggcaggcccacatcaggaggtggcacaggggtgggagatgagatcaggaccaggacccataggcaggaatcttgcacagaacctggctgtggagctgagccatgcaatggcacagggcaccttgcccttctcacctgggactgagtgtcctgcacctccaaaaggcatcctgcagccccagccaggccctgcagcccctccccaagccagttttctccaggatgggaaggcctggtcttgcccactcgcctcctcaccttcctgggaagtgagcttagacactgtctctatgctcagtgccctggcgaggagggtggtggttcttattctgctcttccctcccctcttcaccatttttttttaaagtcatttgataaacctgagggcagccagccccagctttggagttctgagactggaaggaccaaggggacaccccgggttggaggtctcactcttgttctctgaatgactagtcaaaggaggtttctagtgggatggggtgggcgtgctcttgggaggcaacaggtgaggtgcaaggggggcatcagagatgcccgttgtcagctgggcacagtggctcacgcctgtaatcccagcactttgggaggctgaggctggcgtatcacctgaggtcaggagttcaagaccagctgaggcaacatggtgaaaccccgtctgtactaagaatacaaaaattagcccagcatggtggcacgcgcctgtaatcccagctactcaggaggcagaggcacgagaatcacttgaacccgagaggtggaggttgcagtgggccgaaatggcaccactgcactccaggctaggcgacagagacgctgtctcaaagaaaaaaaaaaaagatgcccattgtcctgagggagctaaagggctgtcacctggggaccctgaacaccttggacagctcccagctccggtcctcagtggctccggatcactcttgccccctggtggcctcactgagcgcggccgccgcggctccagccaaagctgcagtcggggccggggccgttctgtgttcctgtatttgcttttcccgcgagtgggggtgcccctgcct

SEQ ID NO: 17431 - DNA, 26640 bp, Human
cgccaccacgccggctaattttttgtatttttagtacaaaatacaccgtgttagccaggatggtctccatctcctgacctcgtgatctgccgcctcggcctcccagtactgggattacaggcgtgagccaccgtgcccggtctttttttttttttttgaaatggagtttcactcttgcccaggctagagtgcaatggcatgatctcagctcactgcaacctccgcctcctgggttcaagtgattctcctgcctcagtctcccaagtagctgggattacatgtgcccaccaccacaccccgctaattttttgtattttagtagagacagggtttctccatgttggtcaggctggtctcgaactcctgacctcaagagatctgcctgcttcagcctcccagagttgctgggattataggcatgagcaaccatgcccagccaaaatgtgtaccaaggttctaaggaaggggtttatgctaaacaccgggctgttggtggcaagcaccctgtcttgcttcaggggccttccctttgggctggggcctcctagcctcatggcactggggtcacacaaaatgccttcgtggttaatttttggcagacccttcaaatgtccaatcgagggtggggctctgggctgctcctggagcacaggatcagaaagacttgaaatgttcagctagaaacactgctgcttccaccccacctttgcctggccatagggttgcagccattgcccagtggggacaggccacaggagggtgggatgtgggatcatggccacctccagacgtggacaggccatggaagagacaggtcataagatcatggccacttttgtttctagaagtccagtggcaacttcttcctctttcttccctcccaaccccctcaccctgcctgcccgccctcctctcttcctccctctccaccctctcatcctctctccctttctcccttgggtcctgattgcctggtcccagattggagtccaggatggctgcctgccgaagaatgcctcccggtagattggggaaggatggatatgagaagccacccagctaaaggagacagcctaggcaaaggtgtaaagatggaaaccaatttttttttttttttttgagacggagtcttgctctgtcgcccaagctggagtgcaatgaatggcgcgatctcggctcactgcaacctccgccacccgggttgaagcagttctcccgcctcagcctcctgagcaggtgggattacaggcgcccacgaccacgcccgggtaatttttgtatttttagtagagatggggtttcaccatgttggccaggctggtctagaactcctgacctcaagtgatctgcccgcctcggcctcctaaagtgctgggattactggcgtgagccactgcgcccggcctttttttttcctttttcgactagctgcaacccagagggagaaggcggtaaacccgccttaagactgagaaaaccgcagtccagaaaggctcccgagttcgtagatcccaaaacaagtttactggactcattaactttaacaaatgacaaagacacgcctcctccacctaactcgcccaactcgcagaagctcagagggctggttcctgctctgccctcgagggcaccggatccccaccctcgggttaacagatccgccctcccggctgtccagcaacagagctcccggcgctccgcacccaatcacagcccggtcccgcctgcagcccgcccagtgccgggtcccggggtttggaaccacccctattgccttttctccgcgtggccccgcctgcagcccaggcccgagcctgggctgcgcctaacttcccccttcgctccgccctcgagccaatcaacagcctctaatctcctctggccccgcctgcaagcccgccccggcccagtcacaggcttggttcgcccaggccccacccccggcccgccccgccgtcggtgcgcggcggtagggaaggcgcctcccgcagtcgctcggaactgccgacccgagtgcttcccgcagagggctggtggtgggagcggagtgggtcgggcggggccgagccgggccgtgggccgtgtgggggccgggcggcggccgggccggcggacggcgggatgggctgcaccgtgagcgccgaggacaaggcggcggccgagcgctctaagatgatcgacaagaacctgcgggaggacggagagaaggcggcgcgggaggtgaagttgctgctgttgggtgaggccgcgtcccgcactgggatccttgattcccagctcgaatccccagacaaggactttgacctcccagactagggcttcaaactcccagacccgggctgtctgggaccccacacctgggccaggaccagggttgaaaactctagattggactagacctttgatcctgcccagactctagaccagacccctgtctcatcccagaccccagacctccaaatccagtcaacagtgccccaacacccgcggtccagtgccctgcttggccatccccccttgctaactagcttcacagaacttcagagccccgccatccttccctacactttgcccaaacccccaggatgcccgccacttgttccccaaccctcaggctccgcttgttttcctcacctgcgccttttattcctattgggcatgagcatcccgcggggcccctgccaggccccccacccactccctccttctccttctgtgccccatccctagtctggaatctgtatcctccacctgtgcactctgacccaaggaacctctcgagtgggaaactgctcttgagccccatctccagctggaaccccttcagcgagccctgctccctgcttcctgccctccagatccttctctgcaggcatcactcccgaaaccctctgctgatcctcccctaagtcctcttacactctggccttccccagatccctccacccttcctgcaccaagtgggctgggctaggaggcgggagccctgggttggagagggcctaggctgccttatgcagaacccccacggggctggattgaggctccactggtcacgctgggggagggggccaggcctcaggcttcccaaggaggctctatgttttccagtttcgaaggccagtctgggaagtaggagagagagtggaggagttagggttgtggccgcctccaaggccagaaaagatggtggctgctagaggagtggggggaagtggaagtggtgagacagccgacatattgctgcccctgcgggtgagcccaggagatctgctagtaggtgctgggctgcccacaccccttctgggctgcaaggcctgggatgtagcctctgagagttggggggcttgttggatcttgggaccctgtgaagggggatggtggactagctgaatgaggagttgaggggccagctgggggtgggccagggtgcctctgagcatcccagctggccttttgcaaagacggtgggcctactggctgtccccatccagcttcccactggaagtaggtgtggtgcccagtggcagtctaattttgatttgggggttttagagttggggggagggaggcccttgcaacagcgcagcaccgttgtaggctgagaagtgcatgggggggtgtggcccctcgacttcagaactgtcatagggctcccaggctgtgaaaagcagggcttttcgtgctggacctgtggccgaggaacagcatgtatgtccattatgggccatctgttgactgtccctgcggacccggcctccggggcacagccttggaggtttcaaaatggcatccgcttcgctgctgcctcagggaggaagagaaggggcgggaaggggcggcggcccagcctcctgggctgctttgcgttgggcgcttgcctcttcctgtctctgctgtgagtgcggcagcggcagtgagtgggtgtcgacgcggcggaatgcccgtcgctgctgctgctgctgcccgacgggcctggggagggcacttccggtaccgctgcctcccagtgcccagccaggagtctctagacagcctctccccaggcgattgcagttactgtggtggccgaggaaatgcaagactggaccatagagctgggggaacgcagggcttctggctagttttgtgtcccgacaccagaagggtcccccatcccaccaggcctgctccttggagcccagctcaccttttgggctaaggcaagtgagacctggtaactcctcccacactgggctggcagcagccaggggtgcagggtctggcttagcactttctagcctgggaagttcaccctggggtcctggccttctggcctttgcttactctgtgaaatgggcttcctgggttttggccaaaggagtgccccaggtcaggatggggagggagaacaagagcctcctggtggttcttgttggggatgtaggttgggagtaaagaccctgcagtgtgctgcaaagggctctgaccaagctctgcttgatattgatgacccagtctgccatggctgcctggggagggatcctggcttgagccatgcctttcccatccaggtgcaaggtggtgatgggagcccagctgtggtaagttcagagttctgggcgcctgtcccatgtagcgggagactttgtccaggcaacgggactcaggttgggcaactgccagccttccctcccagccagaaccacgcctgctgccccgcccgcacaccgcctccctcccatcttgggtagccctgccagcaggcaggcacagtccttgtcaccagggcagaggctgatgtggtacacacaggcaagagagtatttcctggcaactttgtagggggagcagataccagtcctattctagggatgctccccactcctacccagctcaacgtgactgatcagctaggcccaggtggaatctgggaccctggtctgggctcttaagggaaaggaagccagagtgtatgtgaggggggagagtctctgatttgggatgggcctgtgtggacagcttcacaaaaaaaggagacagtgtccaccattggctccataaaggcttcagaatgtaaacagagcagttctctcttgcccctggaactttgtgtgtgttgttccctacttgattgttctttaaaactttactctgggatcacctcccaggatccttcctggacatcctccctcgaccaaggctggtgaaacatctggctcccagcgctgttgcttcccccctcagatgcctggagactgcagggcagggctaagtcctcttcatttctgtgcccagcatggagcctggcatctactgggtgcttctcatctgtttgttgaatgaaggaagtatcctctgaacctgattttgggtagatggtggagtaaactgagcggcagtttgcatactgtgggcaggtggcaagggcccacaggcccaccacaggattggtgaccagcattgaggggacactgagaaaagttcttcaggctgtttcttcccagccccgccacaggctatgctggcacctgagagagttcttatcccaccctgtgcggaactcctgctgagcagagtggctttgtattcttccttccaactcaggctgttggtgcactgctagagggctgctgtctctgacactgcagtagccacagtcgagcttgagctggctggtccagcaggggctgctccgcagccctggggctcagaccagagcaatgctgtgagagtcctggtactggccagtgcagagactgcacatagcaagggctcaatgaagtttaccaaaagaaaagaaagggggttttgtggcctctgtcctgtctgtgtctcttgcaaagggctggcatactatagatgcctaatgagggtatatggacagaatgaagtgattgaacatgtccatgaacagggcagagctcctgggagaggagtaagtataatcctggggcagccactggagcctggtctagctagagacagataggaagggttagcttgggattctggctggctgggtagtgagttagactctaatggtgcctgtgaaggggggcttcctggaggagggggtctgctgggcagctgtgaaggatgaataccatttgccagggccaggcactgggggtcagagggaccaactcgacaagaacactgcagcaggaagacttggcctgtattcccaagagcttgggtgggtgtttcctggcctggtggggaaagggccaccctccctggaccagcccatggggtcatccagacctgagttcgaatcccagttccacctatggcactggctgagagactcagcatcaggtgaagccctggcaggagtcctgctctccactcataacctgggggcagagtgcctccctgcagccacaggttatggggacagtctaccaaagcttggaggtatgaaaaatgggtgagggaggccaggcgcggtggctcacacctataatcccagcactttgggaggttgaggcaggcagatcacctgaggtcaggagttcaagaccagcctggccaacatggtgaaaccccgtctctactaaaaatacaaaaaaattagccaggtatggtggtatgtgcctgtaatcccagctattcgggaggctgaggcacgagaatcgcttgaacctgggaagtgaaggttacagtggaccgagatggtgccactgcactccagcctgggggacagagcaagactctgtctcaaaaaaaaaaaaaaaaagaaaaaaaaagaaaatggatgagggacccactgctgagagtttggtgggaaggagtctcccatcctagaggctgcctggcctgggtttggagccctagggaaccccctcccctgccctcaggcagctgttcacagcaagtggggagcccaaggcgtgcagatagttggtgccagcaggagtgacagactgccctggggaccttaggcccaacctctgggggtctaggtttggagatgtggtagggccctgggtgccaggtgggccagtacccacccaggctggcctccagcccctacactctaccccagccctctccttcactgctggagctcattagcacttgaatggggggcggggcggcttgggcctctgagtctcttcttcccacccctcccccaggcttgtcggggctttgtctgcaggagcaggcagggatagagctcccacactaaggagtgaacaggggtccaagctatagctgaccccctctgcctgcatcctgcccagttctgctaggctcagcccctgcctctcacgccagtgtcagtgcagccaacatgaggtcatacctctagggtaggagtgagactaggtcctttaagggatacctctgagctgagagactaggtgaatcagggcagctggagctcagctgggggcatcccaggcgggttggggagaggaaccccagacagagggcagagcaggtgtgaggacagagagaatgagccgcgctgctgtggcaggaggtggaagtcaaaccagttgcgggacacaggcttccatgtcagaagccctgaggcagcatcacaccacccactatgtgtcagagcctaggctgctggatggggcctggggatggtccgggacccctttggccctgggcagcttgtcagcggttggccctgggtggcctgagaggtagggtcactgagtgccatcactgatgtcccaggcccttgaacatcagtttgcctggcaagtggcagcaggtagtgctgagggtggggtgtggtcaggtcccagcaaggtccctaggcctccagcactgcagggggtggggcagtaggtgcacttggggctacttgggccacaggcagacacacaggtcctgtatactctgccgttgatcttagttcttggtccctggctgtgactctctcagtctgtctctaaaagccacccattcacttggcgggaacaggatggaggaagctttgtccacccaagctcttagccactgaggaaccagggactccccccaccccacccacagcagaggaggagactgtcaccccagagcctgagtgctgcctcccctacatcccgttgtgctgtggggggaggcaggaccgggcagatgggggcaaggtacaggccagggagtagtctcatcttcccagcatctcaggccaggaatcccagcctaggagttgagcgaggaggggaaggggtcagcaggttctggccaggccactgctgatacaccctgcctaagagtgctctgcaaggtgctttggggaaggcaaaggattgggccctttgatggtgtccctggtacctgatgctctcaggcagcccttccctcagctacaggtgcagggtggaaccccgtctgcccagccccacccagcccttctagcttgaagctctcgttcttactaaaccccaaccccaccctcaccctgatgttacttcttggggctgtggctgctcttggtggctggggaggaagaatctttctggaataaccaaacatttgctgggctggttcttctgtgccggcctctgtgcacatttacaaggcttgaaaggcagcaccacaccagtctgagcaaaggcctaaaggtggggtcatctcagccttgttggggagaagatatccttatggcttggaggaatctgggggctccaaggctgctgacagcctcaggatatgcaaaggaggtgatggcagcacctactgtgtgtgcccccggcgggaggaggaggtaatgaagtctgcacgacatggcagggcagggctgggcctctcggggaagtggtgtccacaccagaggaaaaggaggaagcagctgggggaggaggagcccaaaagaggaagaggccagagggctgcctggtgctagggtgggggtgagagcccaagggccccccagggctttgccaactggaagggtctaggaggtgaacacctgcccaggcttatctttgcactcctgtgggccattctagtggcggtcactgagttggagccagtccaggtagctctgtaccttgtcccaccccagcaaccatcgggcccaagatcccagagaaggtggtgccttcgagaaggattccaggccccttctttggccacaggaagttgtggctgggagaaggacgctggcgggagggctagcaggaaggcagagggctgctcttagattcccgagcggccattgctctccaaagccggaaggccagccacaggctgagatgaatgcctggaaatgcagcaacagccccgagatgagctcactctgggtttcccctgctggggggcggacaaaggatccctggcctcagcctaaggattctcccctaccagcacccactcactgggtctagggctgcattcactgggcctgtttcccctcaggtgataaccacagctgtctctgattgagccttgactgttgtgtggagctgaattcttcattatcttgtcatatttaatcctgtgaggctgggactgatattacacccatttcactgatggacaaactgaagctcagggactttatgcacttaaacagggaacagagatgtcaggacatgacccatgtagtgattaagcgcctgcctccaactgccatggccctttgggagtctgtgctggctggaagtaacggatcaggcaggacagcaggcagacggtgtgggtgcgtgtgtgttctgcctgtgcctatgggccctggctttcgggcctcaattcttcttttaggaggcggaaagggagctgtctgtcctggaaggtgggacccaagactctgtgtatgaagctttctacagccatgtggtcatgggggaccccctccactcctttttttttttttttttttttgagatggagtctcactctgtcacccaggctggagtgcagtggcatgatctcggctcactgcaacctccgcctcctgggttcaagcgattctcctgcctcagcctcctgagtagctgtgactacaggtacgtgccaccacgcccaactaatttttgtatttttaatagagacggggtttcaccatgttggtcaggctggtctcgaactcctgacctcaagtgattcgcctgcctcggcctcccagagtgctgggattacaggtgtgagccactgcgcccggctgcagctgcaccttttgacttcccactttttctcctagtccgtatcctctcacagtgatgctcaagttatagctggcaatttaggacttcattctttccctaatattatgcttgttctcccataagccccagtcttagactgagaccaagcctggggaaggctcagaagctattgaagtccatggtgagggcctctgagactgggaattgtccagaggagtgaaatgaaagcatgttccttagggctgcactgtgagcacaggctcagtgctgggtgcacgtacggtactgtgtggtggtagaatgtggccatggtgttggctgatgactgcatgatagttgttgaggctggttcctcttgctccttggcctccgaatctcagtgctgtggcctagtggggccttgccctctcttgtaggggttcctaggggttctgctgtgttgccaggccaggccgtaagggactgagggggctgaggaaggcttaggagagccagagcagaagcgtccaagcctctctgggccatgaagccatgcacagagcagagacccgtgcatcctcatggccacccaagactgtgggtcccagagggtccagttcctcaccatgagacctcagactgtcctcttccctctctgtatccagcactagaatctgtgatgctgtgattttttttttttttttctgagactgagtttcgctcttgttgcccaggctagagtgcagtgatgcaatctcggctcaccacaacctccgcctcccaggtttaagtgattctcctgcctcagcctccagagtagctgggattacaggcatgtgccaccatgcccggctaattttgtatttttagtagagacagggtttctccatgttggtcaggctggtctcgaactcctgacctcaggtgatccgcccacctcagcctcccaaagtgctgggaatacaggcgtgagccaccccgccccgccagtgccgtgattcttagcatggtctcctggcctgtggacacaaggacagctgctggcttgggttgggccctgaggcagtttggggtgactttgaagaggctactcagggcaggccttgggtttggcaccctccctcaaggggtacatttcatagatgaggcctaggctcccgttatctttcccagagtccaccgccatgaatcagaagggaaaagaggtcattcaggtgccttgggaacagcggagggatgcctgaaatgaagaggcctccagggagacggtgccaaatggcccagctccgcgtgatccgcgtcttgtccagcacctcctggctcctgcacaggcggtacctggggcctgaggcgccagcgatgaacaggtctggggcctcctttatatcaggccagccttcctcacccggtgcctgagtttccctctgtgcagtggaaagggccccactgagggagacacaccttgccccagaaagactttcccatgtgtgggcaggacctgaggcctcagtttccctaacacagagatctctgacttggcagtaggaagccaggccctgcttggtagtgctcccctttgggcactgtgaacccctggaagccgctggaggcagccgagtgccagagactggcgggagggaggtgtggagtctgttggtctgttcaggcatccgttatagggccatgccacacacatgggtgggagtgttgccggtccctttcaagacctcgagtccctgcctcccagtgccggacccgtgctgagccttctcggagggaatgaggggggccggggagcagcacctggaggaaggaagagacgccaggggcggggctcagagggcctttgtctggcggggtctctgcccctccctcccgttgccatggtttctgtgtgtgccgagtctctgcaggctgggggcttcccagggacgggctggtgggtgggacaccttccccagtcgcccctggctgaggctgcttttctgaaacaaaacgctccccagtgctgcccagcccccacttccttccacagtgtctccggctgccgggcgccccctggtggtggcggggcatgggtccctaggactgcaggggacgtgggggtgcacgggatctgagaaccacaggctgagctggagatgtggcaccttcctgggataagagaaggaggtggtgtccgggctgcctttgtggtgggctcagggctacccccacctgccccaccatatcccactgggataggctggggagttgtggcagtgtgggcgggcctggtgttgtgggtttgagctgggccgctgcccaagtctaccctgtggtcccagccgctgctgcttctgagaatctctgccctcgggcctgccacgtcagctggctgctcttcctggccccacgtgttcccacggagcccaccagtatgggggttctctccagggaggtgtgcctggctttctgggtgtgtgcagccagtgagcaatgtcagcagtgaggctcctgggcaggaaggaggccccagctgtgtaggagtgccgggttatactgaagggaagtgacgacacagcggaaagccaacagaggagccagtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtttggggaaatctgtactctttcaaagggtagataaatagtgataacttttacctgaatgctcacatgtgccccacactgtgagaagagctttgcatttaatccttacccatctctcagaaggagacagcgttgtcccatttcacagatgaggtgccagagaaagggcaggaaaggagctgaagctcttgaggatctcaggaaggatcagagtggacatcagggctgtggcaagtctggacctccttctgggagaggatctgaaaatgggaggcaggctggctggctgcttgaggcttgacagctctgcccaggggaaactgaagccagaaaggatagtagcaagtcccagcctcccagcagatcaaagcctattaaggagttagagggtccaagatgaacagatgctgtgacttgaatgctggggcctggactaagcatcaagtgacaagacctgtgggcctgtctctcctgctgcaggggccctgctggtcttgttcacgcaggtggagtggtactgtctcccttctctcatcggttccctcctctggggctcagcactcccaaagtggaagcagatgttctagtgcagagcagctgccaccacccagcacatcactatgattactgcctacctgctgtgggccctaactgcgccacagggcaaaggctgcagaggtttcttccttggtgggaagaggtgtgactcagtgggaatgccaaggccaccccagggaacctctgcaggcctctctggtcttacccagctggggacagagcacttggtggggccctctgcgggcaggaggggctgattcatgccaccttctattgcctcagttcccctacccagcatctttgcagaaatctggactcaggctggacgcggtggctcacgcctgtaatcccagcactttgggaggccaaagcaggtggatcacttgaggtcaggagttcgagaccagcctggccaacatggtgaaaccctgtctctactaaaaatacaaaaattagccgggcgtggtggcacatgcctgtagtcccagctactggggaggctgaggcaggagaattgcttgaaccgggaggcagaggttgaaccgggaggcaaaggttgcagtgagccaagatcatgctattgcactccagcctgagcaacagagcgagactgtgtttcaaaaaaaaaatctggactcagccacccctctgagaggcaggtgcgaggggagctgggtgtgtgcaaaactcacagataagcctcttgccagcttatctggtagggggcatccctcaggtcctgatggaaagaggacccagccagagatggggagagtgaagctactaccccacagctgccagggcacttagcctgtgggctgcccgagagctcttcaccccacccattccacccagatgccatcctggggctccacccacctctgctcctgtcccccttctctgctggagctgctcctgggctgtgcccctgcctctgtcccgttgttccccctgcttcctgcctggctgccagcaccacacccttgtcctgccactcactacttcccgcctgagtcacagctgctggaaagacaaagagaccagcctgagtctagggataggggctccatgaccttgatttgcttacctgtcaagtggaactcttttttcagtgacccctgcttgggatagagaatgttctcttaacatttaagaggccttaggaggggaaaatgaaacttgaaggggacagggaagtgggccctccctggctggggcagggagcagatatcctggctcctagtgtgactggctctgtgctgcctacctcatgtctaccaggtctagctgctgctaggaaaatcagatgcaaagcaagtttgcaccctcgtccctgggcagggtcacgaagcggcccacatcacctactaagagtgggcaaaaggccagaccccctcttcactctcagtggccagatagggaaactgatgcctcaagtgggcaggagtcccgaagtcacacaagatggggaagctttcaccctagacctcaggtcccccatgccctgggtagcttccctgctgagtctgagctcgcctggctcgggactgcatggggacccatgacttcgcatccttggcctctgctcctgcagttccccccatcctggctgtgactggctcctggttcttcctcctgctctggaggagccagtggggaagacagtcaggtagccactgctgccctccctgccccagtgggtgctttgagccccagggggatgggccttaagtgttcaggcatcgctgtgaggctttcctgggacctttccccatgtcctcattggcaggtggaggagtgttggtatgcagatcctggctgcccctttgccatgcacagcccaatggggagggagtggtgctggtatatatcccggtacacaccccaatgaagatactgggcccggcccctgtagtgcccaggggctaaagcaatagaggggattgctgccccagccacagcgccccagccttcccagggcctgcacatttgtatgtccacaagattgtgcaaccatcactgctatctaattccagaacataatcaccaccctcaaaaataaacttcatacccaactagctgtcactccccatctccccagatcccctcccctcatcctggaaagcaggcctgggacagtcagaagctcagtgattgcaggcgcctgatggcatttgtgaggagggctcaggcctttcccctcagggtggtctctggcgtagggggctgaaggtgggcaggggccttggcaaggcctgccaccatgtcccaatgcctgctgccgcttgttgagcactgcagacatggcccagagtctgcctggggagctagggagtgaacccagtgccaggtggactgtgtggctccgctgcagtaccaggtacttaggacagctctaggagggactgcacggtgggcaagtgtgctccctgcagaggggactctaaccctgtgacctcagcctccctggacctcagttccttcactggttagattggggtgagaatggaacctacctcccaggattgctgtggagatggcagttggtgggtgtcattgatgtagagcagcatctggcacatggtgggcgctgttttcatatagctttgctgtcgatattgccgatgttattgttactgcttgtgttcgtttgtgtgttagcaccttcatcctctgaggttgttttgaccagccccaagggatgctgttgagcttggccagagtacccaagtttgacctctgcacagaccttactacccacccagctaagctgcacagaggaacaaacgtgccacagtgatcagaattgggacactgtgaatggggcatggggcacgtattcccggcaaagagaacagcatgagcagggccctggagatagctagaggtagtgcctggcagctgcaggtgtgactggcagtgatggagcaggagcacagggtctgggaaggacagcagggcccagctgggggccattcaacctggagctcaagacaagccagcagcaagggagcaaggtcaaggtgaggccctgcctccactccctctggcccccagccagggagttgggtggcccccctggtccttctttacacagactccctgggtaatacaggctcctgggctgcactcctcaagatctggctctgttgtctgggatgggacctgggagtctgctttttttttttttttttagaccaagtttcgctcttgttgcccaggctggagcgcaatggcacaatctcggctcactgcaacctccacctcccaggttcaagcgattcttctgcctcagcctcccgagccgctgggattacaggcacctgccaccacgcctggctagtttttgttatttttagaagagatggggtttcaacatgttggccaggctggtctcgaactcctgacctcaggtgatccacctgcctcagcctcccaaagtgctgggattacaggcatgagccaccactcccggcggaatctgcttttttaaacacctccccaaggcattgtcccgcagggtctcagccacattttgagaatggcagggtggaccaggcatcatgggttccctccaccctcttgcccttctgagtcctggctacatgatcttagatcaatactttatttttctgagcctcaatgtcctcatctgtagaatgggaacagaaacagtatctgctgtgactaatacaggagagaatgcagcaaatctcagtaccagctaaagagaaatatgggccagggctgtaccaggccagggaaaagcttgagtcagtatgggcgtgtgtgggtgtgggtgtgtgagatacgccgcaggtctcccagattcatgagtcagtacgcgtgtgtgttacactgtaggtctcctagattctagccttctagcctccatctgctcagggcagacctgagcgcagtgagcagagggcggggcattgggccatgtccagaaagctgaagtgtgacgctgtgctcctgcttaggcccctggttgctaaggctcagtgtggggagaagaagggctgctaccctgttggatggagtatgcagggcatcttcctgccagctctgcccagggcaccatattggcatgcaccagctgcacaggttggcgagcctatgtatgtgagaacagggtggctccttcatggctggccaagtctccagccaagaccccccaggacagtggggagccatggtgggcagcagagcttgtgggaggcaaaggcctgcagagagtctgccatggggcacaggtgctctaggttaccttgaccactgtggccctgccagctgcattcctggtagctcaactgcccaccaggcccagctgcctccatctcacggtgcagctggtgggaaggttagttctgcctcctgggctacaggtgtctgggcatttgttctgtgcctgtggagcccctctgggcctgccccctgaccacctgtgccctctgttccaggtgctggggagtcagggaagagcaccatcgtcaagcagatgaagtaagtgctgtattccagaggcagtgctcaaactccagcttcccctcttcaccctctgggcctgcactgcccccgactacaggcccagccagtcttagccaggcccagaatcttctgagaagcagaaggaccctcaggtcccagtgggtcaggggcagttttcccttctctgaagcaggtcccagtagccccaggcagccgtgggaactcccagtgcccaggggacactaaccttcctggtccctggctatcaggatcatccacgaggatggctactccgaggaggaatgccggcagtaccgggcggttgtctacagcaacaccatccagtccatcatggccattgtcaaagccatgggcaacctgcagatcgactttgccgacccctccagagcggtatgtgccctccgccccaccctctcccacctcccaaaaggtttcggggtggctggttgtggtggctcatgcctataaatcccagcactttgggacgccgaggcgggtggatcacctgaggtcaggaccagcctggccaacttggtgaaaccgcgtctctactaaaaatacaaaaattagccgagcatggtggcacgtgcctgtaatcccagctacttgggaggctgaagcaggagaattgcttgaacccgggaggcagaggatgcagtgagccaagatcgccccattgcactctagccttggtgacagagctagactccgtcacagaaaaaagtaaacaacaacaacaaaaaggttttagggcaagtctcatcctagggaatccaagaataccctagcctgggccccattccagaggtctccctgcctctggcagagtgggggtacattccttcaactgcctgaccacccgccactgtgcccaggacgacgccaggcagctatttgcactgtcctgcaccgccgaggagcaaggcgtgctccctgatgacctgtccggcgtcatccggaggctctgggctgaccatggtgtgcaggcctgctttggccgctcaagggaataccagctcaacgactcagctgcctagtgagtgctctgaggggctgggcagggcagggcaggggctgggggaggactaaaggctggaccggagggcctgagaacccccagaaggacactgctggtctttgcttatgaaaccgatgactgttaaccaaggccttcctgttttttggtttggggggtgggtgggtgtcacgttactgaaaggccaggaggaatgacaggcaggtggcttatacagtacatctcttccaggccagttgagtctgatctgtcttgacagtcttctaaagaacatttgcggccgggcgtggtggctcacgcctgtaatcccagcactttgggaggctgagacaggcgggtcgtgagatcaggagatcgagaccatcctggctaacacggtgaaaccccgtctctactaaaaatacaaaaaattagccgggcgtggtggagggcgcctgtagtcccagctactcaggaggctgaggcaggagaatggcgtgaacctgggaggtggagcttgcagtgagcggagattgcgccactgcactctagcttgggtgacagagcaagactcagaacatttgctgccacctgttctgtgccaggcttcaaggacacagtgatgagtggagcaaagtccccatgcagtgacaatttagggtgttagtgaaaaggtagaggtggagttggcccagagacaggattgctgagctctgaaggagagtcagccaggggaggagtggatgaggggattccaggcaggggcatagcatgtgcagcatctcggggtggtggggagctggctgtgcttgaacataggctgtggaggctggctggagggggccacaggggaggaagttatctgggaggtgacaggtgtgtgtgtaggtcagagcccctggacctcagctgtgaccctcgctggccctaggctgaggaattacaaggggtcccaggaatcccagaggcatgacaagcctgcaccctttccacagttctgaactccttccctgtggtatctgtcatgtacttggactggtgcagggtgctgaggaccccacggggaacaggatagacaggctaatagccattgaggatggctgcaggggacatccacaggctttggatggtgtcaccagataggctgctgtccctgtactctagccttcccctatctctgcttaagccagtcccctctgactggaacacccttttgctcctattgttcatccaatcctgagcctacccatagggtggatttcagcaagggtgggtgggaggaggaggagggtcttgcctggctgtgattcctgagccctgtccaagccacatgaacagcctcctcctacccttcttacatggcctgaatgctcttgtgaatatgtaccccctacaggagctgtggagtcacagccaaatgctgtgggggcccccaggcctcaccactgcccctccctgagatctctggcccagccaccagcgagcttggggtcagagcagcagggaccttggtgcccatgatactcaaaggaagcaggaatagagccacctccaggccacctcctgcttctccatcatcctctttctctattctccagacattaggcacccactgtgtgcccagcacagttttgggagtgaatacaggccctgttctcccagtcaggtttaagccttgatagctccccctgggaatgggttgcggattggaacaccacaggaagcagggctccttcagcccctcttcgcagcaaccctccaagtgtgcagcgagtcagggggtccctggggcgaacccacctgttggggaaaagggagaggctggtgtggaatgcaccatggtacctccacattgaggactctggcagtagggggcggggcatggtatgcgggtcacagcacatgcgtcatccttccccatggcccttcctgtttttctgttttgtccctgctactctgagatcatttccctctggcctggtttggcctgggtgctggtgggagccaagggccagccccagcagccttgccccaggaatgaaaagtcagctctgggcagcagcctggaggcctgggaccagcctccagggcatggcagggatattgaggcaggcagcagaggcaggccctgcaggggtagccttgatactaattaagggaactggtaatgaggagcccctgggacccctgccaagcaggtgtctgtgccctccccctgaggaacccagatttcattgggcgctgggcaaagagcccactggacctggcaggccccaacctgtccagcaccacatcgagggaccgcacccggctgctctgcggctaatgccgtaattgcgcccattagcatcctgaatccttcaccgaaggactaatttgcctcctcccaccctctttgcctatagctccaacatcctggatcctgtccgaggcaggtctggctcagaccctgggtgctggagcttggctggctagctgtccacagagctgcacctcctcccattcccattctacaggtgggaggccgggggctctgagttcaggtttcttcatttgagcaatgaggtaatgcaggcaggggttaaagaaacaagggctgtgcctaggccaggcgcagtggctcacgcctgtaatcccagcactctgggaggccgaggtgggcggatcacctgaggttgagaggtcaagaccatcctggccaacatggtgaaaccccgtctctactaaaaatacaaaaattagctgggcggcaggcgcctgtagtcccagctactcaggaggctgaggcaggagaatcgcttgaacctggcaggcagaggttgcagtgagccaagatcatgccactgcactccagcctggcaacagagtaacactctgtctcaaaaaaaaaaaaaaaaaaaaaaaaaaaaagcaagggctgtgcttgagaaatggcatgggagggaaggggcctcttgcagctggcccagggtccagctaaggaagccccatgctggcccccactgaccctcccaccccccatccccagctacctgaacgacctggagcgtattgcacagagtgactacatccccacacagcaagatgtgctacggacccgcgtaaagaccacggggatcgtggagacacacttcaccttcaaggacctacacttcaagtgagcgagcatgtggacaggtgggaggggcaggacctgccagcctctggggtagcagaggcaggggctggtccaggatcccccagccccactgaggttttacaaggctcatgtgttctgggcaagcacatcctcaccacctagtgaaccagcagtcaggatccacgccacctctgccagctgctcacagcctctgctgctcctgcctgatgtggctgcagcctgcctgctgtccaagctcctggcccagaaccaggggtgaagtgggcaagtgtggatgattccagaaggtagctgccctactctgggcaggcctctgtcctcagtcagccaacctgagaaatggggtagaaagcctcccccaggctcccttcctggaactaaggtgatctatatctgcaggatgtttgatgtgggtggtcagcggtctgagcggaagaagtggatccactgctttgagggcgtcacagccatcatcttctgcgtagccttgagcgcctatgacttggtgctagctgaggacgaggagatggtgagaggatgagagaatgctgcgggtgggggcagcgggcttggggagtggtggctagcgttgaccttgctattctacccccagaaccgcatgcatgagagcatgaagctattcgatagcatctgcaacaacaagtggttcacagacacgtccatcatcctcttcctcaacaagaaggacctgtttgaggagaagatcacacacagtcccctgaccatctgcttccctgagtacacaggtgtggggactgtggggatagggcctccagagggttgcttcttgtcccaagtagcctatggtgaccaggtggccctcaggcgccccccactggacagaagtgtaaccttggaacactggcaggggctggtgcctcacttaggcttgtatagttgtgtgtgcacacatgaagcccttaacacactcaagcatgtacccctgaacatgtgtacatgggcatcctccttcacacagtggggtacccctttgcacatctggcatgtatgggcagccacaaacattgtcatattatgcacatgcatgcacaggttgtatgcctggccgtccacacgcacagacccttgctgcacacgtaggatgcggcctgcctgccacacatgcagcacaagtcttcattttctctcccccaggggccaacaaatatgatgaggcagccagctacatccagagtaagtttgaggacctgaataagcgcaaagacaccaaggagatctacacgcacttcacgtgcgccaccgacaccaagaacgtgcagttcgtgtttgacgccgtcaccgatgtcatcatcaagaacaacctgaaggactgcggcctcttctgaggggcagcggggcctggcgggatggtgagccagaggggctgtggcagggtgctggggaagaactaagcgggcctggagccccagcagggggttctgggggtgggtaggggggtgaacctggagggggaggggcaataggtgaccaggggacaagggaggagaaggcccagggtgtgaatcaggaggtcaagtgagtgaggtgcagggcatggaggaggtcatacaagcaggcctggcccagtggtccagacagaagggcctggccttgccctgggacagaaccagaggccatcctgatgttccctggagaaatctcacctcctcacccaccaggccattggcccagcctgccggaagctgcatgccagcggagcccagccctgctgcccactaccaccagctccatgtgcacctccagctcttgccctctgacttgtctgagcgtcccgggcttaggctggccccactggccctggtggaggtggggatgactctcccagtgccacagactcccctcccccacgtaacccagcaacagaaactggctcctgggcggcaactgtgtccctggtaacaaatgggtaggaaaaatagagaagggtcattgtctagggaggcgggagagaggcacgccctggctgcttcccgatccatgctctgctttcccccacctccagggccaccgccgactttgtaccccccaacccctgaggaagatgggggcaagaagatcacgctccccgcctgttcccccgccgcttttctcctctttcctctctttgttctcagctccccctgtcccctcagctccagacgtaggggaggggttgccacaggcctccctgtttgaagcctgcccttgtctgagatgctggtaatggccatggtacccccttctgggcatctgttctggtttttaaccattgtcttgttctgtgatgaggggaggggggcacatgctgagtctcccaaggctgcgtctggaggggcccctgcttctccagcctggacccccagctttgcccaacaccagcccctgccccagcccaagtccaaatgtttacagggagcctcctgcccagtcccccaaccccagccgctcggaggccccaaaggaaaaagcacaagaagcgtgagacgccaccattcctggaaaccacagtccacctgctcattctcgtagctttttaaaaaaatgaaagtaaaggaaaaaaaaaaaactgcaaatctagaaaactttttagagaaaaactatttaaaactgtcagatcctgaccagcaagcccccccccagccccccttccaagtgactccgtgccttgagtgtgtctgcgtgtttacacccgtccctctgctggccgcccccgtgcgagcggcacccctgccctgccctccacagaattgggttccaagggctgttccagacaactgccaacgtcactgagggccctgccccagcggccctggccccaggctctattaacctaaaatgtagctccctagcgctaacctaggaaccgccgctgcctgctggggggccacgcccctcatgcccttgtcccaggcccggggccttcagcgttgaacacttccttgcttttttcacatgttttatggaattgttcacctggtttgaaataataaaatgtagaaagaaaaaaaataccgagaactgatgggtattctctcccaggggcagaggcctgggctaaggtgtgccaaggtgatggtggtcctaacctcagtcctcaacctgagtcagggccctgactcagctttccgggccgtcctggagccccacgctctgagcttcatttctcccacctggactaggcagcatacatgtggggcccgtgtgtccccgcccttccagtactctgcagccttgggtctcgggcagctgggcaggcttctaagggagctgttgtaaggtgctcttccacacctggagcaggaggggtggccggcctctctagcgcggaaggagaaagtgacttccgacttaggtaccaaggcctgagagtgtccgttgccaaggccacacagccaggtgggccgcatgcagtcctggcttgactaaaaaggccagtaggggccttaagacatattcagaaagttccctgccccagagggccgccgccaaacctgaagggtagtgacaggtggccatactaccatgtgatggttgccccaggctgggcctggagagctgcagatcattgactctgaagatggaaggctccatgaggctgtgggaagggcccgcgcgtttctggggaagggaattgcagatggcaaggctggtgatgcttgtggggcgggccctgagtgccatcgaggcgcctggaccttctcccgggggcagccgcggcctgaacgtgtgggggcgggctcgcggaaaggctggcctcgactgggtggggctccggcgttggcgcatccgcctccggccgccagggggcgccgccgcccgtgctctgccctgcctggctggtcacagaggctgacgtcagcgggtcccgcggaggccgctggacacaaaggcagctttgtgaggcggcgacggctccgcggccgccccaggacagagcggcctgggcagagggcgggccggggtcggcgccgcggaggcggggagggagggagggttggagggttgagccagagacccgggaccccgtccccgcacacctgccagtgccccgtagcttcggccgccggcactggcaggagatgaaaggctgctgccgcccggtcggaaggacatcggcgccccccaggcccggtccccgccccagttcctcgggcctttcctgctgcccctgcctgcgagggccgacgacacggagaacaggatcctgcgcccaacccaggtccccgccttctttcagaggcccaggcctggaccccgctgagccgcagatgtgcgagcaggagcgccagagccccgatgcccgcccagcaggaagcgggcgggagatggttccttccttctgtcctgagggggaaccctgcacagagggaccattgagggcctggcattgtctgcctaactcacccagtgcctccctccctgggtgggccatgcggggccttgacaggattgccctggtgccgtcttggcagtgggtctgggtgggatcctgggggcagggcttccctgag

SEQ ID NO: 17432 - DNA, 9176 bp, Human
actcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggtaagtggaagctgaggtctaggggtctgagtcaggaggtatggccctgttctaggaaggtcccaggagaagaccttgcctaggggttggtcctaatctaggcgttctcagcggaaggccctgtcctggagcatctgatgagggaggcatggctttgccctggaagatgttgaggggtagggaggcccagcctttggagtgctggcctgaggggagatattctgagtggaaggcctgagaagccactcagagactcgatacaaaggggccctacttgggctgggtgagtgtctcacacctataatcccagtactttgggagcctgagatggaaggattccttgaggccaagagttcgagaccagcctgggcaacatagtgagaccccaacctctaccaaaaaaacatttgagacagagtcttgctctgttgcccaggctggagtgcagtggcaccatctcagctcactgcggccttcacttcctggttctagtgatcctcccacctaagcctcctcccgaatagctggactacagatgcataccaccacacccagctaatttttatatttttgtagagatggggttttgtcatgttgcccaggctggtattgaactcctgggctcaagtgattctcccgcttttgcctcccaaagtgtgggattacaggtgtgagccactgtgcccagcctaaaaaattattagccaggtgttatgcacctgtagtcccagctgcttgggaggctgaggtgggaggattacttgatcccaggagttcaaggctgcagtgagctatgatcatgccactgcactccagcctggatgacagagtaaaaccccgcctctaaaaccaaaccaaactagagagtccctactgtagagttagaatcagattgtgacagtgaaccagaagagtttcttgaatgtggatgtgtgcccacatggatctggccagcccagcactggcttagcagctctctgcctccaggatgaccttgtgcagtccattggtgtgagtgcagcactaggggcagccggcgtggtgctctggggggacctgagcctctccagctctgaggtgatcattgcccctttgagcctgccatgtagcacatgctggggtcccagggtgggggacggccatgtcaagattatagagcaggcatattgacacatatcttcccttctcctcaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgagtggggtggggggcgcgggacagctgtatgagcggcgggcgggggtcctgctggatccccttggttgttctcgagggccctgggtggggaaccccctcggccagccccacgcagcttcccataactctaccgaggctggcacgtgccccagcagtcattggccacgtgcgtgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtagctgagtatcctggagcctgaggcagtcttgggactcgcttatcagcttagaccaggagcctatcttaatgcgttaaacacatatgtttactctgctgggatggggtgcctaccacgcacaaatttatttatttttattcttgagggggaagggaggagggccgggcacaggaaggaggaaaatacctaggcacaactttaaactggtcaccaccatggtgggttttgggtgggggacatctaatagggtgtggaacatgttcactgagtggtgtcagccccagacttaggactcagggaggcctggggggaagtgcttctgggtgagtcctgagaggatggagaagagagcaagttgtacaaagacctggcagctggagggaccccagcgcagtggagtgaatgagggaaggctgggctgctccggcaggtagaatagtaagataaaatgggagcaggctgggcgtggtggctcacacctgtaatcccagcactttgggaggccaaggcaggcagatcacctgaggccaggagttcgagaccagcctgaccaacatggagaaaccctatctactaaaaatacaaaattagctgggtgtggtgtcgtatgcctgtaatcccagctactcgggaggctgaggcaggagaatcactggaacccgggaggcagaggtcgcagtgagccgagatggcgtcattgcactccagcctgggcaacaagagcaaaactctgtctcaaaaaaaaaaaaaaaaaaaaaggtggcggggagcagaggccagtgcgcaggctggactttgtcctgcagatgaggggtgtgagtagttcttagaagtagggccagcctggtgatcacaccctgtccaaaactctgccacagcagccaaccttgccaatgtcagcccttggccctggacagaccccacacacaggagtgcaccagccctactgaactgacccttggctttggtttttcatctctgagagggacaccattctatcttttgggattatgaggtcgagtgaggtacccccagccatccctcatcagtagaggcaagttgagtgtcctattccaccttctccaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaaggttggacctgggggtgtgtgggagacttaaactgggcagacactggcccttgctgcatgggctgactggaaagcatcccacagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggtaggggtggctgtccactgggagggggaggggatctcaaagaggcccccaagccacacatatagctcagcctgccccttccctaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggaggtgtgtgtgagaacatatgtgtcctagcaagggtgcacccccaggcatagcagccaagcccagttgtgttggcacctctaccctgcagggcggtgaatgcgaagaagagatagtgcgcttcggctttgaggtgctctacatggacagctgggctcggcaccggatctacgctgccttcaaggaagtgctgggttcgggcatgcaccaccacctccaggtgcggggacggacagggaggggacatctggtgtggttgcttcagtctggcctgagctcactgccctctgccccccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttccacgatgtcacctttgccctccaaggcagtcttccccaggtggtgcctctccccctactcagagcccagcctgtctttaagagctgaggctggaccctcactgggagccctggcagagtttgggtgattgctatgggggcagctatttctagacttcagaacctgccatctggggtggccagagagtgttgacaggccacaggaggagccaggaggctggtgccccttcccctgaccttgggccacccaaagcgaggctttggcaccagaggcttggctaggcctggcttgaagagatcaggagagggaggcagccattaagttaacaacaggttcttgtacaaaaatctcaccaaggaaatagtgtagatgtggcagccagcagtagggaaggagagacctgcccatagccactttattcccccaccaacacacacccccaggccccagatccaaatggcatctcagctgggtgcttgggcctcactggagttgagcctccgaagctggctgaggctggccaagcggagtttgagtagtgtctcctcctgcgtgcggagcgtgtgtgccaggatgcgcagggattcactctgcagcactgtgaatgggaagtgggggatcatcagaccatgtgccaccccgtgacccctgcagacccagcccaggaccaggggcagccacgggcctcccgccccatccttcactgctgcagcatctgcagttactccttccagctgcacagaagggcctcccagtccccactgccttgctttccattcctactagcaccctatgcgtccataccgctcaggtagacagccaggagtgcgagcactaggcaagtgagcaccagcagcgcgagcagcagcaggaaccctcctcgtctgtacacagggctgcagccagcctgggcacacagtgacggcggcaaaacgcccagcagctcatcccacggtcgtgcctcttcagttagataggggcgcagtgtgcctgctgggtggatgggacattgggagggtggtgggtgcacctgctttcgtcccctcccccagcacatcatccaccccactgtccccactcacctccactatgtaggtcgctgatggactccacctggtgcaggcatacctcatgcacgtggttgggggccaatggccccctgctcctctggctgggcatcattggcgccacggagtctgcaggggcagcgcaggctgatttagccagtggtgggtcaacccccttccttctaccaggtggcttcaggcagcaaggacttgcggatgatagggatagtgggacatttggttccaaatcccctaaaactgactcaggaattacccttgatttggatccaggatgatcccagacccttacaggcttattctgtatacaggagcaacaggtacatttgatttgtttccttccaagcaccccagggactcactcaggcattcctctgcctgcttatttctagcagtttatcagccttgaatgctaaacctgcagcaaatggaattcagtcctgcctcttttgtcagttctccctgcagacccaatgcctggcatcttctggtcagaaagccctattgtagccactctggtgcctttccctcctggccttggttctgtgtttgttaacatactcagtgtgactctgctgtacatgtgtgaaccctgctgttttcattcaacatttactgttggggagacccttctttgttatactgttgcacatgcctctgaggtctctcccttcacacatctccctgaggctgcctgggcatctaggttgtttgcagtccccgccccccttttttttttgagacggagtttcgctcttgttgcccaggctggagcgcaatggcgcgatcttggctcaccgctgcagttcccttttgaaattaacccccaggacatccacc

SEQ ID NO: 17433 - DNA, 101349 bp, Human
atatactttatccttgacatcacaattactttttcattgtaccttgttctgtagtttgacctaaataggaaaatgtaaggtttatgaaattgttggtgatagtgacaaaccatttattacttagtattttcactgtcattattactgaaaaaatatagaattggtcttaattcattaagataatgcaagacatgacacttagcaaaacaaaagcgatctcccgttcgaatcaaaatcaaaccaattgttagttgtcaatcacctgtgcagatggagaagctattaattgatagtaacctattcttgagtaattacagactgtatatgtttgagagaatttagaacaaaataaaatttttaaaattctctacctaacatgatgtaacttagagtgcattactgagagtaataaacatactataaccactaaagggccggaaagcattgatagataatttttcagcacaacagttaatgagtagacccctgtttttgtttttattgttcttaggtttgttcatagtaaatgttgtggaaacaaagtgataatgctaagtcatgtttggagagttgtaatgttcctaaattagtaccaggtaatacttgataagtttacagagatatagttttaaagggatttgattttccttgaattcaaactggggattcatttggaaggtactattagtacctgacttgtgctggggtcaggaccttatggaaggacttgaattagagtaggaaaatacctggagacagaaacatttccttggggagttcatgcttttccagtttactttatcctcccaggggaatgaaaaccaaatatactcagatgtagacacaagatactaaagaataatgaacttggccaggcgcagtggctcatgcctgtaatcccagcactttgggaggccgaggcaggtggatcatgaggtcaggagatcaagaccattctggctaacacagtgaaaccccgtctctactaaaaatacaaaaaaaattagctgggcgtggtggtgggtgcctgtagtcccagctactagggaggctgaggcaggagaatggcatgaacctgggaggtggagcttgcagtgagccgagattgcgccactgcactccagcctgggccacagggtgagactccatctgaaaaaaaaaaaaaaaaaaaaaaaaagaataatgaaattcagagcaaataagctcctaaaacccagactggatcttacagctagctacctctgtcacctccctttttccttcttccaagacgtaaaatgtggcagggagtaaggttatggtgtctcctcgggaactggccctccaacatttgcccacctttatcttctgcctgcttgggagaatatggaacattgtttaccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgtcaattccaaactctgaggaggctgatcacctgaccactacaatcatcaggatagaattttaaaataagattgtaaattgttcactaaaacactgttagtggggaggagaaaatagagtttcaatgtgggaaaagcaaagggacttacatatttttataatatttgaaaagccattaattactgccttcactttccttttttgaaaattgcatcagggtttttgggaggtaacttccttccctccagaagagaaacccctaaaaacgatcctcacacaaaacctgagaaaacatgagagcaatgcttttgtttctaagatgttagaatccacatatttattaggtttttagacctcttctccctcaactccttttttttccctccttttctttaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaaatttgggtataggtaggtttacttctgtatacctttttgataactgaaaattttgaattcagtatatgagaatcagtccacgttgccacaatattgtctctctgactatattgtaagtgggaaggcatttctgagtcatttgtttccattatcattcttcaacctgttttcccctagacagccccatgtgtactgagtagcacaccaatatattataatttatccttctggtgtttgtaataccatttggtgcttaaatgtcatatgctaatgctttgtgacgtgcagggatatgaaatctctagtaagtaactttcaggttacattaattagcataaagctgaaacatggcttctacagatatgaagcaagtacaagggcactgacaccatagaaacttgtcagaagggcaagaagggtgatgtctttagaagagaaacaggacattctcaatctacttcttcaaggtaaaataaatagctttgtaggtcacttatatagtgttaatcaatctacaattcataccacaaagaaagctgaaactattagtatggccagtactgccacttgtacacctgcataacttaaaagatgctttgttcttcatgacccaaggatggaaaagatggaaatgaagttaaatctctggattgaagataaactgaagaataatgaaccacattccatgcaagagatttgtgactatgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaaaataccttgaattcaaagtcctgctgattcttcagtctatttggtgcttcaggtacatttgccaatatgcatcctcatggtaaggttgtctttataactagccacatgtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgactccagaggttattatcataagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaagtttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgcgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgataacagtatgcagtctttctttggtgatactggagaccctttggatcttgcagtagctcaaagttattatcactgcaccaataatgtgtaagagtgtcaattaattcagggttctgttatcagaaagccaggtatcagagactgctacatcctgaatggtgcttacattcttggttctgcaaatgtagcccatccagcttagcaaagagtgttctttggaaatcactgccctgcccttttggaaacctgaaggacatggcatcttgcttgtcctctagggtcagtgctatgccccaatagaagagtctcttgtactactcctttactcctaggaaacccgtgttgaaatgggaagaaggtggaataaggacacactctccctatctaccagggtctgtgcttccactttaaggccaatgaatggggaaactgggcacaaatatggtagccccgtaaaaccaacagacagtcaaatgcaagagaagtatggaatgtagggttgggagatgtttacactaaggtaaagaagccacagggagaaataaactgagaggaagtaatgactgaaagggagattaggaggtggagaagatacagaggatggatggaataagaggggaagacagaagagtgctgtatcaaacacgcagtttgatatgctttaaaaaatggagtgttgcaagaagaggaaaattgacaaaggctaagggatatgaagttgctttccccattaaggcaaatgaggcctcctttttctcctcagacttttaccctatataattatccacatgatcagaagtgtctagttaggacattgcctcatctttgctttttgttttcaaatgtttcccatcaaagttgttgcatatgtcaattgaatgcaaatgaaagtggaaccagtatgtgttgcctagagggagatgagtaagaggtaacttcctaatgatttcccagaataatcactgttgctgaatgtttttgaagatgataccactgaaggtgctagctgtttgcatgtgtgagtgggggtgacttgaagggctcacatgtgactatcattttacttcccccatcccatcatcctcacggaacatctgacctgtgaattgggcttgtggtcactcttgcagaatcaggtaccacattgagttttatctgtacattaaagcctgctaatttgtggaggacatatgttgttttccatagccactgaagacctagcaggagaaactgggcttaatattccaccagagagaatggaactagacataaattccagataggctaattggatgctataggttactaagagtgacattttctagaatcttcattagatatctcatggctttagcaagttctacatgaaggcaggagaatggaccttccaccatgggccttcccaactatatgcttttgagatttgctaatataataaaagatattataataagagcagtgaatgtttaagatggcccagtttaatcctcttttctcagtagttatacttctaaggatatcactcataagatgaaagtgctaggtctaaacatagtcaccctgttacttagtatattgccataagatgatgtattttggaaagccgttataggtgtattacaatgttcaaaacctctcatatcagttaccttcttcaaacttcctatgatggaggtaaggcagggattattcccattttacagaggaaggcagaagttcagagaggttaaatgacttccacaaatttgctccactacttaataacaaagcaaggcagacctagaatttggatcccccaactcctagtccagtggtagttgaagactatactgcttacataaaatgagagtagcttgttttgtaaacaggtttcagccaatggaatatgcaaaaatggaatttttacagaagcaagtagaacccaggtgcctcagtggttacaacagtagtcatacctttatcctgacaagtttttcctcctgagggcctaatttgctaataggaagtaactagcttttgtaaaaaagaaaaatatggaatattaaaatagaacacaggagtggtgcacctatcatccctccccttagattcattcatgatccagaatgtaaaagatatttgggccgtcttactcatttaatgaacaccttccttttctgctcagaatcaatatgtattcgcccaagatgctaagtttatgccagaaatatgtatgttatgtggaatttcttttaaaattcttattcagcgtgtactgtcagttgctttaaatacttactgccaacaataaaatctatttttatgcctatctttctattgtagtcaccacatatactttcacatatttccaatgcaaaaaaaaaaataaatttgtaggcccacacaatgatagtctttataccaaaaaaaattttaggtgtaaacaaaagaactgatctctccctgtgtacagggaaatgtacttcttgtaaatccaggagttaagaaattcctgtgggttccctcttgtaatatgcccccaaacaggatgtttgtttacagagcagatgtctcagggattagaacatgctttgcagaaatcagtccctctggaactattgctctcacaaatgagtgcctgcctctttgaaacctgcagggctgctgttgtcataggaagaactattctgagacacttactgttacctaagtataaggaaggcttcagaaggcttccctaaggagggttatggcacagtgtgctctgtgacccacaaatcagaggatgaagcaaaatggcatttttttttaataaaaaaaggaaaaaccacagtacttaattcactttcctggtagctaagtagacagtaaggcatttcatttcttacaggccaaaggcaacattttgtaaatgacttgtttggggcactaactgacagccttttagtaacagataaatcaatggaccaccgaaagcatctatcatccagctaaagagtaacgaagtcactaaggatcatttgttagggaaatgaagaatgtcacccataggaggtggatggccctttaataagacttatatatcctttcaacatggatttcccaaatcaaggctcaggaatattgagatgaaaaataggcctttaaatatgacagatctctaacctagccatctccactgtttctgccagaagtggtccctgtgactacaaaagttgcttggctttaggaatatataacactgaatgaatacagattgcacctgggcagggtgagggggacaaagggtggaaagaaggacaagggcttctggtgtcaagctagggattatgagataagtgcacctcccaggagggcctcgaccccagcaactacactacaagcctcctaacggaatgttttattaggcttcctttatctcaaaggacttaatggaagaccacaggatagagacatatgggtatccagccaatgcacaaatctgggctgcattctgactttgagcacagatttaatttattagctatctcagtttaaaagttagatataacagaatctggagcatgtttttaactgcttatataccactcagaaaagagttgtgcctactttttatgtgcctagctctgtgctgattattgtgagggatactacatatgagacaaggttccctatcctcaggtaattttcaacatagttgcagaaatcatacacacacacacacgccgagtttgtgggaaatgtccagtaagtgatcttagagaaaacagatacagtggtggggaggtcctccccattccactcccaccattcattcttcttttccacctgagtgaaacagcaaccatctggaagcctgcccccaccatggcatgtgtacctttagcagcacacagctatctagcttgtcttctcacacctttttttgttgtgtcattcaactattcaaaaacctttctcagcatattttgtattactacctccgatttcatctttcttcccttcctgatttccaaggctacaccctacttatttattgtgtcttctcatttcctcatcaacatgcaatatgcatccctacttccaaccttttacctctactgttcttcctcgttgagatgacttacccttgcatctaggtatccagtctttaaggcccatttctcaaaacatacctcctccagtaagccctgactgtccaccacagatttctgtgatcttttcttttgacatgctactatcctatattctgcccaacttagcacctaattttctttggtagtttctgttgctatttcttgtttattaaggttatttccccagttagatttcaagttcagaatattactgaagtttctaatgaatcacccagaataacctgtcactacagtgatccacaattcaatatagttgctaactgactcactgattcaaaggaaaggaagctgggacagtagcaggaggaagttgtgttttagagccaaggttgtaaaatgcttgcctcatagaactagtcaaactatgtgtttatttttctttagaaaaattatttctgcagtaaaaatgctttatatgatattttgcttttagctttctgtattaacaaggcttcaaatgttgcttttaaaattatgacatgtaccataatattttgcatgcttttcattgcttttaaaaagatgattattgttttgtgcttttaggctaaatttatgtaggaaagcatttccctatgtctgtcttctgccatcctttttcttttcctgcatgctctgttttcaagaagctagaaagagttctaaaaaataaatctgaaaatgaccatatgacatccagtgaataggcccaacaaaacttccaggaattttaggggaagataacaaatggaactcctacaacaaggaagactcaggtgagagctttctaaattgctttcagaaggcagccatagcaccatccagggatttcatcttgggggagaattggttgctttgctcaaccttgaaccatgcccagctatgttaccatatatgcctttggccccaaagtggtacctggcaagaggtgtgcctgaatgaatagagtcatccccactgttgggggaaaaacagcaacaatgccaccaaaaacaacttcaactacaaaaacaactgtaaaatatactcctcacccttaggccttcttggcagacatcgatcatcttctcctcttctatgaacacataacagcaaataggcatgacctgtccccatatactgggccttatttcatataatgaaggtcattcattcatccattcattttttgttcatttgctttttcattaaacattgagtcagatgctgtgctagataggtgctggggtacaaaggtgaaaaagtcccagtccctggccttaaagaactgaagctctagtcagggacacagataagttattcaatgattagagtttagtgtgataagtgtaatatgtaggagtgagaactgaggagaggcaattattcaagactgaaggaaggggtggttagggaaggcttcctggaggagaggattattgaactgaggtgagtcttaaaggaggcatagaactagccattaaggagtgagtggcatgccaggtagaaagaccatcattttgaaggcagcaggcatgacacgctcttagttgagcttctatgaatacaactacaagtagttcagaaaaactggtgctctgagagtgggagaggggtagagaagaagctgtggatgtaagtggggaccagatcctggagggcttatctatgccatgctaagggctttaaatttgattctgaaggcaatgggggaatattgaagcagggcaatgatatcagatttgtgtttcaaaatatcactctagccacaggaggaatcgggaagagggggaaagagaccagtcaggttgttggagtcatacaggtgagaaatgagagtggcctggcttaagggccactaatagcaataaaagaggacaatgcagagggactatttagggaggagaattcatagaactaggcaactaatcagatggtgagaggaagagctggagaaggttgagttaggaaacaaaagaagagttgttatttcctgtttttgatagagaaaagcacttaattagttagataattaatgaaataattaggcttgattttgaaaatatttagtgtgggggtctgtgaggcacctaaatagaggtgttcaatagccagttaactacatggggttggggtgcaacagagatgtcatggccggaggtatatatggagaatcactagtgtcagtggggattgaaatcatgcatgtggatgagatgacccaagggagaagtgtgttgatgagaagggatgaagagccttctgcaaatgaggctgagaaagaaaactgagaaatgcagaaatagactctaagaaagagttgtatgaaagaaggtgggggaaatgttagcttcaagaagttcgtggtctcaaatgtcagttttgactgagaggtccacacttgtaaggacagaaaagtagccattggtcaaggaggaggctaatttgtgacttcaggggagtcattacactggtttgaggagtgagagctaaggaaatctagattaccttttcaagaagtttaacctaaagaaagaaaagctaagactataacagctagagaagtatgtgaagaagcagaagcattttaatttttaaggacaatagtgatctcagcatgttttttaagccaaaagagaagtgccagtagagagggagagattgaggatacaagaagaaatagagcataattggtggattcactttaggtagaaggtggcaggagtgagacaggagaagagaagaagatgctactgctggagataaattcataggggcgggagagaaagtgaaatcaaaggaataactgaaaaaaaaggagtccctccatttatctcagtgaagtagaaggaaggtcatatgctgaaagtaagggaggagggggtagagctgaagttagagtggagttctgaatttctggaatattgggtgtggtgattggaaaaggaagttggcaaggggtgacgaaactattgtcaagcaccattaatgacccagctatcataagcaccaaccaatctgcatggctgtgtgatttccctccagcaactcttggcagccttgacatagaagtggagagctttcatggttggattctattagggtagggtttcataggacaattataacaagaagtcaaagagtgaaattttccaggacagaagcataagagcaatttacatgctggacgatagagtctcagccagaaggaagctgagaaattggctaaaaatggcagtgactagaatgatattttgaaactcaaatctgctattattgccttgtttcaatattccccattaccttctagaaatggaggtcttgttgagatcaaagaacaagtaaaataggagtaagcacttgaaacaattagcaggttagccagatgggaagctgagctcagagaatgagataacaaggttgaatattgcagagaaagggttattctggataataaaaagatctggggcaactatggttcttcactctggctgtgcattatctctggagttttaaaaattcatttgcccaggtttcatccccagaaatcctgatatagtaggttattggtgggctctagatattggtattttatggaactctacaggttattctgatgtgcagccctgcttgagaaccaatggtttaaaagatggctgtgggaatgattgcagaagtggaagggaggtaaaattcattagagttgagagagatcaaggatccataaggaaagggtatgaaggaggtgtccattaataccctgtttcacacagtggtggcagcacagaatgtaggaaggaagactgggagccaaagtactcaatggagaacaacgcacttggccaggagaactaggtggtgataatctcaaaagagaggattttgtaggcaagtgtagaagtactgatctcaaatcatttggagtaaaaaaagagaaagtctgccttctccattctctcaggactacaggcttgggatgagaaagggtgagcagcctccaccagtcttatctaaggaagcggtaccctcactggatagtagagtctaaagtcattgttctcagtcccagctaagtaatataaatacctgaggagttttaaaaaataaagatgcctaaggctaccccagactaactgaatctgaatctctggagatggcatctctctttttttttaagttctcagatgaaaatgatgtacagtgaagtatgaaaacctaaggcaagaggtgaaggaagaggtagaaaatgtagaaaaaaaatgtttctgataggacaaactcttgcaggtaaaagaactgcagaacattggggtgggcatataaaaggtgatagatgactagagggacttctcattctttatgaagtagtagaatagagaaagatgtcaggatgagagattctggagagattagctagccccaggaattacaaccagaactcccaatagatctcaaggccaaatgctgtttgcagtttgtggtccaggcagcaatttgtagccttgttctgagttccaatagaatatgggaggtacacttagaaagtgatacttttttggacttctgctctctgcaaatatcaacccagatagctgaccaggttgagctttaagataaatgacaaatgctcacagaattttgcagggtgatacagacattttagtgtatctaaaaaacaaaacaaaagaaaaactggttttcatctagggtctagtttattgctaaacacttactgaaagctagagctcaaatcttttttttttttttaatgccactgagtaataaatagtttaactgttgaaaactttggttctggagacaaagtggggacgtagattcaaatcctggctctgatatttgccagctgtgtaaccctgggtatatgatttaaccccaatgagtcccacttatctataaaacaagaacaagacctgcctcatatgactgttgcggagattaaatgagatagccccagatacttggcacgtggtgagtgtcccattcgtgatagctattaagtctgcaggtacaagctagttgctggggaatgtgagaataaataaattacactctttactgtcaagtatctcaaattttagatagagaggtagatatgtaaaaaataccaatcctatgctgatggtaccaagctcaaagtagacactgagtagttctatgggagcatgaaaggacaggcatttaactttgtctgcagaggggagataggaaaagacttgccaaaagtgaaaaagcccaagagtgagtctttaagagtaaggactaataggagtgatccccataaatttgggggagagggtaagaagtaagactttccaggcataggtatagcatgtataaaagcttggaggtatgagaaagcctggcagtttagggagcattgaatgtgtataagtagtggggcacatggcaagaatagagaggttggagtggtaaacttaggaacatatcatgcaggcccttggatatcatgctaagaaacatgaacttttaacttatgggtaataggggacagcatttaagcatcttaaagtcaagaatgttattcaggaggctgaggcaggagaatcgcttgaacccgggaggcggagtttgtagtaagcagagatcacgccactgtactccagcctgggtgacagagcgagactccaccaaacaaacaaacaaacaaacaacaacacacacacacacacacacaaatgcaagaatgtgatctagccacagagtagagaaatgaatggaagtggataaaattggaggcagtgatgctaagtgagaagtgatgaagccttggactaagttagttatttgtggggatgaagagaagaggatggattcaagaccagtttaggagatagaatatacaaaacttgatgatgaattagcatagaaataaaggagtgaaagatgactcccagattcttggtttgggcagctgggccagtgctggattactcaggagccagaacaagcatttgtatatggcatctagtaaatctgaagtacccaaaatgtggaaacagtttaattttgaatatatagcttaaaaaaaagactcaatcaccataggaacatcagaaattttgcacttccttaattgtttatgccttagtattgtttttatttgaattgcatattggagaggaggatcataattttttttcattgcttagagccgcctaaaggaggaggagcctaaggccttgcttcttctctaatctgcgtggttagtggtatcatttcactgtgatagagaacaccagaagaggagcaaacttgggcttcctgcctttgttatgcttagccctgagtgaagaaaattgcatagttaggctgataaggcattggcagtctggtggccttctaggaaaacaccattaatccaattctgcatgtaactcagcccaagtggagtgttgagtcaatttgctacaaatattttgccaatactaatagaaaagttgggagagtttatttgctgacaagaggggccatgaattcaaattgatataagatttggaggtacagattaaggtaggggctcttaactcagagtccaggagaattatgaacctgtgaaagtatatgtatatagtacatttttatgggcagaagttccatagctttcttcagatttttcagaagattgaccccaaaaagcttaccaagagctaattactgtgaagtgaatgaaactgctccttcagagttactcacttgcctggaacccttccagggccctggaggggccccggtacatttgtatttgtaattttataatgtcttttacttaaagggaaccttcctctcaaattacatgaagtatttggtcccccaacatgtggatccacccctgccaaccacagattagggaattacctaacatgagttagtatttgggagtggaggcaatccaatagagaaagaaatgtagaaggccaaaaactgtactagcaaaggcaaaagcaatgacaatcaaagaaagaaaggtcactgagaaaggaggaatgccaggccacattgtcaaggaagtagaaagagaagtagctagccatggccagcatgggtgggacatcatgaaagagaaaaagtaagaaaatgattacaggagtggctaggacaccttcaatagagtgatgacaccagagtgcctttctgaacaagtaaaaaatggtagttgaacaagtataaatgttagctatagttcacaaacattcaggggaagtagaagtaccaacagaaaactctaaacttcactgttaggataatattcatgaataaagtaggctcactgtaaaaatggaatctgtaatgagggtaagttatatggcatatatgtattttttcaaaatgaatcctaaatgtgctccatggccagacaaaggccttgggtgactcttgttcccctgctcccaacctttctttcctgatcctgtatagttcctctcactacttcagttttcttatttctgccccatatctctgtcctgtggctggagataaggaacagtgagagagagtggaatgagacaagaagccataagaatagcctttgaacatgaaaagttttgaatttaaaatttatcatgggtaacccacaaaaccaataatccatatacggttgaatgttgtctgtaattcaggccaaggcaacatctatttgaaccagaatgttctaaattgaccgccctggcaattctgaagttgattggtcttaactgggtaaacctggttcatgctgacttgccctgtattaggagggtgagtactatttttttcagtgtgaaatgcagcctcaccagagatacatgctcagatctgctaataagtgtgttatggaagcgactagatgccattttagagtgtttccacagtgacttcctcctgggaactatttccagatagactatagttctcaacttagtttattcagtgattatatctttataggcttttaaattatgagctactgatacatttatttataattatgtaactatgaaaaatctgctacttgaaaaagacaatgatttttgaatggctgatatgacaaaatataatggaaacatggacaaataactacaaactagaaaaactaaaccaaagaatggctttaagttttctgaaaactaaataaaattaattcagtaaaaaaagcagcaatttgtagctttttactagcaaagtgctgggtaggaaatgattgaaatatttttaataataaaaaaggtttgtaacataattgatttgcagtggtattcttgttaatagaagagtctattaagatatggttaataatagaaacatgttaaattaaataagtaccaaccacttgattattagctatcgttaacatagaaacaattcacaatatctttattgaaagctgaagtgcttttctattctttctaatagtatgccttagcttgacttgtatatgatgaatttcttccttagtaagtgatatttgattcaacaaagccagttaaacacaatatccctagatatctcctggttacactggtaaaaggcataaatcagtttgaatgagagatttgtttcaaatgagttttggaaattttgaattatttggatatgacatttgtcatcaccctcttagctacttctgcaaataattggaatttctggagttaagtgttgttaaaattgtgttggaatcaattgtctttcaactttgtaattgttttgatgaacctaattgtacaacttgtggatgccaaaactataccccaaataaatacatgttaacattttgcctttagccaataagaagaaggagaaagagcgcccagagatctctcttccttcagactttgagcatacgattcatgtggggtttgatgcagtcaccggggaattcactgtaagtaagctccttgttttgttttgtaagccacgaaagaattcctttgtgaaaatagttttcaagcaagaattgccatgtcccaaaatgtcagacttaatatttttgatggttccaaataagatggacattgcctaggcaatcatagatggaaatagaggatggcaacagcattgaccaaattattttgtccatcttttaaaaaagtttgatcactgtatagtctcaacttggttgaaaatattaactaaccatggcacagaagatgtactcctggcagacagatactgcctgagctttttctttatcaagtgaatggaatcagagaatcatctactcaccttggccagtgaaaataattcatctgaataattcaggctttacattaaaacctagaatacccagatcagctaactacgctaaccaagaatctctatggaactgacctgtttttccctttgatttctagaacatagataagttttacaatttttagtaggtatattttgtagattttcaaaaaacaaaccttatatttcaagaagaaatattgatggatatatcatgtatgttctagttgttttgggcatctctctcctctctctctagatatctctctctagagatgtcatgcaatccatagtacataccaataagaattcgctggacagaccatagctatagatcaagccttttgctgaatatttgtagtgctcaaatagcacaagatctcagatctatggaattttatacttttcttttttaaaaaaaaagaactggtatcttttttattttattttattttagctcaaggagagaaaagatgtggctattgctagaaatatgtccccaggaaggtcaactaccttttcccatactattagtgaactccatcaaaatgtacattctgaaataaggagtaattttgagggcatttcaaaaaaaatctttgatagagccatcaccatcaattcttgggctgttaaaccagagagaaatttacatattaagtagttgagttttttgtttcataacatagtagtgaatagactgtgttatatgattaagcggaaaaaaagaaggaacaaattaatctatgtggagaagcaaacaatgttgctgaattgacagtcaaattatcttatttcttcaattctggaagtaagtgataggagaatggaaatggaaacagtaaacaccttggcctcataaagtggtgtaagctgattatttctgcgttctcagtagcaagcagaggagaacgttaagaaatattgacacataaagtggagataggtaagatttaaccaatttcatcattaaagtcagagacattactcaaatggctttgagtgtgaacccattctttactatatttgcagaatattctcttagccacacttagatactccaaccttgctattatgactaccaccaccatcatcaccaccagaaaaaaacgtaatttgtataacctgaaaaacgttctatttttaaaaaattacaaaaagattgtaactatttttgctgacacttgaaacaagaagatcccttaaactttataaaaattttgcctaataactcttcccttttttattaatttttccagctttgacattttaatgttctctgtgcttttcctcatttaaactactattgtgttttattgttgtcattcactatttttcttttcttttttcttcctttttgttttctgatgtgaaaattttctcatccagttatctcatgtgatattctagttgctctccaatattttattctttccacttttcaaacttacttgtcatcttatgatacagtatatctctagctctttcatttatcattctggattctgaatggaaatgaaagaaagtaaatcaccaccatcttgctgactgcagcaccagtcattttcaatttgctgtcaattagaacccaaagaacccaaagtgatggactatctttccaatgatgaaaaacagttggatacaaccaaaccatatgaaacaaatactcctctccctactaaaaatatccccaatttgaaataagatagctgttcggaagtattccattgttacgaatccattgaatatatagaaagacataggctaaatttggaaaatggaagtactttattgtcatcctgatgatcttttgtaactacttgttcatacattattcttaaagatgccaaattctgccctttttggtacttttttaacctgtgatttacatttactatattattatgtttattaaatgtaaacatgccaaattataaaaagcttttaagaaagtctttttattggtaggatttagaattgggtcctaattgtcatagcaccactaatttattgtgtgttgggaggggatcatattaagtttgattatcgtggttgttgaggttgaattttgtgcaatttgctgaactatctaatccagttgtcttacaagggcttgttattttgaatatttggacactgatttgctgtgttgcttggtgattactctttggctaattggcccatatgaccttgtatacctggtcatacacttggaccctgaagctaaaagtaggttgggaggtgagatttttggtattcaatgattataagtcctcatcctttatattgccatttttgtcccaaatacttcagaactcccctttccagacctctagacctgtgacggtcgcttcaagtcaatcagagggaaaaatggtatgagtgatataaattatcatttcttatgataagataaatgcttggcctgttatatcgtgctgccattctcctgggctacactggacaacccccagcttaatttacttctagttggtatcctatacacagtcagacattgatatgtgctcctgcttctgatgctcaaactcctaggtcttcattagctgtctaacttttgggattagttcctcaacgtggcataatgagatggctttatgactatgtgcctttgtggcatacattcaaatttgaatgtcgggttttagtgataattggatttgtctcaacttagaaaaaagaaatgtcagcagtgtagtcaaaattatgtcagcagtgtagtcatgtggtaagtatagttgtctggaggattttctgctattggcagcattttttcctgctgtctagtgatcataaaactatttatcacaaaagtttagaagtgccatgggaatgtataataactgccaatattctaatgattatggtaatgattatgccagtaatgtctgctctagtggttatgtgcaatgcatacctcaatttgtaacacttaataactcctttggccattacggtattaacaaatgctattaattgcacttagaatcataactgggatcatgcatgggctcctgagttcaaatttttggcttaaggctttagcatctagctgcgtgaaaaatgcatgtaaaagtgtcgtttcactgtgcttggagtaaccctaaataccaggaatcaaggacatatatacaaaatcaagccagttgggtcaagcatgtttctgtagcatttgagatatctttatttaggcaaagctgttaccttatatcttgtcttattttgtgggaagtgggattttagaactgcagcactaaaatggaaattatatatatatggtttgaaatggaattgttcccctttccctggtctaaatatctaagaaacttaacatatagagtctggctatgtgggaatgttctttatctagttttctctaagccagccatgactttagctacaaagtgcaaaagaatcacatcaatgagaataaaattcaatgtttccatacagccatcctttgaattttagccacatacacacttttgaaactaaaattggttaaccagaattgggaactgaaatttgtaagtttatcacatggccattggctacctgtgatcacccagttataaaaacaacttacaaattattgtcaaagcttttcatgatgccatccttcttgcctccaaattcatgtttctgccttttaataatttctccaatcatttaatggtaattcttattaatacatatttatggaggaagcatcttgccaaaagtggaattatacatccaaactttgaagcatcgtcgttctctctgttctcttaaatctgttgtcctgtagcctgtcctgtccctgatttagttaaaacctccctattttcataactgccccactttagaagggactccccccattcagacccattggtttcatctcctcccaccttctaagttgtcccacattctgttttaactttcttttctttctttatttacgtccattacagccagatctctatggctcacagatgtgcccagggaagctcccagaggtgcgtcacaggcccaaaagaagcttgcatcaaagtgcttctttgagatgtcatagcactgcagcagcaggttcatgtgtgtgcagtagagttgttgcttggcttatctcactttttttgttgtcattcccaaactctggaggcccacgtcacacattgttttgccgagacttcataggataaagccacataaattgtgtctggatgcacttcaggaatagtgtgtctgtttctctctccaagttgctcttggaggttggataattatgaaattgggacttctgtaggctggacatgtaggaaagaatgttgaatgctcaatgcaaagctaacctctaatttttgcaattctccttggttagatttccaaatattccctcctctctgctctaaatgcttcagattattataaattatcacaaggctttgtcgtggttttcatagtccccaggttctatgtggcctataaatgaagtaaggaggaagggagagagagaggagaggagaaggagggcatgccctggagaaagctgcaggggaaatgcccaaagcagcattaatgttactgtttagcatctcagtggttcttgcccctccacaattctatttttgtctcctaccaacctgcctttatagtaaagcgctagacccaaaaaattacattttgtaatcacaaagtataacctgaccaagggtgatcctttccttttattctaaaatatattctgattacaacatgaccagaaacagcttgttattccagtcataaaatccattgatctgcactttactatgctgtgcacaaatttagagaagtcttgctatgtctgccctgagtcgccagaaaaaaaataagctaagccgtaaacatcatttcatggatgagcagagtcaatatggaggtgattttcatgcgcttttttttttctatcacagtcatactcccacccaccctttttaagttggatcctagttttacctatgtgttttaattagagaagagaatgattgcattattaagttactaactttaaatctagaatgtaacttcagtttcccaagtgtaatcctacaggtagcatgggcttcttggtgaagaactttactggaacataaaaatgctgctgcagaatgttctgagctaccattctttccctttggttgtccacagggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggaggtaagaggaagtctgtggtatcaaaggtgaaaaagtaatttcaatttcagagtgtcatgttgagaacaaaatgtctgtgggacatttgaaatcgattctagtaccttcttcaaatgacatcaacataaggaaaccaaaaaatgagttggaatttgaggttgatgttaagttatataactcaagtatgtttagaatcaaaataaggtaattatttagtgaaggagtagttgtgagcttgaactggtagtcacaattgttgtctctttactgtcataaagacactcagtcacttactgggctttgttatatgttcatgaagtaagagttgtatgtatgaaaccatgctctctggaaatttactttgtcccttagattcattgatttacaccatgatgacacagcacactgtttttttggtgtcaggttattttgctaagacccccaaatcagactgaaaagagaaaactatgtgtgactatttttagaaactgaaatatccatgttactgccaaatcttgaccttatttgctagtgtgtagatttagtcttttcttggagctttgatgttcaaatttgcactataagcaactgtattagtccattttcatgctgctggtaaagacatgtccaagactgggaagaaaaagaggtttaattggacttacggttccacatggctggtgagacctcagaatcatggtgggaagtgaaaagcacttcttacatgacagcagcaagataatatgtgaaggaaaaaagtggagaaccccgataaaaccatcagatctcatgagacttgttcattatcatgagaatagcatgggaaagaccagcccccatgattcaattacccacccccgggtccctcccacaacatgttggaattatgggatatacaattcaagttgatatttgggtggggacacagccaaaccatgtcattctgccccggcccctccaaatctcatgccctcacatttcagaaccaatcatgccttcccaacagtcccccaaagtcttaactcatttcagcagtaactcaaaagtccacagtccaaagtctcatcttagacaaagcaagtcccttttgcctacgagcctgtaaaatcaaaagtaagctagttacttcctagatacaatagaggtacaggcatttgttgaatacagccattccaaatgggagaaattggccaaaacaaagggattacagggcccatgcaagtccaaaatccagcagggcagtcaaatcttaaagctccaaaatgatctcctttgactccaggtctcacatctaggtcacgctgatgtaagaggtgggttcccatggtcttgggcagctctaccctgtgactttgcagggtccagcctccctcccggctgctttcacaggctgctgttgagtgtctgcggcttttccatgtgcaaagtgcaagctgtaagtggatctaccattctgggatctggaggacggtggccctcttctcacagctccactaggcagtgccctagtagggactctgtgtgtgggctctgagcccacatttcccttctgcactgccctagcagaggttctccatgagggccccacccctgcagcaagcttttgcctgagcatccaggcatttccatacatcttctgaaatctaggtgtatgttcccaaacctcaattcttgacttccgtgcacatgcaggctcaacaccacgtggaagctgccaaggcttggggattccaccctctgaagtcacagcccaagctgtatgttggcccctttcagataaagctggattagctgggacacagggcaccaagcccctaagctgcacacagcacggggaccctggagctggcccaaaaaaccagtttttcctcctgggcctatgggcctgtgatgggaggggctgctgtgaagttctctgacatggcctggagacatttcccccatggtcttggggattaatattaggctccttgccacttatgcaaatttctgcagccagcttgaatttctcccaagaaaatgagtttttattttctatcgcatagtcaggctgcacattttccaaacttttatgctctgtttcccttataaaactgaatgcctttaacagcactcaagttacttcttgaatgctttgctgcatagaaatttcttctaccagataccctaaaacatctctctcaagttcaaagttctacacatctttagggcaggggcaaaatgctgctagtgtctttgctaaaacataacaagagtcacctttgctccagttcccaaaagttcctcatcctccatctgagactacctcagcctgaattttattgtccatattgctatcagcattttggacaaagtcattcaacaagcctctatgaagttccaaacttccccacatttttctatcttcttctgtgtcctttcaaactgttccaattgcctgttgcccagttacaaagtctcttccacattattgggtatctttttagcaacaccccactctactggtaccaatttactgtattagtccgttttcatgctactgataatgacatacctaagactgggaataaaaagaggtttaattggacttatagttccacatggctggggaggcctcagaatcatggtgggaggcaaaaggcatttcttacatcgcagcagcaacagaaaatgagaaagaatcaaaagcaaaaacccatgataaacccatcagatcttgtgagacttatccactatcacgagaatagcatgggaaagaccggccactataattcaattacctcccactgggtccctcccacagcacgtgggaattctgggagatataattcaagttgagatttgggtggggacacaggcaaaccatatctgcaactgaaatatatataccaaataatactttcacattttgagatagatgatttgagttctctctctacaataatttattaacttattaacatctaaagaatgaagggagtattatcattagtactacagctataaagagcccttacctcttcgcactggatttagtataagcaggctttaagtttctttgagaatgatccaaggatacccttggaaagggaagagtgtctgatttggccatatcaaatatcaaagcccaaactgctaaattggactattgcttaactgctgttatccaatgttgaaaacctaaaaagaaagccatcaagggaaactttttactatatttaagcttccacatagaataaaatatctaagagatcctggtgatatatcaaaaaatgtttcatgtgagaaaatcaagagctgtgctccaagttagaaccataggcaaccagaactgaaaatgtattcaagaaatcatttcactgtaaccaagaatacactttagagtatcagagtttgttctttactccaaatagccattgctgtttaacacttagttttatatgccaaatttctctcaacttacaaagatgaaatcctgacaactatattaaaactcaactgtacagttgtactgtactgagctgagtgtacctcatcataggttttctgaatgctctggtattgggactgactaactgaataggaagagaagatgaagatagcacaggaaggtggaaagaaggaatggaaaggaggtagggagagaagaaagtgggaaaaatcctagatttagagtagttctccacttatccatgtggaatatattctaagatctccaatggatgcctggaaccatggatagtactgaaccttatgtatatcatgttttttttctatacctacttacctgtgataaagttataaattaggcacagtaagagataaacaacaataaccaataataaagtagaacaattataacaatatgccagcatcactacttttgctctttggggccattatgaagtaaaataaggggtacatgactacaagcactgtgatagctccgcagttgttctgataaccaaactggctattaagtgactaataggctggtagtgtaaacagagtaggtacactggacaaagggatgattcacatttcaggtggaatggagcaggaccgcgtgagattttatcatactcagaatggcatgcagtttgaaactcatgaattggttatttctgcaatttttgatgtaatatttttgaaccacagttgaccacaggtagctgaaaccacaaaaagtgaaacttcagataggggggactactatagatgtacagaatcatacctgttaagagtaggtaatcttgtcattcttccatataaatgagattcactggaggccttcattaatatctgcaaaatgacctggtgagaatatggtgaggatgtaatggtgtgagctattttaagaaaagctatgtcattagtcataatatctagttaatactaaattggagcatttccttctagttgaaatcatgcagttttttaatttttatttttctggtgtggtctctgaatgaaacattctttatgaaacaaaaatgacctctctattctcactttgcagataaaagtgcacatggatacatagcagcccatccttcggtaagtgaaaaattgaaaactgtttcacatgattggtgtttccaaagatttaagagaatataactgcacagatccagtttttagatataaagtcttttaaaaacaattttaaggtataattcagtttatataaaattcacctattttcaggtaaacagttcaatgagttttggtaaatgtatatacctatgctaccatcaccacaattgagttttagaacaagtccatcaccccagtaaaatccttcatacctacttacagttaactccacccaccccaccctagtcacaggcaagaactaatatggaatctgcctttatggatttggctttctggacatttcatgtaaatgaaataatacagcgtgtgacttttgaggattggcttttttaactcagtttatttattttaagattaatccaagttgttgtgtatatcaataatttgtgttcctttttatctctgagtattccatggtatgattgtaccactgtttgtttaaccattcaaacattgaaggctctctagaaaattttcagttgctagctattacaaattaagctactaggaacattcttgtacagggtttttatgtggacaatgtttctgtttctcttacatgtagaactttgagaataataatcatgttaatagaaatttctctgaacacctacagtgtacacttataatataaactgtaagataattttatttttataggtacttaatctttcctacagcccagttaagtaagtcttaccattgtccccattttacaggtgagaaaactgaggtttggagaaattaaataacttctctaaggttataacagtatacgttttgtatgtcacttgttccaacaaactgagatacagggagggaagtgcctttgtccaaagtcacatagataatttttatcagagaagtgactagaaaataagtaacctagttgttgaaagtgctatagtatctgaaagaatatttgtacacattagacagaaaatgatctcagataaggcttccctttctgtgattttcattttgatattctgatagaaattacttcctgcctcatttgtttttttaggggtgaaataatttgcattactgaaagtctcctaaccatttattcaaacagtcatggatggccaacctgattcttcttccttttatagcagaccaatgccttttatagtggacagatgtctgcttgacatcaccctgggtagccagtatgacaccagtagatcttctttagttgtaaagagtaaaggttctgaaatattatgtcagtttctcaaaaattaaaaatggtattaaccatatgatctagctattccacttctgggtatatacccataattgaatgcagggtctccaagagatatttatacacccacgttcattgcagcaatattcacagtaggcaaatggtggaagcaacccaagtgtccatcaacagatgaaggggtaaacaaaagatggtatgtataaacagtggaatattattaagccttaaaaagaagacaattctgacacgttacaacatggatgaaccaggagaacattatgctaagtgaaataagccagtctcaaaagggtatatactgtatgattccacgtatgtgaggtacctagaggagtcaaattcatagagacagaaagtagaatactagttgccaggagctgggagcagggggagtgggcagttgtttaatgggtacagagtttcagttttacaagatgaaaagagttatggagatgaatggctttgatgattatacaacaatatcctcaacagtactgaaatacatacctaaaaatggttaagatggtaaattttatgttatatatattttgctacaattaaaaataaaatgaaaaaagaaagaatgaaggctctggatgtaggtatttaatctgatttccccatttactaagtatgtgacattgggaaactagcttagcttctctgagcttctttcctcagctttaagagggaataaaaatagtacttacctcctacgtcttgtgtgaatattaaatgtgataatgtacataaagtacttagtatagtacttagcacataatatatatttattaaatgtaaactactattatttttacatgacaacaagaggaaaaactcactctcttcacacatgaagcttgtacttgcgctttgctcagattccccaaaacagaacagaatatggccctctcatctgactggccatttccttttcctccttctttgccatgacagcttcctgggccacactgaaaacaacatgtgaagggaggtaataggaaaatggaaaggacaaaaatgacagccttccatgatcaacacatactttacctcctttgacttcattaatatcatgcttgtgcaatcttgactgggtattctggcaaaaaaaaaatagttattatttttttaggttggtcagttatttgaaacaccaacttgctaggatagcctgtgtattggtttttgttttctcctaagatattaactgtttcttttgagattggttctattggttttgcttgtagaattaaaatgaagtctatgttatggctaaaatattccattaagttagaaaaaaaaatgatgatctcactgtctggagataaaacaaatagatatttacctatttaacatatatttaccaactgcctccttataagctctaggaagtttggatatcaggctggtaggggaaggtaaacatggacataaagaagtacaatacagtatggatagtggctgagtatagtggttcatgcctgtaatcccagcactgtgggaggtctaggtgggcagatcgcttgagcctaggagttcaagagcaaactgggtaacatggtgaaaccctgtctctacaaataatgcaaaaactagctgggcatggtggtgcacacctgcagtcccaactactttggaggctgaggtgggaggatcacttgagccctggaggtggaggctgcagtgaggcgtgattgtgtcactggactccagcctgggtgacagagcaaaaccctgtctcaaaaaaaaaaaaaaacccaacaatatggatagtattacatatcataaaatatgttgacatgctatgagatttcagagaaagtagattgcttttagctggggagggaaagggaagcaggcccttgtctccaagggctgaagctcagtgtctggtaccaaatagatacttggtatgtatttgttgaatgttaagttagaaaatgcttcatataaaagttggcatttgagctagatcttaaaggtcagatgagatttcgatctgtgaagatgggaagggcattttaagtaaaaagaaaagcataagaaagggtgtgttggtgagtagagcaaggaaacaaggaatatggggttgaatgaaaactgagatgcgagaaagggaatcaggaaataagtcttgaaggttaaggcggaaccaaatcatacaggcccctaaatggtactccaaggaatctggctttccagtattcagtgggaagcttttgaagtgttttggagcaggagagttaagtgattaacacttataccttgggaagagtaatctgacggcaaatgtccagaatgaattaagtacaaatggtgagactggatgaagggagactagtagggagaatattgcaagcatccaggtaatctgagccagaaatgaggtagtaacagtaggaatggggagattacattcaatttctagaggtatttagattattaattggatgttggaggaaagggtgaggtcaaagataaacgcaggcttaaactgataggtcgtgggtaaaaagataatgatgctgtctttcaggagaagccaatttctgtgggaagatgctgagttccttattggacagtttgagtttgaagggctggcaggactttcaggtgaaaataatggattgactgcttgatgaaggctaggtttctattgattgaatgaactgaattggaccccgacattctatttgaattacttcagtgggactcagttccttaggaatggataactgcaccttgtgttttccttatagttctagaggagagtatgcttcgcaatgtgtatgtctttttgcatcataaaaactcccagtagatctggctgtctacaaaatctgatttaatgggtctgacaaccccttgtagacatagcctgaattgattacaagttttgcatcctttagtagcctgggtgagaattaaaacagaagcaatgttgcattctctaagtgttttaaactcatgattctgtaattaatattgaactcagggatagatctcatagtcatataacacctgctttactgcttatttgtggtagcttctttgatattagtgtattcaatttcaaatactgttcaagtctctactctttaatttgaggctaattttaaaatttcatatttttatcgtactgttgaaaataaaatgacatatttagaatcctaagttagtattccaactggaaggtaacagcaataatatgtcattattgttttgtcatattgaacgtgccattatctatgcttagagcaactggatgtgcagttgacagattgctcttttgtgatttgcagtactggttaattttttttaaacatagtttaagtaattcttttacttcagtgtgcatcagaatttcatggggattctgttaaattgcagattccagggctccactcccagagtagatctggagtagaaacctaaaatctacattttaaacaatcaccaaaagtggcccccaaacagcattttatattatctaaagcctctaagttccttacttctaagttctttgacctttaaaaattaagctcagagaaaaggaaatttcctaaggtagctactctagctggtgtattctctagagcaacgttcagaacttggagttcatgggtgggcttcagatctatgaactgttgaagttatacataagagcatgtgtctacctgtacctttccggggagatagaccaaaccctaagagtccgggacccaactcaggttaagaacttcattcccgaccaggcgcggtggctcacatctgtaatcccggcactttgggaggctgaggcgggcggatcacctgaggtcaggagttcgagaccagcctgaccaacgtggagaaaccccatctctactaatacaaaattagctgggcgtggtggcacatgcctgtaatcccagctactcgggaggctgaggcaggagaatcgcttgaacccaggaggtggaggttgtggtgaacagagatcgtgccattgcactccagcctgggcaacaatggcgaaactccatctcaaaaaaaaaaaaagaaaagaaaaaaaagaactacattctctgccccaatgtctagcaaaattagagtgtcaaaaatatctaatttgataagacaaaaatattccttacttgttatccatctatctatatttctgtaagtttagaagttttagatacagtaattctcagcctggaatgaagagcatggaaacattgcaccattgactccaaaaatgatcaccaggaaaacctctaagtaaagctatgtttattaaacttagagtgacataaaagcattactttgataaagtctttgtgtcttaagaaggggatgtcaggagggaatatttatagggttttagggcttagactgtttgattttaaagcaggtcttgcaaggcgaggaatgggttaagattatgcagtgtttatgataacatagctttgtattggtgaatatagcaaaggaaggggcttgaagcaagttttagtgagcaagctgttagtctcaatgagcaaactagttggttcacggtatcttctagaaacaagtatttcctaaagtaagaagctatgttatttttgcttattctcactattgtttaatataagaacattaaagtatgtctgtcttgatattgactaacacagggaaaataaaatatgcccagtcccagtactatttacacagtgatagtaaagtacgcctaatcccagtattttttaactcagggacagaaattgttaatttcagttctcagtaccaaagattgctatccttggtggattgctggggatttaatgctctctggcccaaccataattcaaaacatactatccactcaatgccatacattcttccaagtcaaccaaccaatatggcaggatagtgtttggtccaaagtaaacagaaatatctgtctttttcttttcccacaaaccttcagaggacaaaaaccttcaggttttctaatagtcccttaagtctatccttggagatggggaatggtttccactggaagttagcagtgaagatagtaatgaatgttaacagtcagtgaaatcttgcaggtggatcttatctagtgaagtattaagacttgaaatgtgtaaggctgctccttgccccagtaggcagactgatctttgtaccagtttaaggtttgggccaagaagactagaccttgaatcattctttttgcctctagggccgtttttagagcctaatagactgtatatactctcacttgtagaggtcacatcatgcattgctttaaacatattaaagggcccccatacttcactttatatttttgctgtaaatttttgaaattatttttgacatattaattttgaaattatttacttacaagtaacttttaaaatgtatggttaggtataatttcttgttaaatcattgtaaatactcaagaatttttgctaaatatgaaaatcaaacctacaatttatatttaatataatgaaatttctttaaatgctaaacataagagactagttaagttggcatattgttatacttaacagacatttaattaaacattaattaattttgactttatagttttcttgtggctttttggagctgatgatttatttctgatggcaaacactttcacgggcccatgtaaaacttatcaaccctgggcaaggttcgtattgcctaatagataaaatagcaccatttgtcatataaaaaagtactcagcttccatccttctacaaagaaacagtgattaggtacattcttgaacccagctggtgtaagatagggcaaaactttctggaacataatatcaaagcaaatttcgataacccaaagcccatttctccctgtgccccctgaaatgccctgaagaattagtgttttgcaagaagaaagtgattttttaaaaatctggaaacttaatgtcattaacagatgttgctatccacatagctatacaatataatagcccagttgttatggctaaattaagaataaatataggtgcataaataagaaaaccaatattcagtaaacatacaaacttcaatctataaaccacttagcatttatatcagggcaataaaatattctttcaaatgcttgtttataaattctaggttggctttcttctcacaattggtaagtctttctggctcctatcagatgtgtgattacaccttattacttcaccataggtttatacatgattgtagaaaagccacattgaatttttaatcacaattgaggtcctttgatgtaatggtctattaataggctgcctataactgcctcaggagctttgtcctcaaagaatgaaaattcattgtcggattatgttaggacagtatacccagtggcataaacaaaaacaaaataaatacacaaaaacaaaacaaaacaaaacacctataatagcactgtccaacaaatatataaactatagtcataactttaaattttctagtaaccacatattaaaatgtaaaaaataggtgaaataaattttaataatatatttattaagccaatatattcaaattttcagcatttcaacatataatcaatataagaagtattaatctaacattttacaattttttgatattaagtatacaatatctggaatgtaatttacacttgaaacacatctcaattcaggctagccacattttattttattttattttattttattttttattattattataccttgaagttttagggtacatgtgcacaacgtgcaggtttgttacatatgtatacatgtgccatgttggtgtgctgcacccattaactcatcatttagcattaggtatatcacctaatgctatccctccccgctccccccaccccacaacagtccccggtgtgtgatgttccccttcctgtgtccatgtgttctcattgttcaattcccacctatgagtgagaacatgtggtgtttggttttttgtccttgtgatagtttgctgagaatgatggtttccagcttcatccacgtccctacaaaggacatgaactcatcattttttgtggcgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcaccacactgacttccacaatggttgaactagtttacaatccccccaactgtgtaaaagtgttcctatttctccacatcctctccagcacctgttgtttcctgactttttaatgatcgccattctaactgttgtgagatggtatctcactgtggttttgatttgtatttctctgatggccagtgatgatgagcattttttcatgtgttttttggcggcataaatatcttcttttgagaagtgtctattcatatcctttgcccacttttttgatggggttgtttgtttttttccttgtaaatttgtttgagttcattgtagattctggatattagccctttgtcagatgagtaggttgcaaaaattttctcccattctgtaggttgcctgttcactctgatggtggtttcttttgctgtgcagaagctctttagtttaattagatcccatttgtcaattttggcttttgttgtcattgcttttggtgttttagacatgaagtccttgcccatgcctatgtcctgaatggtattgcctaggttttcttccagggtttttatggttttaggtctaacatgtaagtctttaatccatcttgaattaatttttgtataaggtgtaaggaagggatccagtttcagctttctacatatggctagccagttttcccagcaaaatttattaaatagggaatcctttccccattgcttgtttttgtcagtttgtcaaagatcagatggttgtagatatgtggcattatttctgagggctctgttctgttccattggtctgtatctctgttttggtaccagtaccatgctgttttggttactgtagccttgtagtatagtttgaagtcacaggctagccacattttaagtgttctgtagccttatgtggttagttactgccatgttaaacagtgcagacctaagccatagttgatggtttttaaacttgagcttgcatcaggatcacctggaaggcttgttataatacagatcgctgggctccacttccagagtttctgattcataggtctgaatggagcttgaaaatttgcatttctaacaagttccttaatgatgctaatgatgctgatctgggaaccacactttgagaaccatggccacagttctttcaaaatccaactttggaaccattttaccactgtattaacatgagtgatcaagaactgtccctaggtattgttgctattgtaccacaatactgtcgtattattgcagtttataaaatattgaaaatctccatttaactcatggttaatattgagtaattattcatgtggatgagtagttcttagatcttcatgtctattactctctgagtgcttctttccaggaggctggacagggaagagacatttattggcttgtttgttcttagtgagtatttacagagctatattaataccatatgtatatgcatgctctgatccttaggtagaaaatagttcttttcaagttgacaaactgtcaatcaataaattgataatctgcccagtatagattcaaggctctaagagcaattagtttgatttttaatgtatttcaaaaacattgaactttaaaatattaagtgaataatagtccactgtttttgagctcagtgagaagttttttaaaaaattacacttcatggttttttaagccatgacatgaatttatctctgaataagttcagagattgtattcaggtgagcaagtcctggccaccaaattgttgatgattctgatcatttgtgaaagatgtagtttcctcctatccctacatgcttaaatatttcatttcccttgttttatttctgaagaaaaacaatgaggagttaatacctgatctttaaactttgtttttgtcacaagagtacaaaaacagcatctgagcctccattggcccctcctgtgtctgaagaagaagatgaagaggaagaagaagaagaagatgaaaatgagccaccaccagttatcgcaccaagaccagagcatacaaaatcagtaagtcacaaaggactatttccaaatgattcaaaagatgccctttggaatagtcatagagttagaatatagttaatcagctagtacctattaagcatcttttatgttccaagagctaaagtataaaatatgaccaaggttttgaggatactgtttgaggatacaaggttagcacattaaacaattagagaataataccaaacaatacataaataactgctaagtaataaaaatgttggagaagttaaggtaaggaaggaaatccatgtaaaccaggtaggaagagttgcataaacagagatcctcagaccagaattagcaaggcatgtatagggacatccaaagactagctcccatgatctttcaacagtgttgtactttcagctactcaaagtcctttttttttttaagaaaataccacttgtctttaaaaattcattgatattacaatacattgactccacactctttccttggcctgctgttttaattgcagagctttttggtttttttagatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagtgagtacttcttgccatgattactttctacacgggagtgtttctcataagccatttaaaatgggaattgatcctttggaagttttaatctgcttatatgaactccagacttcccaaaatcatgagatgaaaaatttgagactcactgcatatgccagaacactttctcccttccactcctaatttgacaggaactaaatatttttacttgaaggaatcaattgaggtgaaaattgataagacaaattaagtagcaagttttaagattacatcttcaaaagagaatagtctgataaaatatgttatgatcataacccaagggctctcaactaatcagtgatgatagatatgtcaacctcaaagcccaacacagtcaatcaaaacttggaacaacaaataatatagctttttcccttaattcagaagcatttatatgtggcaggagagacagaactagcaaatgctagtagcttccttccacaatgtcattagtgtgtacatgctcgtgtgtacacacttgttgccccagttttataaaacacttaccttctagttacttttctgggtcaagaagataaaaaaaaatggattatctgctgaaaagtcaaaggtttgtaaagcatattcattaaactcatactataaaagcatctaacaaattgctagatatcagcaataagtgccccccccaaccccagtttgactaactcctacttatccttcaatactcagctcaaaagttgcctcctcagaagatgttgcttgtccctcccagtccatgttaagggcatctcttccttaccacttttactggagcaaatatcaaaccatattagtctgacttctttactagactgtgagattctcaagagcagggactgtgcccttttttccctatatgtccaacccctagttcatacccattacataaaggcatacagcaaatgcttgttgagtgagtgaatgaaaaaaataagtaaacaaatacatctttactgagttcctacttgtctgttctgtgcaagaaaccttggaggacacaatagaatgaaactttcctgtcatcaagaaattcaatcttttttggaaaatacgatttaatagtatgatacaattagagcataagataatctcgtttcatgcatatttttatttaaaagacctcagaaaaggaagacagtaattcccactataggccacagggaggctctgcagaggtggtggtaggatgattttgccctccaaaggacatttagcaatgtctggagaatatttttattgtcctgattcagagactgctagtagcatataatgggtagaggctaaggatgcttctaaaaccccaacagtgcacaggacggctgccctccatccactttacagtaaagtattattcagtccaaaatgtcaacagtactgagattgaggcatttgagttagatgcatttggaaaggcaaaggtcggagttgcagctgtcagttaaaactcagaactacaattgctagatttttgctgactttactattcatgattaaatatgccactagcactgatactaaccatttgctgtaataacagcagtaataattctcatttattgggcaccttctgggtgggccactttacatacattatcatagtttcacagtaattccttgcagctgattctaatatcctcattttacagaccagtgaatgaaagtaagctttaaaaggcttaactgaccaagtcaccaaaccaatgtgtggcacaaccaaagtttgaactgagaccagtttaccttcaaagcttacactttttccattacctacctactttgcttctgcatatccgaactgtctatttttgtaaaaaggaagaactaaatgaaagaattgcctcgataatttaagttcaattattcagacaattggcacgtttttctttattttgcatatgtagacatgacctatgtgattatatcagattttaaaaatctaacagccttgccttaataaaatgactcttatttggtatctgtttcaaatctcaatagatgtattacaacaaaaatgcttgtatagttttgttagctgacagagaaacaagcattattttcttggaccaaaatcttgttttgcttgtaaactctagtggtgctagagctgtgtccttattattttgtttattctgctctacactgagcaacatggtgaagaaggggaagctaactttgattacatttgaattaagaattcagtggggttttttttttctctactggacttcatgcttgggcatagagagagtcattttccctctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatggacacagggaggggaatatcacacaccggggcctgtcggggagtagggggctaggggagggatagcattaggagaaatacctaatgtagatgacgggttgataggtgcagcaaaccaccatggcacctgtatatctgtgtaacaaaactgcacgttctgcacatgtaccccataacttaaagtataataaaaaaggaaaccaccacattttagtgacaaatttcaaaagccattactgtcagtaaagttgtgtaatacaggaaatttgtcttcaacctccttcctctgggccccactatcacctactccttgcctctcacctccctcagcattccccactcaaaaccctttttcctaattcaccctcatatagaactgatatcaatttagagaatctttttactttttctcagaaatcaaaatcttcattatgctaaaaggataatcttttaatggtgggagttcaccttagcttaatatgtcagaaaatatattgatgggcttttctgtcactgaactcatatcatgaatgctattttcaaatacaagtatttagcattcttaaaacctgcactttaaaatgaatagtttatttcttctttaggaagttctggtaggaaattgttctggtattgcttttttttcttttgattttgatttgctgattttaaaaaactttctccctattgtgtcacagtgttttttctttatcgtaatttacaaaagcaaattataataactaatggaaaagatcactttaaaagcttgttttgtgattgagaatggtaaacaaggcctctagtatacttgcctaacatcagtagatggcagcacacactctcctgtgaagggcgatgagtgtggagacaccattttatttgaatagcagttaagttcagaagtggaatctcatcaaaatggtttcttttggtaatcttcatgaaaggatttatttccagttttttttccccctgcataacatggaaataaaggttgaataatttattaccataaagccacattaactgaaccccaccatttggaatgggtcataattcagaaagtggcttgggctgaagctttttctatatggaaaaaagttgcttagcaacttaatagttaaacttttttagaagactataaactgcttaataaaattatggcttcaagtgactttaaaatcgtcatttcattaaaataaaaaagtccaggcccttgcgcattaatagctaatttgaataaggatggctctcagttatatagaaatctgttagacaagttgaaaaataaaagaccaactcagaaattgctaaattggtggcattctatagatatagctcaagtaaaatatattctccaacccttgccttaaaccatggagcatttacaaagggaaataactaattgtattttattgtaattcagcaaatatatcaatatattctacacacggcattgtgtgaggaggcactgaagatacagagatgaataagacatggctcctgtacttaaagacatagtctaaaaggcaatatcaaataccatacacacacaaaggaacctatgcagatgactgtttagtacagagagtaactcagcacaagtgttacattgtgaccaagaccttaagtgaaccaggaagatctgtggaattcccgtcatgtatatcatgtacatttctagccatagatacaacattgaatggatgccagatgattatgaaacccttcagttctaattcttacaagtcaaagttccaaatagatagatatagacatctgatatattaagtacagagagagagagaacaagggcgagagagagagagagaagatacagtagtagcacagaaaagtgaagttgttaattattcaagggatcagagaaagcttcctagaagagggaacatctaagctaagtttggaagcatgaataggaacttgccacagagaaaatatgggaaggacatttcaggcagcgaatggcatgtaaagaagacttgaagcatatgtcctggaactctgacttattcagtgttactttaataaagaattggtggtatatggtgatactggcattgtagaagaggaaactgaacttttaagcaggagctgatcatgagctaccattagtttgttatgcttagagcataaagttctagtggggaagtggtaaatgatgagaagagaatgaagcaggagccagattaggaaccttgcattgccaaggagttttggctttcatctgtaggtgttagggagctatcaagtaatcctgaaccagagaatcacattatcaggtctgcacttagaggatcctgatagagatgtagagccttgactaaagagggcagcagctagactaggagtccagttaggaggctgttggaataacccaggaaaaagatgatgggagcccaactaaagcagtagtaatgaggaaggaacacattcaaaagatgtctaggaggtaacaagatataggcccttggtggacaactgcacgtggtaagtgaaagtaagagtcaatgatgacttgcagatttctgactcaggctactgagtagatggattggcagtactactgactgatagtggaaatacaaaagaaaaagtattataacaacccatatattagctaagtcttatttaacttaatttaaaagtgaactttcattaaaaaaaaaaccaacaacttgatgagtaatctatgagtgaaatgtttaactgattatttttctcaaggtatactatctactgctgttaggtctaaattatgttgtatactagcccagagaatagactgttgtgtaaattagcatgaagtattatctgtagcatataattgagcacttaaatacatattttcttgttctcattcatttaatcaacaaatatttgtttagtagcagccactgttctaggctccaaagttacagggatgaaaggacaaagttcctgccctcaagaagcagcatgtaagtctcagtgaaatgatcagagaagacttcataaaggtggataatttgagattttatttaaatgacaaataagaattcatgggttagataggaaaggaaaagggggagcacatgcaaagccctaagcactagatagtgatagcattactaggatataaagtagtaagggtggagaaaaagaataatataaagctagactggttagataggagccagatgatgctgaagggtgaaggaccttctctgtctaactacagaaataggatttgatcctgcagtgggcaggagcttttaaggaattatgaacagtggagcaaaatcactctgatatagggttattgtacatctcagtctgtccaggacagactcattttatgaatagtatggtcccccttttccaaaggcatggtgtaagaggaactagagaaagcagagtctatgagtaggttatgactggcacaattgtttgaataagaagtattgaaagcccgaacaatagcagtggccatgggcatagagagaagagtatgaatacgagtgacaactagaagatagaatttacagatcttctcttgattagttcatatgtgaaaatcttgccttaccaaccaactgtacacttctttgtaccatgtgttagtaagatataactcaaagataataatactgacatgtttgcttccagaaagaaaggtgggccagaggcctccaaataaatgatgcccttcaaagtatacccttgagaagctgcacccttattcccatgattgttctataaccccaagatttttctggacctatttgaacactgcattgaagagtcaatgccacttctgtggtatttattctgagtgatagcaagtattcatcctctgagtgatggactggatttttttgaaatagcaaaactattatttttaaagagccaaacatgataaattaatagttttcttatgtagcttataaacttactaaaaaaatgtttggagcaatctatagaaacagaaagtagattagtggttgcctagatatgttttgggaactaagggaagatggggagtaactgctaacaagtaagaggtaaaaggtttctttctggaataatgaaaacattctaaaattagatcatgatgacatttacacaactcattaaatatgttaaagacattcaattgcacactctaggtcactgaactttatggcatgtaaatcatatgtcagtaaatctgttcaaatctttggagcactagcagtgtcctaggtttggaaatatatgttttgaacatgcatgggtctcattactttatgatcaaactttgttcttcattagactcatttccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatttgttattttaataagtagaaagtatcatttttatgtaaattatagaaatcccatgggagtatttgtctaatgttttatttgtcactgactctggcatcttaattttcattattaaattaaaaaacagtcaatcaatttctatttctctctctctctctctctcttccacctcctcctcttttcttctctccccacccatctcttaggaagcattgtgagtgttggggacccaaagaaaaaatacacaagatttgaaaaaattggtcaagggtaagtgattgttatttgaaatataaaaagatgagtacaagcaacatacattaaaattaaaattcagtaagagcttgggtttctggtaaattatgcttctcatttcctagattatatttatgtcttgcattctcagtattggcctttcagggggagtgctgacaacagttacaacattaacctaggaacacatcctgctgaaatcttcattattgttgggctgacagtaaattctgtgtggacattttgatcctatgtagttagaagattcaaacagatttctctagaaaaagcagtagggttatggaaacttctagcttacgtaaaaaccccctttatcgcagttccccctacagccacatggatggtatgattaagatcctgttttattgtcaaaatgtggagtgacaaactgagggtggggaatgtccttatggaatgatccggaggtaggcagagttgactatctgagtatggaggaaacagacaataatccctaaatgagacctagtgcatcattttcacttaatatacttgttaaagataaagattcccaggccccactgccaaagatttgatttagagtctggagtggggttcagtgatctgaactttgcaaaagtccctcagataatcctgataatcagcaatacatgggtaccattgcattagattattcactaaagctgaaggcaggagtcaccagttctgcaagtcaactgtactaatgcatgtctctcaggcctcaaagtgaaactaggcaggtggatctgagcaggcaacagcatttgaaacagggaaaagttttatttaaaggaaaatggaatattcttaagggacatccttaaatgaggagtgagacacatattcagggacaccaactactgtatgtcagaaacaaagatggcacctcagacttttcctggctgaggcaaggggctgaagacaaagggttacagccaatatgcttgcaaaactgtgctagccgatcagccattagaatctaattattttagggtaagagaaggtagaatttcttcaagaaccacactgcttttcctggcatacttaggttcaaaaaagtatacatcatatataagcttgactatttttcatgattttatattttctttgtttttccccctagcttttgtactaaagtttcttttgaaattgccagtatatctcaggaaataagggaaagcattcattagacgtttgggctagagaaaaggagaggcactcatggaaactgtgcctggtgggaatcaagatgagaagaccctaagggggacagaaactcaggaagaaatgcatggccaagtttattcttccagtcaaaaccataatgacattgtatttgaactttccagggggctaaaatatattctcatttgctcacaaaaaagaagagttttatggtctctagaagcttcctgtcaccgaatgggtcaaattaatatttctactcattgttctaaaacagtgataaacaacagaacttactgtgatgatagagatgttctatatctgtgctgtctaatatggtagccactggctatgtgtggctatggggcacttggaatgtgggtagtgcacataagaaactgaatttatgtgaactcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccaagtctatatacagacctcagctctccttcttcatgcctaaagggtaaataccaccagacagattgcaaaaagacagtattatgtactaaagggacttagaaaacaaaagttggcttttagatttcattttcatctggatgagtctcaggtggagctaacaataggaagggaagggatattcaatccacttagaaatagcactccaaatcattgttgtccagtatggtggccagtaaccacatttggctactgagcacttgaaatgtggctagtccaaatggaaatgtacttaagtataaaaggcacacctgatttcaaaaccttagtatgaaaaaataatgtaaagtatctcattaatatattttttattgattacatgttgggaaattttgcatacattggattaaagaaaatatattatgaaaattaatttcaccttttaaaaactttatgtaactctaagaaattttaaatatggctcgtggctcatgttatatttctaataggcagtaatgctctagttgtagccttaactgggagttatttgtttattaattcgtaaagtgtttttccatggttgttttttggagagtgggagatgttataattttgtcttgattgttccaactaaaggccaactgagccaaaaatagcattgaattttaaaaggaaaaagtacaagatggtttcagatacctcccagatactaggtaatgaaacaagactaattttgccaagaacaaagatcaggccaccaagcaactttgtgtaacaaagagatttcctctcttggctattatttatgcctgtgacttttaaagatgaaaaggaaagttctctatctctgagtctctttgtacagtcttcacaacctaaaatgaaaaaatcgaagcataaatcctgcttgccactgcagaaaggtctattttaaattcccagcaagttcatcattttaaagaatgataaagtagcagatagttcactcataggcccaacacaactttttaatacatccttagagggtatggagtcaattgtattcctacttttgtcttctttagtgtttagcacagtgcttttgcacttagtaggccctctgaaataattttgtgcagttatgatcaacagctgggttcactttggccagattcaaagaactgcaaagctgtctgccaactccgtctctgtgggtctgtttttgcctcaataaatatttgttgagctaatgaaaatgtttgtctttccactgcatcttctcactcgtaagtgggagttgaacaatgagaacatatggacatggaggggaacaacacacactggggccagaaggggaatggggggcgaagggagtgagagcattaggacgaatagccaatgcatgcggggcttaaaacctagatgatgagttcataggtgcagcaaaccaccatggcacacatatacctaagtaataaacctgcacgtcctgcacttgtatcccagaacttaaagtaaaattaaaaaaataaaaaagaaaatgtttgtctttctagctatctctttcctctgtcctctgtatttacatgtgtatatacatgcctatcttgctcctcctgtgtctgtctttccctgtttttcctcagtgtgtcttcacatttttgtctttcacaatgacttgattggcctcaccacatctgattcctttattctctgggtatttgtgtgtgctgcatatctgtcttcttcaagcatgttggccttacattctactgcccattttcacacacaccccacaacccaaattgtcataatataaaatcaagatgtatttaagatataatctgccggcttaaatctatttactatgattttatcatttacttaatttactaattttatttttttgatcttagtagattgtttttcctcagttcttaattattaaagtaaagcaaaatattgacttttttctttctggaccaaaaaaaaaaaaaaaaacccacctcccacttatattaactttctttttacttaaatggctttcaactgatttttttttcattaattactggcctaagttatataaactagtagtctctactctcaatatgtagagttttttaaaattaaatctgtgtttttaattgtttttgccttacctattattacagtgacattcaaaattgttgtcaataatcatttggtgttagggataatcagccccagtattttattctcagctccagagagcacaacagttcactcactctcaggagctggatttgagaagagcttctccattaatcaccttcatttacttggaaaactaaattttttctccagcatgggtttctgccatcccagcattcaggcctggggccagagaattgggctccatcttccataaatcaagttcagaatcacatgtctaatcgtttgaggccatatctgtgagttgaaggctaaaaatgacattgtttcactgggtttgctgtgaaaagtgttctataattggctaccaaatccagacattttgagcaaatttatgcaaagttaaaaaataaggaaagaaagaaaaaaagtcaggtaccccaaaattatcattaactcaacaacatgagtttgtcagaaatatatccggtgcgcacttgagaatcttcactttctagaatagttatataaaataacttgtttaataaatgaggtagagtgagacaacaaagtcaaatatttattttcagtcaacagctatcaatagcaaccctgtgtaattcctgaataagcaatagctatgtaacagagggctgaatttacaatgttggcagctgtcctcacagatttctcattaatgtatttgaattcatgttagggtctttccttaaatgagaatgcactgaaaaacaggcctttttttctctttcaggttcatattgtcttttctcttcaacattataatagaaaaatatttttgaggaagcagctcagaggatccagtttaacaagtatatttttaacatcaatgaacctttaatgagtgcctactatgtgtaatggagagtagcagttaagaatcaggttctcagagttcacagtgacctctatacttgtggtccccctgaatactggacatggagaagagttatatcaagaaataagatgaacacctacccccaataatgtacctttcctctatattttattcatacactcatcttcactgtcatctctcatatgaatcactctttggctggcctggtcctaattgaccttttctgtcttttgtttttctgaatcctacagattatatctgtgccggcatgtattcaccacttatatcttagcttgtctagacatgtaaaattgcttgaaactttgaggaatgtagaggaataaagggagaatttttgaaaaacttgaagaaaaagaaagagacaggattctgaactcagggctgtagaaaaattatttaatttctttaagcatcagttttctctttcatagtaagcagaatgcacgtatctcataaggttgtaaaaataaataagagaaggcatttaaagtccttagcacagtacatggcacatagttaattgctcagtaaatgctagttattattagggatgaaagacacactcatatgttgctattatatagaacagaatataataagtattgtgaagaaattacaaagatctctgtggacagagaggagggacaaattatttacagccaaggagtgggtatgatggattcttagaagagggtacacttgagagtgacattagagggtataggaatttaacaagtagggtttataagaagttttgtttgaatgcttacttcagactgtaggtttcattcactttggtatccctaaggtctgcaacactgccccagcatatatgctcaaatataaggtaacacaataagataattttaaaaagttttttgatgcacctgcatacataaactgttttatatatatatatatatatatagagagagagatatctgtatatctatatatctatatatatatatatatatatggttgaaagtctacttatgatgtttgttaatttactttcattttcatatttaaaaccacttatataaagtattattttgtagagatttttctactctcatatttcacgagtggtataattcaaaatcttcttatgtgtctttaacatcattctttttgtaatcactagagattatttttgagtcttccagcagttactcaaatatattacctgacttccatctaagatatttgagattttgaacccacatataattctgttcgtggatatttattcctagtcacaattacccattcatataacattaagactattgttttttgaatttgtcctgtaggtgtatatttaggtcttcatgacatatatctactatctactatatgactttttaaaatttctattacaaattgtcatacttacacaaaaatagggaaaataacacaggaactactgtattcttatcactcatattaaatatttatcaacaatttttaataaaatcacaatgccattacatctacaaacaattaacaattgcttcatatcatttaactcccagtctataatcagaattctccacttgcaacaaaacgctatttttataattgatttgttcaaatcaacatccaaaggagatctacatattgcatttgttgtatatcgtaagtctgtataccctgaagcagtctcctttctttttccactaccattatcttgttgaagaaactggttattgccttgtaaaatgtggcactttctgtatttgtctgttagtttcattagctgtcatttaacttgctcttctaacttccacctctgggattcaggggattctcttgcctcagcctctcgagtaactgggattacaggcgtgtgtcaccatgcccggctaattttgtatttttagtagatacggggtttcaccatgttggccaggctggtcttgaactcctgacctcaagtgatccacccacctcagcctcccaaagtgctgggattacatatgagagccaccatgcctggccagatgcttgcttttttaattgccagctttcattgtaaagagttagcatggagttacatacgaaagtgttcaatgaggggtattttgatatttttagtagggaaattttattaagtatctttataaagtcttacaattttacattgtcaatatgtttcactgagttgcatctattattgtttatggtggtcaaactattccatctttagctaatgggagaccctttcactgcattagttttgacagaggtcttttaatagcttgtttacgacatccaacacttgcagttatgtggtcataccctccaaaataacttattcacatcctttctttgtaattctgacaggtactctctatgagcatccaaaactagcattaattgagaagatatcaacctaatatgtcctttccaaactgtattttatagttaaaaataaatgaatatggataagtaccaatcacatgaaagatttttataagaacttgcatataaggcagctccatttttatgaggaaaaattgggaggagaaaacccttatcttgtatttgggtatatatggtgcatttctgtgcatgcatgtatgtttgttgtaggtatatttttagcacaagtggtaacatactatatatctccttttttattgtgtttctgtgttttagagatggttctatgcttgtacctcatactttttaaacagatgcagtgctttgttatttgaatagtaccataatttattgaactaggccctaaatggacatagacatttaatttgtttttgatgttttgctattataaacaaggcttctgtgaagatccttacaaataaaccattttatacaaagttatcattagaatagattcctaaaagtggaattgttatgtaaaaggatatgtgcatttttctttctgagttaccctccttagaggtttgtttatttaacacaccatcaataatgtatgagagtgccggtttgcctgcacctttgccaacacagctgtattcacttatttgggattatagtcgtataataaaaacactcccacactgacttttttaaaaaggaaaataaataagaaaggaactctaacaagaaagcatgtggcaaaacaaaaggctatcctgaagaattaattagccaatgtagtccatgtctttataatgccaaagtatctttgttacatgttatatctctccataggttagattagctatgcagctatgtttgacagaaagtgacaatgagagcatttcttgaaatcatttttctcttacacgtagatatatatctgggcaaaggaattttgtctaacatctggatctttgtcaatcatatcattatatagaatgatgatatgttcaattcatcaataattgctaacaaattttgctactagctcatgcgtaatcaagccctcagtcccccccgtctctctaaattagttttagttttaagactacagaaactaagtatataatgttaggtatttttcagacttatctctgctactcagtgagaagcccctttcttcttaatctaacatgaaagtctcatattgaagatgaatagctttgaaacttatttcttaaaagacttgttgaataacagtgtcgtttagagaacctgacaaagcagtgtatgccatggaactcagagtgctgagaataaaacctctgattttttttttttttttggttgttcaggaaactatgggcaagagtggtgtctagtgtgcttatagaagtgattctttgggtaggaccacccaccccaaaagtatttgcttcttcatcggatctattttgggccacacaaggtagaacgctgctatgaagcactaaatagatgtagtctgagttctataaaaggctttgtgatgtaggagattggaaatacattagcatttgtgaagaacaatgtttatggagcaatggaagatgctctttgttctacttaatgctcttaaatgcactgtgttgtgtgctgtcccttgtaaagaaagatgatgccactcaatcaaacaccattagcagagtttgcacgttaacttgttttttccagccacagtaatgagcttgttttaagccacctgcccccctttcctgtccaggcctcttgaatccaatggcacacactgtgaaacagctgcttagatttaatgttggagtgagtagccgagagttatctggcctttccagggattaagccttgtaattgtggcctcattatcactggactataacccaccgagctccctggccccacacccataatgtgttacagctctctttaaaattagatgaccgtgaatactctgagaaaagtcatgccctagctaaagaacagaaaattccgtgttctgatttataatcttagtaattaaagactataccatctggccccagctacattctgtgtacttagagcagtactgagataacatgatttttacataattttcttttttaaatttagggatgcattttttagaagtaaattacacaaaggaaaacgccagaactctgtctttggaaaagttattgcatgtgatggtaacatcattcctgagccccaaagaacacatctctcaacaaaacaagtaactatatggtagtatcaaactatatatatacagatatatatagatatataatctgtttttatgtcaggtgcgttagtatagtgagacaatatctagataggagcctacaagtagtaacttttttaatattcagcaaaagataaagtctatttctaaaaactaacagcagttcattttcagccacatgatcaatcttaattgagtcggcaaacagaacaacaacttgtgtgtggttataccaaaggaataaaacataccatgtcctggtacaaactaaatggcttgtggacaaagtgagtagaaaattaaaggcaagataaacattttggggaggcggcttagcataacaggtacaaacatgagctttgggaagtaccacacttgcacttagcactgaggtaaaaatgctaaagatctatagcaaaacatgaaatggtgattaagagcatgggctgtggagagaaagtaatgcatttttaagctcagctgctgattgtgcaaccttaggcaacctacttaacatttctttgtttcaatgtcctcatttgcaaagtgaggaaaatctaatttatctcatagagttgtacagggtgggcattaagtgagatcattacagagagctgcagagagtatggctcaataagtgaaatagcctttttatagcagcagcagcaataggaatacatgtaaaaaaaataaccattctatatggggtttaatccttgactatgacctcattagcaccagatttatatttgtaaaaccttaatgggaattttgcctatctttctggctccctcattcttattcctaccagattcttcttggacttcattgagcctttagacctcttgccctttttgttttctcccagtatatgagcttcttcctaggctcacttcttcacccttcttttcctctaatccatttccatgctgaaatcaaagtgacttatctaaattattagtcctaccatgttgctacttttacaactactcatgattatggcttgacattggcacttggtgggaaacatcaaaacctggtcaagattcctgataatgaaactgacctgctttatgaggaaaagggagaattgtgaattgtttctttctggacccttcaggctagatgccagtgtttccatttgagtagtaagcgcttggccatgtcagggagagactgttgacaaagcatctaatgtgatgccaagaacccagatgtacttatcgcattttaattgatgatgggtcccaatggttgagaaatctgttggtttagtattctttaatcatagtatagttaactgaaagatctctaacttcaagttaggagacctttgttacttacttgctatgttatcatgggcctatccttcctgctttctgggcttcagatttctcatttgtaatgaggaagttaaactggatgttctctattttcctttgagtcctgataatgcatgattactttgtactatctgagggattgagatttggaataaaaacaatacctatcataaaagcatgttcttcctacaggaatctggctttaatataactggaatggagtgataatagggatcaatgtaattaaatgtttagcataaaaatcaaattgacagtgttgcccattttagcacaccagacccaatacactggagaattaggaattttaacccctatctttgttagtttgagttttggcatctttacatcctatagtgctgcgtgacactgacttttttttttttaattatactttaagttctgggatacgtgtgcagaacgtgcaggtttgttacataggtatacacatgccatggtggtttgctgcacccatcaacccatcatctacgttaggtatttgtcctaatgctatccctcccctagccccccatcccccaacaggccccggtgtgtgatgttccccttcctgtgtccatgtgttctcattgttcaactcccacttatgagtgagaatatacgttgtttggttttctgttcctgtgttactttgctgagaacgatggtttccagcttcatccatgtccctgcaaaggacattaactcatcctttttatggctgcatagtactccatggtatatatgtgtcacattttcttaatccagtctatcattgatgggcatttgggttggttccaagactttgctattgtgaatagtgctgcaataaacgtacatgtacacgtgtctttatagtagaatgatttataaccctttgggtatatgcccagcaatgggattgctgggtcaaatgatatttctggttctagacccttgaggaatcaccacactgttttccacaatggttgaactaacttacactcccaccaatgatgtaaaagcattcctatttctccacatcccctccaacatctgttgtttcctggctttttaatgatcgccattctaactggcgtgagatggtatctcattgtgatttttgatttgcatttcttgaccagtgatgatgagctttttttagtatgtttgttgaccgcataaatgtcttcttttgagaagtgtctgttcatatcctttgctcactttttgatgggattgttttttttcttgtaaattttgtttaagttccttgtagattctggatattagccctttgtcacatggatcgattgcaaaaattttcttccattctgtaggttgcttgttgactctgatgatagtttattttgctgtgcagaagctctttagtttaattagattctatttgttaattttggcttttgcttccattgcttttggtgttttaatcatgaagtctttgcccgtgtctatctcctgaatggtattgcctaggttttcttctagggttttttatggttttaggttttatgtttaagtctttaatccatcttgagttaatttttatataaggtgtaaggaaggggttcagtttcagttttctgcatatggatagccagttttcccaacaccatttattaaatagggaatcctttccccattgctgttgtagatgtgtggcattacttctgaggcctctgttctattccattggtctatgtttctgttttggtaccagtaccatggtgttttggttactgtagccttgtagtatagtttgaagtcaggtaggatgatgcctccaggtttgttctttttgcttaggattgtcttggctatataaaatttcaggccaataccaatgatgaatattggtgcaaaaatccccaataaaatactggcaaactgaatccagcagcacagcaaaaagcttatccaccacaatcaagtcagcttcatccctgggatgcaaggctggttcaacatacaaaaatcaataaacgtaatccatcccttaaacagaaccaatgagaaaaacctgattatctcaatacatgcagaaaaggccttcagtaaaattcaacaccccttcatcctaaaaactctcaataaactaggtattgatggagcatatctcaaaatattaagagctatttatgacgaacccacagccaatatcatactgaatgggcaaaagctggaagcattccctttgaaaaccagcataagacaaggttgccctctctcaccactcctattcaacatagtgttggaagttctggccagggcaatcaggaaacagaaagaaataaagggtgttcaaataggaagagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcctatacaccaataatagagagccaaatcatgagtgaactcctatttacaattgctacaaaaagaataaaatacctaggaatgcaacttacaagggatgtgaatgacctcttcaaggagaactacaaaccactccttaagaaaacaagagaggacacaaacaaatggaaaaacattcaatgctcatgaataggaagaatcaatatcgtgaaaatgcccatactgcccaaagtaatttatagattcaatgctatccccatcaagctaccattgactttcttcacagaattagaaaaactactttatatttcatatggaaccaaaaaaagacaccaacttttaaaaattaaagtgaattaaggttttattttgtaaatatatgcatggagatattttgatataccccaggccgttgcaaagctcatctttgggaatcagcacaacatggttggcatgaagattgtttctttgggagtatacactactgtgcttcagttattacaaggagagtgcttcccaacttcaccaagatcccttcaattatttgtctttgtaaaccctgggttataaataattttgatgattgaactgtatttattaatagtttatttattgtactttattaagcaaaaaatacatataactgctaattaaagcttttaatcatcatgtgatatccaacataattacaagttgatataattctagctaaaaggaagtatatgtgatatttgaattagctgttctcaggtaattgtcaatttttttgttatgaattttgaaacatcaaatatcttgaaaactcccagatacttacagagcttccttatgattcacacactagaatttgagaatgtaatgaatatgttaggaaataatcaaccaaataataattatcattactgctaatatttattgggaaatcactgtatgccagaactatatacatttaatcctcctttaatcctaaatcacaaagaaactaaattacttacccagagtctgacaactaggaactagtagtacttgaaccaggggaggtttgaatgaatgggagtgaggactactgttctcaacccagcagtgagcaatgagagagctttaatagatgaatcttgaaggaagttgagatctcttgaaggagagattcatatttatacccgttgaattttaaattgttagaatatgtaaaagcatcagaactggggtgcagaaatatgttgggagtgctaagacagagctggggaaaaggtggtaaattttaatttgcaggttagtacctgaatttgtgcattcgagttgaaggttgtgcaaaggctagaagttgcacaaaccaataacttattggtcagagcagggagttccaaccacctaacaacatgtttggtttgaggggattggtaagtgtggtaggagaggatattaccattttatgacaagagaaccagggtacagggtagggaaatgcatatatatatatatatatatacacacattacacaattgcatatatggagtaagcggggaggggaggggaggagaaaggctcatttttagttagcagctggtgctctagagtttcaggatatttaaacctctgtggattagtaatttgtcgcaattttataccactggatgccataaatcccaggatattgagattccagggttagaactctagcaattttaatacaattaaatgctgagggtgctggaggacaaaaaaaaacaaaacccacgaatttgaaaggtaaagctctgaaaatgttaaacatgaatccccacttgcactccaagtcaatcacaattttagccctcaggacagtgggaatgggcttgggggttagggagacagaggtgttgaataacagaaagggcacctgggcaggtattttgggcccccctccctagctttaactggggcaactcccaatttatttgtttaatatattgagggtttcttcatacagtttcatttgataaaggcgttccaactttcaaagaaaagggtaaaaccacttccctagggggggagaaaggatgtggaacctctaaaacgtgttccaatagtttacctcagcctctgtccttttggaaataggggcagatgttagcaaggatgctttggctgggaggtttggatgggccaactaatagttcggtgtaccagtcatcccctactgtgaaaccaataacaacagcggcaacaacaaatgatgataatagcagctaccatatagacatcaactctgatctggcacagggctaaatgcttacatagattgtgccatgcacaatctctacatgtaattctctacagccctgtgaaataggaactattatctcattttgcagatactctcactcttttgcatctaaaggaattgtgcatgcggcctaaatacatgtgaataaaccagagtcacttttatttatttatttttaaattttattttagatttagggagtatatgtgcaggtatgttacctgggtatattgcataatgctgaggtttggggtacgaattatcccatcacccagaagtcagcatagtactcaacagttagtttttcaacccttaccctcctccctccttcctcactctagtagtccccagtgtctattgttgccagctttatgttcatgcgtacccaatgtttagctccagcttagaagtgagaacatgttgtatttggttttctattcctgcattagatcccttagaataatggcctccagctccatctatgttactgcaaaggacatgatctcattctttttatggttgcataatattccatggtgtacatgtaccacatttttctttatccaatccagcattcatgggcccataggttttttccatgtctttgctatcatgaatagtgctgcaatgaacatacaagtgcatgtgtctttttgataaagtgatttattttcttttggatacatacccagtaataggattgctgggtcaaatggtagttccgttttaagttctttgagaactctccaaactgctttccacagcggaagacctaatttacattccctccagcagggtataagtgttctcttttcttggcagccttgccaacatctgttgttttttgactctttaataattgccattctgactggtgagagatggtgtctctttgtggttttgatttgcatttctgtgatgattattgatgtggagcatttttttcatatgtttgctagctgtctgtatgtcaaaaggcatttttaaatcatattttgcaattagatttaagtagtttctcaggacttattgcggctgaaatatacaccaagtcgaggtgatctattcctttgaactcaaataagttcagaaggacaaatcacacaccgggctctgaagtcaggaatgtttgttcgcttattccaagagcaaagtgctttatttagatttaagtagaagaaatgttttcttcacagaaaggaaaagtcatattggcattgcatgtttgctttaaaagatttttattaatttgttcattcaacaaatatttattgggaactaactgtgagctctgagcccagaatctcacacttacagaagtgaggaaatgatttgtctgatataagcctcaagcctaagaaatttctagaattatcaaatcccggtttaggtggcacctattgattaagtgtgatttttcagcccagttccaatcgatatttagaaacacaagcagagtgaggagggtagtagagttgtagattataaatcatagaattaaagaaccttagaaataaagtagctcatttcctgtactttaaaagcaagagagtcagacagacacgggttgttaactgtgtaaccttgggcaggtaacctctctgaacctcagttcatcatatgtaacatgggaataatagcatctgccttataaaaatatggtaaggattacataagataaattatctaaagttcttagtgcagtgtctgacatatacaacatactcagtacatgtttactgttattgtgatacctgttttccatgtgaggggactgaaactcagtgaaaggaagtaactagcgcaaagtcacatagcttgatgatgttaggacaaatattagaactcagatctctactaatagtcaaatatgccttatactacacaccgagtttactccctgagagccaggtcatatacacttcctggacctgtgagaaatatttgggctaatacaaggagaagggaaaagaatgacaaggaagtgcctgacataagaaaataattcctggactcagaaaacaaaacagcaaggatgaaataaagaacaagagaaataattaccagaaagtttacaaagcaatgttggagtattataacatgtagtcaatcacaggactgatctctattctaactcctttattcactaaaagcgaaattgactttttttctttttcttgaaggtgttggtgggaggtggtttagaatgcatttgtgattcatagaaggttactgtgaatgcagcttactatacaatttctatttgcaaagcaagggaaccccataaatgaagttagaatggaagcaagagtactgctaagatataaagaatgatacattattaatttttttgagacatggactggctcattattaatttttttgagacaccaggctggagtgcagtggcacaatcacagctcactgcaacctcgacctcctgggctcaagtgatcctcccatctcagcctcctgaaaagcagggactacaggcatgtgccaccacacctggctaatttttaaatttttcatagagactggatctcaccgtggtgcccaggctggtctcaaacttctgggctcaagcaatcctcccgcctcagcctcccaaagttttggggttacaggtgtaagccactgcaccaggcccagaaatgacagattttaaaagaatattgggctggagtgacacctcaaagtagaagttgttgagaaatttagtaaaaataagaaaacaatggctcaataataaagtcatgttgctattgcttcatgtagctatagtacagtacagcactgagagagattggtctttagatgaagatagtcttaaaaattggaaatatatgaaaagaaccactcggtttctatactaaaagggaaggttaatttatacttgcctaagcaaaagatgatatattctttcctaaactattcttcagtttaatgaaaggcctgcaatgttggttattacaaaattcaagaaatatttaggggattccaggagtttcctaaaagaagcaaggccattttgctcaatttattactgcatagtgcatgacactcagactagtgccagaaaatctgactggagttcctagtccaccacaagggatacattgtgattgtttcaggtgcatatgctgtataaaaagattgttccaatactgtacacttaaaaatttgttaagagggtagatcgcctgtgtttttttttaatcacaataataatttttttaaaaggttgttccttttcttacctcataattttgagtttgctaattttcctcccctcaaaataattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaataaaaaaaaaagtggggggcatgtgtttgtggcacagggaaagagcttagtaaataaagaatgtgtatgtttcactctatgtcccccaaaatatgaatattcatgtttattataatgattgtaattcattcttgtattttaattgccattcaggtggccataaagcagatgaaccttcaacagcaacccaagaaggaattaattattaatgaaattctggtcatgagggaaaataagaaccctaatattgttaattatttagataggtaagtgttttgtcttattatgtacttatattctttgtgggatgtcattttttcttggcaaattactttatttgggattcgttcatttaacattctgcaaatatttctcaaatgctacagtgtagtagagtattagatctattgctaaacttgcactcacttagctttgtccacatatcagacacttgaagaaacattttatggtcttggttgtaaatttcattttgagaatcatagctccattttggcagaaaatagaccattgcatataggagggagtagtggtttaaacattacatcaagtgtttgtctggagccagtacaatttctgggagtctaagtgaagaaggctgactacaatggctttaatgggtgctttgtgattaactaacagtgaggtctagggaattcagactttaatctcaaacctttttcctaaacctggtaattaatgtctctttatcagtggtattaacagtgtgttataaataggtatttaaaggcagcactaactcttcacttgtggttaacatctgtctcattcaatttcaaaaagagtttgtttagtaccactgtgcggtgttctctggaggggatacaaagaaactaaatctaggtcttcaaactcaataagcttaagatactgttttctgctttttgggccaggtagaccaatgttacagaagaaggaaaaactgggaggaaaaaagagggttaaattttacagtccttttttttttttttttttttttacagagtcttgctctgtcgcccaggctagagtgcagtggcgtgatctcagctcactgcaacctctgcctcctacgttcaagcaattctcctgcctcagcctcccaaggagctgggattacaggcgtgtgtcaccatgcccagctaatttttcgtattttagtagagacggggtttcgccatgttggccaggctggtctcaaactcctggcctcaggtgattcacccaccttggcctcccaaagtgctgggattacaggcgtgagccactccacccggccgcaaattttacagtcttgatcagtgtctcctaaagtgtaacttaggaaccacctgcaacagagtaacctaaagtcattctgtgtttgtaattttgcaaaaacaaaaaacaaaaaacaaaaaacaaaaacaaaaaaaaacaaaaaaaacaatgcatttgcacttataaaaaattcagaattctaggctgctttccataaataataagatgaggactgtgaatttttgtttttaacaagctttccagatgaattttatggacaccacagtttgagcaccactggatagaaaatcttgcttcacattgatatgggtcttagggcagggtgggaacattgggttcattccatttcctataattcatctttcttgataagcaaggtttcagagagacctgattgtactgctaaagtgccgtcagatggtgtcaggtgatttgaataacctcatgctctctttgcctgaattatagggctctggtgacccttggctccatattatgatcacttggagtatgtccctcaataccttctcaaaggtaatgggcatagcacaactcagagttgacttctatcagaactgaggcctgggaatatcagagtccccaggttttttagcgtcataaggcaaagtcttttcttttcttgttatagctacttggtgggtgatgaactatgggtagtcatggaatacttggctggtggctctctgactgatgtggtcacagagacctgtatggatgaaggacagatagcagctgtctgcagagaggtaagcaaatagagcatttctagctgagaagaccaccgaaattggcagttcttcatttctgattattcagaatgtttgtatcatcaaagtaacaatagtagaacttttccactgaaaacaattggagaggccaacttcaatttaaattctgtcctaatagcactccccagcatcaccctcctgagcctcttgtttattttagctgccttttgtgaatcttttagttccattatgccatttgtgaggtgccgtatctaaacccacatgctgtagtttccgtgaacatgggaaacagtgatattggcatagcacttctttctaatttggggaagtttttacatgatacttattttatcctgcatgtgtaatatgagccatgtaaaataaattatattttcatcatttttagaaggcaatttaaacaaggtcctccctcaggccagaaagcagttgctttcacagtacaatctgaacttcccttacagcccccaagtgggcctgacggtctgtctcttttccagtaagtgtcatacccctaaggggtttcaaactaaattaaagagatgttattatatttattttgttgaatattaaaaaacacacacacttttttactggagtctcatcttaggcattataatctatcccatttattgtggtgaggttttctatcaacaaaagtaggaactctgactcactgaaacttgaaaaccaatgatagaaaaacaaaactaagtgatatcagctaatctctgctttttttttataagttgttcacttaaatttcctccttccttgctctcctctcattatcattttccccaccccacatatccaccaaacatatatgttttctattcattcaatacattaaacttactaccctgagcctgtggtttccttcttccagcattacactgcaaaggcatttccaaacaagtgcctatagttacttcatagcctaggagtggttcccaaacctggctacccattagaaatagtttggggcacttgttttaaatgcagattcctgggtttcatgccagaacttctgaatcaaatcatgccatctacaatgaagcttaccacagctatagaagaccaagctgaatcctccaaataactgggccaaagtatattaattggttaatttgactgtattattgattggtgctatttatcacattatcattcttaatgtcctagtctgatgtgtcagccatcatacttagcatgataatgctaagtggcatcattgatgtaaatggtaatgtgactttaaagtggtgttgttaaagcattcagtaatcgatttcacttgacaatataaagttatatccctgcccaaaatttatctagaaataaaacttagtattaaaaattatttgtgatataattagaacttttttttctgatttaatagtgcctgcaagctttggatttcctgcactcaaaccaggtgatccatagagatataaagagtgacaatattcttctcgggatggatggctctgttaaattgagtaggtattttggttcaggtggtattagagtatcagggaatttctgttctttcattgtatatcttaagaagataatggttactgaaagtgatttatttgaaagaagttacagcccagtttgaagtaaagaatttttctaacactgtgttcctgaatattgtgaccacattttttggatttaatatttcagaatttctagtgacttgtggaatgaataaatgacaaatacctaattaggaaactgaaaaattctgtaagtttgagaaaacagtgatgagagggaattagattgaagtctagtaaaaatgacatcacgttagtcaattatttcagaccttcttaaaatcaggaccagctgagacatcagttaacaaaaaggtatgagctaggcagttgtggaaactcagtgtgtagcaaaggaaggtacagccatatctgaaagtgatatattgtaaaaggaaaataatttgggcttattttaactggcttttcttctctgcagctgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggtaagtcagaagagaagtcaggtactttattcccaggaaagaggaaaggccaaatatcatttctggcttccaccaaaagtgaccagaatgggctcttttctgagaccagtaacatagaagcaccaagttataattttcaaatttactgtaagctttttaaagtttatcttacaatgtctcaacagttttccttgtctttttctttctttctttcttttttttttttttttttggagaaagaataactaccctttttttctctttttctcatttaattcttttttccttccaactttcattttaggtgcagggggtacatacgcaggtttattatataggtaaattccatgctgttggggttggtgtacagattatttcatctcccaggtaatgaatgtagtacccaacaggtagtttttaggtcctcagactcctcccaccctccactctcaagtaggccccagtgtcaattgtccccttctttgtgtctgtgtgtactcaatgtttagctcccacttacgagtgaacatgcaacatttggttttctgtttctacattaatttgcttagaataatggcctccagctgcatccatgttgctgtaaaggacatgatttcattcttttttatgtctacataatattctatggtgtatatgttccacatttttgttatccaatccactgttgatggacatctaaattaactccatgtctttgctactgtgaatagtgctgtgatgaacatacacgtgtgtatgtctttattgaaggacaatttatattcctttgattatatatccagtaatggtattgctgagttgaatgatttatattcctttgggtatatacccagtaatgggattgctgagttaaatgatttatattcctttgggtatatactcagtaatgggattgctgaattgaatgataactctaagttctttgagaaatctccaaactgctttttacagtggctgaactaatttacattccctccagcagtctataagcattcccttttctcctgaacctcgccagcatctgttattttttgactttttttttttgagacagagtcttgctctgttgcccaggctggagtgcaatggagtgatcatgatcttggctcactgcaacctctgcccactaggttcaagtgattagtgcctcagcctcccaagtagatgggattacaggcatgcaccaccatgcctggttaattttttatatttttggtaaagaagggcttcaccatgttggccaggctggcctcaaactcctggcctcaagtgattgacttgccttggcctcccaaagtgcttggattacaggcatgagccaccaaacctagcccctttttgactttttaataataaccattctgactggtgtaagatggtattcattgtggttttgatttgcattactctaatgattaatgatgtggagcattttttcatatgcttcttgggcacatgtatgtcttcttttcagaagtgtctgttcacgtcttttgtccattttttaatggggttgtttgatttttgcttattaattgagttccttatagaggctggatattagatcttcgtcagatgcatagtttgcaaatattttctccctttctgtaggttgtctgcttacactattgatagtttcttttgctgtgcagaagctcttcagttaaatgaagttccatgtgtcaatttttgtttttgttgaaattgcttttggagtcttcatcatgaaatctttgccagggcccatgcccagaatggtatttcctaggttttcttctagggtttttatagctttaggttttacatttaagtatgtaatccatcttgagttgatttttgcatatgatgaagggaaaggatccaatttcaatcttctgcatatggctagccagttatcccagcaccatttattgaataggtagtcctttccccactgtttattattgttgactttgtcaaaaatcaggtggttgtgggtgtgtgactttatttccgggttctctcacctgtcctattcatctatgtgtctattttttttttaccagtaccatgctgttttggttactgtaggcttgtagtacagtttaaagccaggtaatatgatgcctccatctttgttgtttttgcttggtattgctttgtctattggggcttttttggttcccagtgaattttagaatagtttattctaattctgtgaaaagtgtcattggtattttgatatgaacagtattgaatctgtacattactttgggcagtatggccatgttaaaaatattgattcttcctatccaagagcatggaaagtttttccatttgtttttgtcatctccagtttctttcatcagtgttttgtaattcttgttgtagagatctttcaccttcctggttagctgtattcctaggtattttattttttagggctgttgtgaatgggattgtgctattgatttggctcttaactggacatcgttggtgtatagaaatgctactaagttttttagcattgattttgtatcctgaaactttgctgaagttgtttgttagatttagaaggctttgggcagagactatgggttttctaggtatagaatcatatcatctgggaagagagatagtttgatttcttctcttcctatttggatgccttttatttctttctcttgcctgattactctggctagaacttctaacatttttctaacatgctttgattgtatttttaatgacaagggtctttaagattccttagtatagctttctaatgtaaaatacatgtagctttttttttaagtgagatgtggggagaaagtacttttattacatgacatggttaaatgatcaatctaaaaaacacttgctttataattactttaacaaagtaaataaatgcatttccagaacagctgtaatttttaaattggattttccttcattatcagtaatgatttattgattaacaacagcttggtgggtattgagtggaacacagagatagacatagtgccaacctggtgaaatcagaaacttaattagattgtcaagtagaaaatgattggaaacagtttccgtttggtaactcactttgctaccacaaaatcagagatttgatcttcatgtgatcttgttatccctgcaaagagaaaaacttcatttcacaacctaatcctatcatcttatttcggagatgtgctgttgatcatgaggaggaaaggaaagaggtatgaaagaaatgcttactcagtgcagaagtgagccataggtattttgttgtgtatagcccaacagtgagctattaatagaagctgtgttttgtgtctataacaggcatcacattgtttaaaaaagaaaatatgcacagattcaaattctactctcaaagttcaagcacagtgctagtatcataggcatcttgtatactgcctgcatcattaccactaggagtctaaaattgaattgtacccttggtatgccaaaaaaaaaaaccattgttcttagtaaatggttaagtgttttcatataaagcttgcaaaatccatgttcaaaccaaatatatgtggctttctatgcatgtaaagagacctataaactaactgtctagttgttttgcagttaaacattttgtatttgggaactgcattccctgtatatggagaggaggacagcttcctcctggctctctcctaactcctctctggtacttggcctcttgttttattccctgtgctgattagaaaacaacagatatgagggaatgccctaatgaatgctataggctatttctctgatctcatgcaacaatctggaaatgagatgtgcacattgattagctgccttcagggctgagtggaaaagaaggggcattttcccaccgtttgtgggttagccctccatggatttaatcaagtccacacctggcctatggtccagcgcatcaggataattacatgggcttttccttattgtttaaccaccttcacccattaagaaatagcagtgaaagaacacatcggacctcttgtttctatggatttcctcccctaagtctttggagtttggaggcactaaatggattatggctattttgctttctgccttctaatgagtaatttacagcctgcaaattttaaggattaaacaaatggctctgtaaaacaactagtctcagtaatggatttattaccttcttcaattccccaattacaattgatctctctttagctaggctgctaattattagaaaaaggaaacaagttttaatctttataggcatcttctagcctaggattagaactcacaattaacagcttgtatcttagatgccaccgcctgatatctaaacaagtacttgcagattaacaaaccacaaggttcaggaagcctacattaagtctgcaacaaaaagacctgtgagaaagaccaccctgttgaattccactgataaggatttactctaactttgctcattactctctgtatgtgtgatcaaccttcaattaatcaatcaacaagcccatacagagctagctttattctaattttgtctcttctaggcatcaggagtacttttttggtttcgatttcaaatatgttttcctaatgttctcttgaaggaaacacaatgtctcaggctatatgcccttatttggaatctttaaaatgtagtcgctgaaaccatggggagattggagagaaaaaggatctaacatgagcctatagggagcagcgatttcttggatcctggtgcccaggccatatgtggggaaatagaaaataatccagagctttaagaggagtataaaagagtgccagattagtcttctttaatatccttccaacactacaacacatccactattgtgtgctttgaggtggaaagaggtagaaggaaggaagtgaaataagtgtaagaaagacagagtagtagagtacagggtagcatgttgatgtgaaaaattttggtcctgtagtcaggcagatctgggtgtgtcctggctctacaacctgcaagctctgtgaccttctgcaagttacttaaaacctttctaagcctgcttcctatctgtaaaatgagaactatgtctatcttacagagttagcatgaaaactaaatgaataatatatgtaaatcacctagcacagtgtccagttcactgtaggaaaaaaatatatatgtatatatttatatatatgaaatgtatatatggatagtaaagtagtaagataggaaaaacagagaaaggatgtttagagggttttttttacccactcatgaagggaggttggattcagcactctcctaagaacatatccttcatgagagtggcacacccatctactcaaggaatggagggttttgcacagttcagtacaattaccatgaacaggtaacactgaacagaagaagttcaaggtgaagtctggggctatacatttcaaggtcatttatgtttcactgtgagtttttctgtgtctctgttgtatcagttccagctgagcagaccctttatgaatattgcctattaacatattgttaatgcaatgaattaactacttttccccttagttagaaagtggctgagattttttaatgtaaatgttgctatactaattgacctaatttgttcataaaatgccttttaaaggtcagagagttattaattgtactgatgttatgaggcttgtacccttccagagagagaggacacaagcttcttactgtcccccactgcctgaagtctttgtactcaacataattggccttggacatgttgttctgtgacctatagacagttttagtgcagcctccaataattaagtaccttgttccttctctttgccaaagtgactggggttaaaaatctaactttccctgtggatatacaaatcaaatgttactgttgctgatatcatcaacttttttgttaattgaagactttaaacaactgttattataataacttgatgctaagtaaggagacacaatcatttttgtcaaacaaaactttggtctattttctcagcacccagagagtgcccctttattaactttgcttttacacgtaatggggctattcttatcaacaggttttgatggaatttgttatttgtgaaatgtaaaaaaatgacatccacttgaagtccctactagactctttgaaacaccttttatggtaatgttccaaatctttatccaagttaaaatagattttaagtgttctctttctaccccttacttgaaacatctgtgaagctgtatcgaagattggatcgctggaagacagttattggtatcactgctaaaaacaatatgtagtatagtatgtgaaccacagatcctgtatcagtggatctccttggttgcacattggagtcatctgtggagctttaagaaccagcgattctaggcccccatcctcagggaaaaatggcaatcaggaaatgtcaaatatcaatgtggcaagccctttatagaacactgtccagcctggacaacaattcgtcatcacccctctttgaacatggtcgtccaaccaaaaaataacactatcattctactcacatttatccattttgtctaaaaacttatgagtaatactataaaagcctaattgaagtcctgatgtgctttatgtcattctctgatttaccagttgagtagcactatccaaaaagaaatgacattagttcagcatatgcctccatgatatgctattttcttttgcaattttgcttcttctgaaaatggagttcatcattaaaatgggctagctgctgaccgagtagctagcatatattggtgcataataaacccatcagtctgactactcatgattaggagtgcattacctatatggcaagggggaaaggaggacagaaatctaaaatcagacctcttatctacactagtaggcttcccacttcccttttcctgcacttaaagcactacagaaatgttagttgttcttatttcttcttgtgggaacagggaaattataattggcttatatggctagagaagagagttaagcagaataagagaatctctagtaactgaaaagcaactaaaggctaaactgtttctaaatccctccaagcactgggactttgctgtggattggaatgtctgggtttgatggcgtgtgctcatttggaattaaagtcagacataaacttcctgagtgccagagaagcaagcatactttgctagcactcagtcaatattgttttgaatgtatttcaggaagagctgggagcattcccttcattttccataagccatgatggaacagcaaggtttattgatggtttgttgacactcctcctattttgagggcaaacctatgcctaaaaggagggggaagttgggatcactacaactaaaataattacagaagaataacagggttcctttttaatcagaaaaaaatattgcctgtcaaaagatagacagctcttaagaatcattggttgttaggaattcagcataggaaaatgggacttagccataggaaagctgcaagtctcatttagaatgtaattcagaagcagacagctcaaactggtgaattatgacccagaaaacagccaaaggagaaattgattccatagcaaactaaaatccaccaagagaaaatgagagaaagaaagtttatgctactattatgttataatttctcagaatccttatagcatggcttgggagtaaaacaaggatgcatatgctgattgccctaataggtaccatacctataactaagtagttaagtccctccagatcaaagttaattctaaagagacaaatcatggagtgtgatgatcggcatttgcgcactgaaatgcccatgcacgtgttttatcctatggcttttgaaatctgtgtttttgccaatgaagaattattttaccaagaaagttggagttttcttaataattaagataatttctgacctttattgtcattttgattgataccttttccaaccgggttgcaacatcattgtagaaaaccctttgcattctaataaaacagtactctgaagtgtcttagataagacgctctgcagagaaagttaaatcaattaaggcagtgtaagaattgtagctgggagagtcagagttctaacattatcccaataatcaaactgacctttctgttgtagcttttttctttcttttcttttgctttatttttcttttcttctttcctttgctttgttttttttttttttttttgtaaagaattaccctcacgctcagatggcaaagttcatcagcacattttttttttttttttttttttaatctaggaggggccaatgactgtgagagatctagacaaggaactttctagtgtctctaccaactgttcgcattatgcgggttaaagagtgaattgtattccgatgtctgtcagtcaagaaatccataaccttgtgcaggtttcttcttgctgagcctacatttccttattgcttcaaaagagtggaatttcactagatttttgtttaccagtaggctccacaatgccctagaataccatagagttccttgagggtattgaaggagccaagagggaggtaaccaggatagggctcttggttccaccagaatagttcctttttaattccttttctgtcttgcgccatcacatgagattttcttaaataaggctaaaaactcgtgagtcccttactctgattctgtgtcctttagctgtacacagcctacagccttccccaactctgccaaaagggccatgttttgtgtgttgtctctatgagtctctatgagtactttcagaggagtggtattcagaaagcagcttggagacatttatctcatcatctctggagtaaatctgtatcccacagaatggaaaaatcctccttttcccaccaagcaaagacacttgatcatgatgtgaaatatactgtatatgagacttggtaacttcattctgataataatcttgggaagaagccagtgaagaacactgcagtaataaagctattgcagggacacaaggttcctcactctgtagtagtattaaaagaattgtatattattatgtacgggcctgttcagctgattaactgcatataaaaatagaagttgaaatcagtttatgtgactagtaatgcatgtttcacagatcatatcacagtcagcctgttttaatcctaatatggtaatttggaaaagcccaaaagaataagagtgctagtcccttcttgcactaatattctgaaatgaaacatgaacaaatgtataatattaaatattaccttaggactagaaatttgttgtgtgttaaagagaaaatgggaggtgaggaagttgataaaccaagtatacacagtattttgagaagttttgtgggaaaaggaccaggagcaatggagcagtcacagaatgggacctaggatccaggtccccttggtctcccagattgtctagcccttatctatcttcatttctctttgtcctcattccaccagcgatattctcctcccattgtcttttggcccctgtttttgccctaaagttttgttttgcttcctctgcttctcacagcttcttgcctctaccttttgcaccattttgctttccttcctttcctagctctgtacctacccacatccctacttccaaatgccctatagttccaaaccttgggtactgctttgagtgcccagggttgcttcataagcacaagcagccccctctgcaattcttagcaagcattattagttctgagaatgagcacacatattgttggagttatctgtaatttattttatggcattggtcagtcctttgtgcttgaaaggagcacatttaagctaggctaacagccagtgagtcagccctacctaattaccttttactatcaacctataaggggatagatctataataggttcattttaaatagccttttaaggattaaacaacaaaacaataacaattgtccctcataatttagtgaccagtgagaacttctatgtaagacaggtaggaagctaaattagaccacattgctcattcagctatcacactgaagttttgggttgagtaagcccaagtatggaatacagcgttcattataatgtgattatttctttttgtatatttggccctcattactctcttctaaaaaagacatggcagacactttcatgatatccataaacacatcagaggcagcaatatactctggcttttaaactgtgaaatcccaggtcacgagtaaactaagtcataaggtgttaagtcacttgttggcaaatatctctcataaaacactcaaagttagttggagattctaaaacaacaaaagaatcagattaggagtcagttgcaggcaacaaccagctgcatataaaccttcaatgtagatagatatatacgtgtgtgtgtgtgtgtgtgtgtgtgtatatatatatacatatatacatatacatatatgtatgtgtgtatatatacatatacatatttacatatatatgtgtgtatatatatacgtatatgtgtgtatatatatacacatatacatatacatatacacatacacacacatacatatatatacacacacacacagttgagcctctgatccacgggtgtgaaatccatggattcaaccaaccacaaatcaaaagcattttttaaaatgatggtttcattgtattaaacatgtacagactttttcttgtagttattcccaaaacaataaagtatgacaactacagtcatgtgctgcataacaatgttttggttaatgatggactgaatatacagtggtggtcccataagattataatggagctgaaaaatttctatcacctagtgatgtcataatatcctaattcaatgcattacttacatgtttgtagtgatgatggtataaacaaacctacttctcaagaagagcttcaggcaggtccttcaggaagtatttgcaagcaaggtattgttatcctaggaggtgacagcgccatacaagttattgcccctaaagtccttccagttggacaagatatagagaggggacaacagtggtattgatgatcctgacgctgtctaggcctaggctaatgtgtttgtttgtttcttagtttttggggaggttttgttttgttttgttttgagacagagtctcactttgttacccaggctggagtgcagttgtgctgtcttggctcactgcaacctccaacccccaggttcaagcaattctcatgtcccagcctccctagtagctgagattgcaggtgcctgccaccacactcagctaatttttgtatttgtagtagagacgaggtttcgccctgtggcccaggctggtctcgaactcctgacctcaggtgatccgcccgcctcggctcccaaagtgctggggttacaggcgtgagccaccacgcccagcctgtttgtgtcttagtttttaacaaaaaagtttgaaatgaaaaaaggaaaacatttttaagatagaaaatgtttatagtttataggataaggatatttaaaaaatatttttgtacagctgtacaatgtgttttaaactgttacaaaggagtcaaaaagttgaaaaaataagtttataaatttaaaaacttacagcaagctaatttattatcgaagaaagacaatttttaaataaatttagtgtagcctaagtgtacagtatttataaagcctatggcagtgtatagtaatgtcctaggctttcacattcactcactagtcactcagtgaccctgagcaacttctagtgctgcaagctccattcatagtgagtgccctacacaggtgtaccatgttttatcttttataccatatttttactgtactttttctatttttagatacacaaagacttaaacacactgcactagtcacctacagtattcaatacagtcacatgctgtacagatttatagcctaggagcaataggctgtaccatatagcctaggtgtgtagtaggctattcaatctaggtttgtgtaagtgcactctatgatgttcacaaaacgatgaaattgcctaatgatgcatttctcagaatgtattccccatcattaagcaatgcatggctgtatttacatggcatttacattgtattaggtaggtatcataaacaatccagagatgatttaaagtataggggaggctgtgcataggttttatatgaggaacttgagcatccatagatgttggtatctaaaggggttcctggaaccaatcccccatagataccgaggaatgacgtgtgtgtgtgtgtgtgtgtgtgtactagacagtgggcaatatacaatactgtatgaaacccctctacctctctgagtgggtacctgccctttgttccccatttccaaacaggtagagaatgattgacctcaagaggacccatttcttctgtacaggcagaggtggatcaattaaaccagtagcttatacacagtgtgcttcactccttgaaaagcccttgtctgccttttctaggagcactcccataacagagactgggaacagtgagacgtggtattgtgcagtggtcaagagcatgaactctggattcatactccctggattcaaatactagttgtgtgacattgggcaagttcttcttatctccacaagcctcagtttcttctcaattggagatcaaaatagaacttattataaacagtctaaaataaatttcaagggtttatatgtaaattgcacaagctaatagtatcattcagtaaaagttatctattaatactttccatggatataacatttatatagatatcaaggtatcaatgaatagccctcttatagttcagttgcattgtatgttaagtcgacttttagggctgggctggagccctgtcaccatgtatcatatgatttccatggtaaaatgtgttttgcatctcaaatattcagcctacaaagaaatgtttgtactgcaccctatcctctttgtaaagtgagtctttatattggtgctggggcccctcatggttgctaacacgtttccatgtaagtcctctggtttgttttctaatttcttaacttaaactttataaactgttgtaatgaactgaagtcacaaactaaagctttttaattaagtggttagtcctgttgcaaaactgccttaataacaatttattgagtacatatggattgtgtggggacttctttggagaaatgtggtaacttctatgatgactgctttgatcttttttaactgaggaaattgttaatatagtaaattgaattatcccttaaacttggtaacctagttttctcttagtacttaggtaaattcagttgcacatcagtgtcagtggaaactttgatgtttgtgtgttattaccaagatatttagagttattatgaagaattcgagaacatcagaaacttctaggtaatgcttatatcacaaggaagaaagccaccgtttttctggccaaaggttgtatttctaacattataaataaggtccgtaggttatggggcctatattgcctcacctcaggaagaaagcagatcttgttaaatgatctaatagattaatcaagagtaccttttctgttcaagaacagccagagagaataagtttctgaactatgtttcaagttccagagaacactttttttcttccctttctctatgggtctttctgcattggccatgttttagtcatctttttccagttttccctccctttggtgatgacatccccttacatacactattcatacagctctcttccttctcccacactgaacagtggggtcatcagaagttattacatgccaggcctgttcagctcagaaaaggtgctatttttcattttctgcatatcttcttagattttaataggtcacttttaggttctgagctttaatacttatgtatataagtctgttatagtctcagctcagttaaatttaaacattttggctattttgtccagcaacaaaaacatttattgatcacctattttgagcaagttgtcacaaaatccacagttggttataacacagctgctaccttccatgggctcacaatctaggaaggaagacagacctgtaaacaaataacaagtgttcatatataatacaatgtaaaaatagacatataaaccaagaactctcagagttcaaagaaggaaatggctaattccatctgcagggtgaccatagaactatcctggtttgcttgagattgagggacacaaaaccttcaatactaaaacccaggatagtccccagaaaaccagagtggttggtcaccatgtttacctatctaggagagatggagaagacttcaaagaggagatggcattttaaccagtgcttgaaaagcaagtttaccaggcacttaaggcaaatgaggatagcattttaggcagcaatgaaaggcatttcctattcagggaatgatgaacaaattggtgtgagtagtatgtgagcttcagccagtgtgtatgtgtgtggcggggcgggagaggagttgggagaagggccctagggtgagaagagaacagatggaaactggaactggaaaggtgggcagggggcaaatcatacaggactgcctaaggaatctttactatgtcctgtgaatcagtagttttcaaacaactataatgatcctctggttccagtgaaaccttgcttggaagcacaaataaatggagaaaaatgcacaaattttctgattgaaaaaggtatgtgggctggacgcggtggctcatgacctgcactttgggttgctgaggcaggtggatcatgaggtcaggagatcaagaccatcctggtcaacatggtgaaaccctgtctctactaaaaatgcaaaaattagctgggcatggtggtgggcgcctgtaatcccagctactcgggaggctgaggcaggagaattgcttgaacccaggaggtggagattgtagtgagccatgatcgcaccactacactccagtctggcaacagagcaagactttgtctcaaaaaaaaaaaaaaaaagaaagaaaatgtatgtgttggggagagtcttagagtatctcctcctctttctccctgttcttttccctcttaactgctcttaagaggaattttggggagcacagtttgaaaaccacctctgtggaccatggggagtgacaaaaaattttaaagcaggaagtgaatgacatgatgagacctgtgatgagataagattgttaaggaggatggactgaagaataaaaaagcttgaataatggaaaaacggttaggaggttattgtaactttggaaccatctgaaagaagcccgactttaagcaaagacaacagggatagagagaagtggatgggtatgaaagacatttctaaaggttgcattaatagaacctggtggactatttataataagggtgtggagcggggaagattgctgggtgaggaagaagggggaaaagatgattatatggtttcttacttaacattagaagcaaccaactagtatatgggaaatctgtagtctaatttctaatagccaccttattttctttgagttttcattagctcagataaaaccaacatgttatcactcacacccagaactattgtccttaatctttcttcatctaatacttgactttgctagtaaaaccctttttgttgtcattgttttattggctacaactgtatttgtctctcattagctgggtagtgggtagcaattttcttttttttactaagagagtccccagcttactcacaggatgtgttccaaaagtacatttttaagttaattatttggacctcagagtacattttcccatagaagtggcattatacatagtgattaggttcccaggccagtccacaaaagccagtttagcccatatataactgaaagtgtggatttttgcaatggaaattagttgtaaatgatactgttgcaattaaaatgaaaacaatagttgcaaaagaaatagtctgggtttttgtttccctcaaagagtagggcttgatgaaaagcaggtttaatcctaggaagacaaagagaaatagatggggatttttgtgtaaattggacactgcagctttttaactgtattttctaactaatgttttggaggttttaaaataataaaagcaactgtgtccattgtagaaaatttgagaaattaaagaatacatttcaaaaattaagtcaccaacaatcctaccatccagagagaaccagtattcacaaattggtgtgtttcagcctttttcttaccgcatgcattttttaatcagttcaccaatagtaattatggtgcatcgacatgatgaactattatgcagctcttaaaatgatatttatgaagaatttttaaaacatccaaaaatatttatgacatagtgttgagcaaaaggcaaccttgcatttgataccttgtttatggatgagggagtataagcagatcaacactaatcaaccagggcaggagtctgctgttaggccaccagtcagaacctcctactatcagacccaccccctaacaaaaactacagccagacctttttgttgaagttctgaggaggacataagggttctttgaagtactgtagaggttcgtagcactggctcttcattacttcagattttccttcaaattacagggctttcttctcccttgatgtactatttcactagcactactcaggcttaacaactgtgattaaggtcatttttttggattcataaatggaatggaaaaaaggccaagtatttccttaggtaattatgcatagattggagagagatgagaaggactcaggtagagaagatgtgtatgtactttcaaggaagaaaattatgtggaatagaatatattaagctaagaatggtgaaagtaaagtgagaaaatgagacattatagcatgaatacagatctacagagagcggaaacgagtctgggaaaggaagaaagaggtgtgcttgtttaggtctgggcttggctacagagcaggaaaaaaaggaagaacagtgactttggggaagttgtagccagctgaaatcaaagttttaggaggaggcagcgaatgcaatttgtagcaactgattttgttttaataaaggaataaagatgtttgggaggacaggtgcttcaagtactaatcatccaagaagaaaagcagtttgaacttaattgactatatctgctatgattgtgcactattcgattttagcccaatcagtgattttctaaaagcatcccatctccttttagtcaaaactggatttgtcactgacttgtatgttggcatggaggtcctaatagctgccacctgcatttcctgttcatcaatgaaggtattgaaaattacaaaggaatgagagttgggggaaaggaagatgttcatttcgtaggggtgagggatgtatttacatgtgggtttttaagtgtacagtactagaaggaaaagccaaaagtttccatgcattctagagaagcatatggcattgtaattctcacacattgctatgcaagacaatctcctatggaattctgtggctcttacctttggtgtacatacgacgcagagattctgagttattatgtgtgaattgggctccaggttctcagccagggattctcattgttggttgtaaattggaatcacctggagagcttaaaaatattggcacctaggttctgttcccagaggtttttacttaatttttctgggggtgagaactgagcatggggattttctaactctccccaagtgattctaatgttcagacaagtctgggactctctagtttagcccattgcttaattacttgggtggattaaactagttgttcttaaagtgttgtcctggaaccagcagcttcaacatcaacaggacacttattagaatgcaaattcttgggcccctgcccatatttactgaaactcttggggtggctcagaaacctgtgttttaacaaaccctctggatgattctgatgcatgctataaagttgacagccactagattaaacggttgttcctgaccctttctaaagtacatctgtgggagttgctaaaaacaagagatgtcttcaagagctgatgaaaactggcctgcaaaaggacttttacagaaatacctataataataataatagaagctagagtagagaaaggggaaaggggatgataatttgctgcaaaacctgggcaagttcagggggaacatgtcttcatgagttagggagtttgttgcatgggctagtaataccctggcagtacctgcaggcaaactcctacttattcttcaatacccttttaaaatgtcagcctcctctgtgaagctttctctgagctgtggtgtaaactacttcatccttgtgtttacttagtgctttctagtttcctcgattagctcttggcccactgtactgtagctctctatatatgtctgtctcccactaaactgcgtgatccttcaaagcaagaacactgtcttattcatccttagctctccagtgtctaataaactatctggtacatactaaatgctcttgaattgtttgcttagaggggggatcagtaatggccagctttcttgtatcaagaaccttcagctgggcgcagtggctcacacctgtaatcccagcactttgggagaccgaggtgggtggatcatttaagttcgggagttcaagaccagcctggccaacatgctgaaaccccatctctactaacatggtgacgcgtgcctgtaatcccagctactctggaggctgaggcgggagaatcacttgaacccaggaaggcggaggttgcagtgaactgagatcgtgccccgcactccagcctgggcaacagagcaagattccgtctcaaaaaaaaaaccttcaaaagatgggtttacctttgtgaattaatcgtagtcctgagttcaactctgactagaagactagagacattgattctctcaggccatcatgacttgatatctcttagtggtggccttataccacaaagctctcagagaaatatacaattattagcaacttattattttaccatgataattggcaggtgccaagactactattgtcattttttcctcatatttcctctcattgtagatgcaccttcatgggaaatctaattaaaatcaatagggatacagctgccacagggtaaaagtatttgagttcttgggccccacagcttgcctctctcatccaggcactggcatcttctggttcattgtacttccctaattctataatgtactctcttcattccacatctattcacaaacattcttcaaacaagataagcacttagcaaattacaattacctttccattgcactttcccaaggttatactcaggtcaaaatgaatggatgtatgtgtattccccaagtctttagagaaacagatttacaggcaatcctttggtttaattttctagatacttaatcacatattcgttatatgtgggtttttactggcttaactctcagaggacaaccatataaccttatttttaagtttttggaggtaggacgacacttcactgtcacctcagttactgccaatattaatcatttctaaatgttatagaaactttgaaatatatgtgtcattctctaaagtggaattattaagacccagaatgtaaaccagaagaaactggatttttgccgtctgtgccaagccatgattttaatatgtatgtgctgaatggatttttctatttttttctacaggcattgtatctgatagccactaatggaactccagagctccagaatcctgagagactgtcagctgtattccgtgactttttaaatcgctgtcttgagatggatgtggataggcgaggatctgccaaggagcttttgcaggtgaaaataaaataggacaattacaaagagaggcattatactcagcttttccatctcaatgtgtgacagagagctctgtcaagagatgtctagagttaggctattaccattttattttagaccacaggcacataactataggcacgcatctaatacatgattgattgacgtgttgcctttcttctgagaagttggcagtgtaatctgtaaatctcttttgttcttcctggagtcttattttgcaaggaaaaaaaaaaaagcaatgtgaccctctggtgttggtgttttgttctaaactttacttgtgcccctggatgttgtatgcaggtgctcttggccggaggtaattctctacataactatgcaattatttccatggcatttgctactctaatgctttgctggtcaaagcccctttgcttgtgatgccaattggcaggcacctgcttgcctgggtgagtaccatccagtggtgagtgcctctgtaaccatttgtccttttcacggctcccagggattagtatacatgatgagaaataatacttactatgtaccaaattctttcaataaattatttcatttttataacaactttatagggtaggcattattatcccattttatagatgtaaaagttgagactcacagctcttgaagggcagagctgggatatgagccctgaattgtctgactttccaccacacgtcacacacaaaccaatttagataaaaatatgtctgtatttgataaagcagtacgtgcccaggattatacacatagcttcactgctggggagtgtttctcagggacatgtatgaagacatttaacatctaagaacaatgactgctatttttctttgtgattttgaacacataagccaattaaacagaaggtgcaacacttggttatacagcgcattaaccacagattgtctgttctagcctactccctgaaagaaaaacctgttcctgttgcttctgaactccttccagagacagagctgcacccaggcaaaaactatcccaccctaactcagatcatacctggaataaacctatttggagaaactgaagagactacatcttttcttttctgctacctgcaagcatttcacaggttatcatagggccctaaaatgtcaaatctggaatggccctttgttaatcctctaattaatccagcctcaaattacagatgaaaagacaacttttgagtacatcacttttatattttttcacccctcccaccactccacatacacattctgatacacattcctcttatatcttcttgtaaggataattgaaggtgtaggttatcttcaattggctatccagataaatgtggctatccagctaaatagatcattaaatcaattatctagttaattcattccccaacaatacttttatatgaaccagtcagataactgatacaaaattgtattttgagtctaaattgaatagtttattgcgtcttttcattttatatatgtaagcaatagcctgtgtttctctttgagtccatgcaactccattctctgactctagcctattattgccattttcaagattagaaaggggagagatgcatgacattcaccccactggaaggctggagaaaagacacaggtcttcaatatttgtgtgtctttctgtatgacctaagacagttctgtccatcaattgatatttattgagcaacttccatttgtaaagcataagtgcagtgggtgatacaaacctattaaaaggcatgattcctccatttaagaagttcacaaccttcttaggtacatgaaaatataatgcaaagctgtttacagactcattcaacccaaagagctgttcaaatagtaaatgatatggttgattagagaaatacttctgttagctaggggtgatcagaaaatgtcttcaaacaggaaagaggtcttctgggccttaaagaagtgatcaggtttagttaagttgaagaaaataagggaagggatttcaaatggaaggaagtgttagggtataaccaaagacatatgggcaaggtctacaggaacagaacctagaaagtgtagctgaaataaagagttcaagtaaagaagctgcaggggataatcctatggtgggccttgaacaccaggcttaagagttggggctgtaggcagtggggaaacactgaagatgtctgagggacaagcatgatgacaactttgtttatgaagattaatctggtagtatgtggtaagaattagcaacaggaaaaaatggagacagggagaccaagggggagttattataatttgggattaagatgattaggattgaattagaaaaagcaagagatggccagacgtgattgctatgattgctatgcctgtaatcccaacactttgtgaggccgaggcaggcggatcacctgaggtcaggtgtttgagaccagcctggccaacatggtgaaatgctgcctctactaaaaatacaaaaattagccaggcatggtggcatgcgcctgtgatcctagctactcaggagactgaggcaagagaatcacttgaacctgggaggcggaagttgcagtgagctgagattgtgccactgcactccagcctgggcaacagagcaagagtccatctcaaataataataataataataataataataataataataataataataagcaagagataaatgtaagagacgttgagaagagagtacccggtagcttattgcatttagaacataaagaagaggaagacaaaagtgacttcaggctatcaagtcaatggtagcattcagcaagaggacaagtgatggaagacaatataatagctaacatttcttgaccctatgtaacttacaagggattgccacttacctcatttaaccattttaataaacagagatgaggatttaacctaagtgctctgactccaaagcccctgtagcttacattacacaagattgccctgcttgtgagactgtaacataactttttaaatgttgaatttaaggtgacagaagaaaatcccgtaggaaatatccagcaggaaaactaggaccagagttcaggaaagagatcaggtcatacactatggatttaggagtcatctccataaagctgatggtgggttgaaaccatgaaagagaatgacatctgtaagaaattaaattaaaaaaagaagatgatgacagccaagttcttatgagtgggaggtaggaggaggaagtgaaaccagggaagaaaatggagctggaatattcagtgcacatgcgcatggaagagacccaatatggtagaatgtcacaggcttctgaggcaaaaaaaataaattaaaaaaattcaaagaaggaagggatattcacttttattaagtactgcagaggggccaaaagagaaatggtagaggcacagccgttgggtttagcagttagtaagccattggtttcaggacagagttctctagtggttaactaaatatactttttccaagcatgacagcttctctagataaatatatcagtttaggaaaatcagagagtcagactgttgcaaacacagtgaggttttacaagatccctcagagtttctcactctgctagtcagcttccagaggatttcatgacaatgaagtacaaaaacatctgaaggacaaaagctggcaccgtttttaattaaatgatatttaattgggtgttcaaaatatatcttaattcaaaagggctgcttgaaaatgtaaagtaatatacttgttggaggaaagaattccaataattcctctttttccttccttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaaaaaaaaaaaaaaacaaacaaaaacaaaaacaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaaatgggaggtcagtgaaggctacatcccaatcaatatttggctctaagtacctcttcccatttttcctatgtatcacctatttctgtttcggaatatggtgtgttcatgcttagttctttgggcttttgaatatcaaaagcatattcataaatgtcttgaaattctctccagtggaaaataattttaacttacaatcatatcccaagaaatgtcagtccgacagaattccttatatgacttggggaaaataacaaaatttgactactatttcaccatatatctatttattaaaaaattcaacagttggcacttcctgaatcttctgagagtagaaaaatatcctgcggagtgtctgtgtagaaaaggatatgcctctcttttgagtgtattgacaattttgtaaattacagaaagttgtttctctaagcctttgaaaaactaacaatttgtgttatagaaggcttcttaatttgcagtataaaagaatctaaacagaacttatgtacattcagccagaaggggaaagagatcagttacataggcctctctccttctttgccaaggtacatccatccatctaaccatccatatatccacatcttaaaatgaaagcactttctttagagtttcagcaaactatatagtgtacgtgtttatgttcaggagatgaccccactggtgtatttcctattttccctattgttttctttgactgtaaaagttgggagaggcttgacctcctccccttgaaaatgtccacagtgggataaaacaac

SEQ ID NO: 17434 - DNA, 312474 bp, Human
aataaggcttttgctctccctgagcactgcttctggttgcatctgggcttggagtggaagtctcagctggactgcagtttggctaaaaaaagggaaatgcccccaaagttttatccacggtcacatattctactcaccctcatgccaaagggaagacggcttaatcacaacatagacctcccttgtttgggagactgtatattagtttgctggttcacagtaaaactgcctttgaatgaaaggcaaagaatcaagtgatttttttttttcagcgaccctcttggccaatctttagaaacacttcctgaagtatttaagttgttaagaggtggaagctccaccctcacttcttcctccccaactcccttccccccagacacaaactcttcatcccccagggtaataattttcttttctccaataccttgctcccatacaaaagctaaatactctccagaatattggactgcctcgggactaggaggactaacgacaaggggaaaatttgtcttgcttggtgccccgagcgacttttccaaggtaggctaggaggagagtgcttagggcttccactaaacatagctactaccagcttcacaggctccgcaatgaaaacactcggccatttaggcaagggagatgattctggcattttcgggagcttacacttaggctcccagggcgtgcagagggggttaaagagcaacaggaagtacagtggagttttctcagagctagggattgttctgagaatgggtagggaaaggttttcaggtaccagcccggcgtccagaaaggcagagactcacatgcccctttcctgagagcgctaggaagggagataaaagacaaagccaatatttggggctgtgcggccaggccatgaaatgctgccagctagtggacctatgcgcctgcaggttgcaggtagaagtctcaggcttgtggtgggggtggggctatttagccccttccagttgggctcaagagggtggacattctgagcgccaggctataaggtgaaagaagtggagaggtgcttcatgtgaaaggaaggcgtaaagatcaaagagtggcccaagtgtccggtgacaccgcccctctccctccacaacagataccactaagcaacctagccccccgcccccatcctacaatatcactttccctccctgtatcaatctaggctggatcttgggagatcgaccctatgggtgagaggggcacggatgggagaattaggtagctccaactagattaatctagatctatcagggatccaagcctgccccataggaccccaggtcagtccctggcgactcagcgctccgctgtctccctgtcctaccagccgcccgccgcccttactcccccaggttcaactccccttcctcctgaatgacctatggtcgccggagcagcctcgccaccaccggcccagagcccaggctgacgggggtgggcaaaggtcactgcccaaagcaggggatattcaggccaaggggcaaagagagactctgctagccatatgctccgagggactcctgtcccctctacccgcacccgcgcttagcctcccacctcccctcccgtctctgccaccacccaggggagggggaggtctggggaagcaaacaaacgagacagaaaattccgtaccgaggggggagagatgagacggtgggacggggcagcgggggttgacttggggctgcggctgcggcttccttccacccctggccgcggagctgcaaagaaggcaggagctgctgcccctgccgcctgccccgtcctccctctttccctctcgcctccccgcctcccccgccccgccccgccgccaggagattgagagtggcttcggcccgggggctgggggaggtgaggggtgcttttgcctaccacggttgtctcaatctctctctctctctctctctctctttctctctctctctctctctctctctctctctctctcacacacacacacacacacacacaccccacatcacaaccacgacgggttgtccgcagctcgcagccaccccaaagggaggaataaagaacaggagcagagggaagccgggcgcagaaagaagggaaaaggaagagctcagggttggacatttttggagacaggggtggggaggataaagggagcgtgcctccttgattttcccctccccacccctctttgcttttctctccccttctctgtatagcatattccagaaacggcagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctcttattgtgtgtgactggctgcgtgaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcagggtaagtctacaggcggccggtgcggtccatttcactgcctgagtgctgctgaggggcaaggggcagcgaagtgcgggttgaatgaagatgctgggctgctgtaggcggagaagcattgactggctggctgtgggctcagggtggtagggagcagagggaggccagcaacagattgttttggaagaggaaatgcaatggggagaagctccagggttgataggacaaggtgctgcctgcgatgaccaaaaacatcctttcactgggaatattttcctgaaccacagctttgtcctatccctggacaatgatttgctccattcttgggtagattttaagatccgtggggaacctgctcccaggcctccttaaaatcgattagtgtggccctcggaccaaggatacctgcccttcgtcaaaagccaccttcagaaatagagagccaggagccggatcatgaaggttcaggaaccagggtccccatttaccttctttgtcttgtatccttcaaacttaagaaatggccagatttgtttgcctgtcttccttaaaggaaccaagaaatgcaaatggaggggcatcagtcagatctctgcttcaaagtggacacctccctccctccctagacacacatcgactcggacaaatggtcatgatcatgtcccacatatgcaggtactgagctgaattcacagatgctgatctttctccatggtctcttagaatgagactagaagggctttttccctattacaacctgggctctttggatcgcagtcatgtacctggtgatggttaagtgtttagcaaggttattactccctcaggaaaagcctgaagcggggaaaccagcctgaaagatagaacctctgaactttacccgagtttattataagagtaggagagacatagactaattgataatgctctttttagagattgtgcatgttaacccttggcttcaaatgtgaaatgattacaacattgacatggcacacccagacccacttttctattgccatatatttatcttcatggcatttaacaagaatgacagatttatatatcagcattcataattgtctattgttggtgtcataggttttttgatgttttattgatgatttatattatgtctcctttcccataaactctttaaaaactgagatataaatgatgtcacatggtacctttcatcatgtctttaaaatctgcttattctaaatcaaaaggcatgttaatatatttacatagtacgaagttcgtttcaaagcaaatatatagtctgggataaaagaaacccacagggtcaaggagtctctgaagctctctctgtgaggtcgaaggaagaattgaatgtcacctaaaatccacattttggtccctggaagatgctgttttcataaactttcacaatatacatagggagagagagaaaatctgtgtgtgtgtgtgtgtgtgtgtgtgtgtgtgtgtgtgtgtgtgtatgtagtttttcaaggacctcaatcaaccccatacaatcttggctctgcttttgtaacagaggggagcaggaggtgaatttgtgcttccaaagcacccaggttcgtctgttaaactttctatttattactatgttaccaaaatgcaatgaattgcctctttccaactcagcaaataagagaaacggattctgcattaagtgaaactgtttatgttgcatcaggcaattctttctaatgttcactgctgagagagagcagaatgaggattactcaagtaggatctgaaaaggtgcccattctgttactttttaaagcaaccatagtaagtattttcttaggttaaaattacactttcaaatagatatactaaagaccgggttgcagacaggtaggaaagaactggcagcatcataattggggaaaaactcaaaatatcagcacgaatgaagcctacagtgtaggttttgctctgttcttggtgatgtgagtatctggctgttgaggtaagtcctgatggttacccaggggataagcatgtgagcaggttcagggattcagaaccaatgtagcccccggcttcactgatactaattcacctggcttcagtgtacatctcaacatggagacctgaaccagatatctgccatccttcccagccacaagagctataatcctaagattctgttctttctatagctaacaactaaaaccggaatggcacgcagaaccacagtacttagagaagactaggccaggaaattagagatgcagaagggaggaagatgagaggaatatgagagaaccgaagatgttttgaaacaaacagaaagaaaactatccaggtgtttgctttgactgggaatggaattaatccagaaatcaactcatatgtgaagcatcttaaaattgcctgtatttgacttgcaaacactgtgtaaacaatgatagaattccatagtaccagggaattgggaaccttggagtacattctcagtgttgctgtctcatttctctccttacaatattaaattccaatctgcaagccattcaggtgcttagttattgaatggatatttcaaatgtgtcatgatgctttcctgtagcctgttttcgaatattctaatttattttttgccatggctccatcactgaaggtggtagattgaagcatttctgcctgctttacttctgccaaaggttcctgttttcaccttagtatactaagctgttcagatgcctcctgctaactgatgaagaatataaggcgcagaatctctctccccaaagtactctgtgccacaaggtgccactggcctaatctggcccagtcatttgccaggtttgcagggaaaggtatgacaaagtttgcagcctatagacagaaataaagcctcattctaggcagaagttattcctcatcccacagatgagggataagctaaggccagccatcatgtccagagcctagtagctgacatatccacagtgtcatcctttctaaaactcacgaagcttttcttctgttgatgggcccctcaaactttgtccagtgagaccagcagagccatactgccagcaaggaatgattcctgaatgactcaactgtggtcttataaacaaacatgtacatcatgctcaactgagtgagcacagatgatttaaagaaattataaaagctgataggggctaagaaaaattgcaatttgctgggtgaagggaactttgcaagtttcttaggtttggttttctgtcaccaattctggagttggcccttggatggtggtggccaatgcaattgccccaggtttttgccttagcaaaaggaaagaaaaaataacgataagaaacaagcggggatcttggaggggtcaatcctctcatttcacctatagagaaattgaagtctagagagtagaaatgacctgcctaaaacagactactagctaacaacagtggcaaaaccacaacccagtactgtttgctgatacgaaatacattttctgaagttctgtggagatcttcccaagaaatcgagaggtaactaaagtcaagtttaccaagatcacagccctctacttccattccatatgtatgtatacgtgtttatattatatgctgctgtcatatctttgtgacttaccttcttgaccaccacctccccctaacacacacacactcacacacacaatcctatcttgctagctaagaaaacattatatgtgtctatagctagcgtattcagatggaaggcagaattaaacatgacaaaaatttagctgctcacatttatgtgtctgatctggctcacaccaccaacagcaaggcatctagaaatcccagtctgttctgcaccatagtagttttggggaatggaagctagcagaatccagtgactatggctctggtttagtatactcagtctcagaatcagccccccaaatgcatgtgcaaatacacacacatgcacacacacacaaacatgcacatacagtcacactctttccgaaaaattaaaacaaagaaaatagaaaagataaggcaggtggtttttagagcagagtacaagaagaaggaaaggtttgcagacggatattcttaccttcccccattctttagccttattgcctaattttcattaatcccaccctaatttattttaggatctgagaaaatagagcaatgcaaacatgtttactacagcccagaaggatgatctgaaaaacctccacatttgagtgagaatatcacaaggatagggaaaaggctaggatgtagtgagctagagccttgctactccaagtgtagtccccacaccaggattgccaccatcccctgggagctatctataaatgtagaatctcaaatccttccccagaccgactgaataagaatctgcattttatgaagatccccagtgattcatttttatactaaaatttgagaagcaccgggctagagcttatccaaaaagcatctgaaagatatttgaaaataaacaattacctactgagcatgtagggacaattcatgtggcttatcaattaaaaaataaaatataaactttttccaggtccacttatcttattattcactgtaaaacccttcagtgtgggcaagagagttcatgtaaagggagtgagatcataggatttgtttatttaccaggacgacttgggtgtgggaactcacacagacctgagttcaaatcctggccctgctcacgaattactagctgtgtaaacatgcactttgcctctaagcctcacagtccccatctataaaatgggattaataatagtaccaactggcactgggctgtcatgaaaaattaaataagaccgtataatgcactgggatatggtgaacaatcaataaatagaagatataattcatacgatttggctaataattttagtttggtagaaaaccaaccactagatgtgatatattggggcacctagcattatttctaattgacgtgaatcttactgggttttctacagatagaatgctaagatatacaacagtaaaatatatttaaatatgatggaggccactagaaacaaatattttttcagaaggaattacaggtgtccctagtgaaatcactccatggaagaagactgaagtcagaagtggccctgttctatgaagcatatctcaaaatattaccaagttagaaagtcaaaagtgaggcattttctgcatgtttgcatatatatgcagcatgaaaacacacacatacatacacacacacggacgcatcatttgatggacaaattataaaataattcaaggccaaaatgacattctaggagcagaactaggtttctgcctgataaaatctttaaaatgcacaaataataacctctacttcgtaacttgctcatgttgcacagtttaatggcttaggtatatactatagctattactattttgtaggtgaaaaaaaaagagcaactcctacctcttcccagcccatggtgctacctacctgctcaattttctcaccagtaaaatatgatacacgtagtactcataaagtccaagaaatcaccaggcacttgattctataaagacttattgactggcatgtgcaatctgggcaacctgattgtaaagacacagagacagacactaccacctctggatcccagtcctttggtatgttccagacctccagcttcccctgattttcaatagtatcagattagtaaggtatcaataatcttataatagacaatatttatatctaattgctaagatttctgtgatcaccctaaataaacaatagcacgtgttatcaattattgactatctttatattagttttctattgctgccataacaaattctcacaaccttatcaatttaaaacaacacaaatttattatcgttatagttctgtagttctgaagtctgacacagggatcactgtgctaaaatcaaggtttcagcaggactgccttcccttctggaggctctagcagagaatctacttcctcacttactcagattgttggcctaattcacttccttgatgttacaaaactgaagtcctaatttctttggtggctatcattcctaacttctagagacaacccacattccttagtgcatggccccattcctctgacttcaaagccagcaagggcctgtttgatgagggggaactcagctggccaactcctgtctcttctccctttgcatctctctctggttgactgttctgccttcctcttctgctttgttttgtgcttacattgggcccactgacataatccaggattatctcctattttaaggtctgctaattagcaacttcaattatatctgaaaaatctttttcaccatgtaacatatcatattcacaggttctggggataagggtgttgacatatttacaggttggccatatcttgtctaccataatcttctgtgtgttgagtgctacaaatatggggttttaaatgacattcactacagtttctatatgataggtattattattattcccatttaacaggtgaggaaacaggatcagacaagttaactggtatgtttaacattgcgcagcttgtgagtggtggaggcagggttggaacacaggtcactcttcctccaaatcttgaattttccctgttggcctacattatgctgaacgtggcctgaaagtttgtaactcacataaaatatttaacctcaagaacgaacagaaaacgttatccttttgattgttgtcatctttacatagtggtcatcaccagaaatttttttagtagcttttagtctaatgataaagaccaaacaatgaagaaagattgacaggaatataaaatgtatatttgtttatacatctaggaaaaggctgatgaagtagtgatgggtaggtaaagaagattgtcgcaggatgtttgatgttgcaaaagagaggattttcacatttgttacggggcagttatgccaagaaagaggaaaatgagagggctagttggaaggatagaaacaagagagtgttaaggagtaattaaacagctcaatcctcaaagtggtaattgagcccctaatatcaatcacttggcgaatattcgctcagtgtgcaccaggtggaaggcactgttgggaatgcaaacaggcatgcccttccttttccctctaggaactttcgacatggtcagaagtgagtgggatgatgggagcaaacatgaagtgaaatcctggtgtggccaagtagggcatcatgctttaagccattcatggaaacaggcaggtacttccaggagatagagtggggaagttcagtctgtagaggcctttagatgttcaggctgtgctggatttaatttagtggatgaaaggaagatacgaaaggatttggagattttaaaaaaagaaataatgataacccatttgggaatgattattctggaaatggtgtgtaggaattccggattggtggaggagcaagcaatggcaggcataccagttaggaagcaattatagaaatttaggctttttgtccttgcgatagtttgctgagaatgatggtttccagcttcatccatgtcccaataaaaaatatatatatatatataataaaataaaaataaagatgataaacagaactttgctactcaaataaaaataactgatatggccttcaaaaaaaacaaaaggaaatttaggcatgaagagtagcactgtggttaggtacagaatctaggtccaaattcgtctacgtgtgattttaactgtgccactctgagccttagttttctcttctatgaaaagaaaaaactaaaagtacctgccttaaaagaatactgtgaagttgaaatgagttacatgtacaaagcacttagcccagtacctggccagagtaaacatgtgcacgttaactgttatactgttgttattgctgttgttactgtagtggtgcacttggaaaggatggggtataaaatacactgtaaagaaacaataatgttgaatggctgtgtgatgtgtgatgaaggtagtcagagatgactgcaagttttacctccttgctaggtaacagagaagtggtgccataagaaaatgtgaaggcgaggtgagataataaggcgaggaagataataagttggtaataagctttgatataagattaagcgcggagtcagtgtgagacattctagtgaaaatgaagcttggagtcagtgtgaggcttggagtcatttgaaaatgactaccagaaaattttagatgtgacactggagctcaagagaaagtttagggatgaaatgaaaatttagaaagtcacagatataacaatttttatctctgggctgggcatggtggctcacatctgtaatcccaccactttgggaggccaaggcagatggatcgcctgaggtcaggagttcgagaccagcctgaccaacatggtgaaaccccgtctctactaaaattacaaaaattagccgggcatggtggcacgtgcctgtagtctcagctactcaggaggctgaggcaggagaattgcttgaactcaggaggtggaggttacagtgagctgagatcatgccactgtactccagcctgggcaacagagtgagactccgtctctaaaaaacaaacaaacaaacaaacaaaaatttatctctaagaaatacatgtaaaatctccaagaaagaaagaagagagacaaaagcagatagttaaggtttaatctgtggcccatgattagtgggggcagaagagccacaggaagaatgattgaaggcaaaaagagacctgtgcaaggcactacagggaattcacaagaagaacacgccctgctcagtacaacttatagactcaggacagaaagcattataaagtatgaaatatataataatgacattcaattttaaaatataaattatcagtttcaaatataccttattttgttgactagaaaagacaggaagtcttcataagtattttagcccttgaatgatgagtgacatttggaaaaataacaaggagcacatttcagatgagaagaattatatgatcaaaggtgaagagttagaaatgggcacaccaagtttaagagagagagagagatcgatctgacaagagtgaaggaagataaggaaaggtaagagaggaaaaatgttcaaatcacccacatagctaaactcaagtcccaactcagtctcatcttagctttaaagttggaagtttcatgtcatttttttctgacataaaactcaactcccagctttctcagttaagtgattgagtggacagtgatgcttttaacaagaataaagtgatagaagaaaaatagcaggttagggtgaggtgataggagggtagaaaagggatgatgagttatgtttgggacatgttgaagtaaaggtgccagtgtgacatccaagcacagatgttaaacaagcagttagttaaatgggtttagaactcaaaatagaagtctgagctgtagatatagattagggagtcattatcccataataacaggacaataatagcagtgatgatgacaaatacttatgaagcatatactctatcaaaggcatggttctaagagttttccaaatagtaaatcatttaaccttcacaacaaccttatgaaggaaatgctgtttttatcctcatctaacaaaaggactaaaaccaaggctcagagaggtctcatgcccaaggtcacacaagtggtatctattggagacaagatccaaacccaggcaagtacagatccaaagttcgtgctcctcgttaccatactaagagtgagtgttagtagtcttagaagtagagtcacttactctagcagagcagagtaaaataggtcagctactgatccttgaaaataccaatatttcagaggtaagtcggagaaaagaatctttcagaagagaataacagcaatcatagagatagaaggaaaactaggagtgagtgatggccttaaagtcactgaggagagaatgcccaaaaaggggaatggatattagcagcattaagagctgcagccattggatttgacaattcaaggggctttgaacaatgcagtagttaggacaggggacagaaaaccacaagccatgggcaaaattgggcctaccatctgttttggtgtggcctcaagctaaaagtggtcttcacatttttaatgcctggaaaaaatcaaaagaaaatacatttcatgatgtaaaagttatatgaaactcaaatttcagtgtctatagatattattggaacactgtcattctgatacatttatgtattgtctatgacagctttcctactacaatggcagagcctggcaacagagagcatatggcacaaaaaccctaaaatcttctctatttagccctttacagaataagttagccagcccttaggttaaaggattagctgaaagtcaaactatctcagttcaaatcccaactctaccactgactacacaatgtgaccttgaaaaagtcaccaaatgctctaatgaccattgtcagtaaaatggagattaaaatggtatttatctcataggattctttttatttatttatttatttatttatttatttatttatttttgagacagggtctcaatctgccacccaggctggagtgcagtggtgtgatcatggctcacagcggccttgaccaccgcaggttcaggtgatcctcccacttccccgagtagctggaggtacaggtatgcgacaccatgcccggctaatattgtgggttttttgtttcgtttgtttgtttgtttttgttttattgtagagaggggggttacaccatgttgtccagactggtcttgaactcctgggctcaagtgatccacccaccctggcctcccaaagagtggagattacaggaatgagtcacttatcaagcccaacttcacaggatttttttgagaatcaaataagacaatttgtgtaaaggacctaacacagtgcctggtgcatagttagaacttaataaatgtcagctgctgttgacttttgatatggtagaaatgaagccaaatttcaataggtggcaaaaggaattggagatgatgtctatacaaatagaaactatacttttgaaaattttcacagtggatttgaggatggaggaggaagtaactttgggggggggcagttttcagttttagtggagagacttgaactcagggaaagggagaagtgaatgaagattgagaatctaggaggaaagaaaatgaaacaacaacctgatgaggtaggaagatcaagagtagagatcagagattaaccttagaaaggagcaggaataattcttcctcaagaaataaaatcgagttggatgcaaatataagattttacgtggggtgggggagattcatatctcaaagactctttcctctataaggttggagacaagcttttctgttatggggcatggataggggaacttgatggaacactggctatggaactttcagaaagaaattggcccaggagattccaaaggggaatatgtatgaaatggccctgtgggcttgatggagcttggaaaatcgaacttggcggcgtcaatctgcacaaccatgtgaattactctagaagtgctgaaaaacctgaaagaagaaatccagaaactagaggggtgagttaagtcatgacttttagttgtgttgaaatacttggaaaagttaatgccaccattggcaaacatttgaatcccataccagcctgtcattggaaccactgcctctgggaccctggtcttgtcaaaaggctctgcagcttgctcatctttatcctgcctggtgtcgtattatgtttgcacaatggcacagcctccccagacatttctggatttctttccctgaaatctcattgcaacgtaacagagacagacggtacattggaaagctctgaggaggaacataaactgtgacttttgtggagagagaatgatactgctgaaggatgggggctagtgctacagagtctgagtacctttcaggactccctgagcctagccataaaatccctattaatttgagagatgcaggacacaagctttatggtgtccaggataaatccaaataaaatgctacaatggctggtgtgctgggtttggctcccttgagactccaggggtaaagttacagggctaacaggccaactcctgtctgggcaaactaaaggcagagcagaagtcagggaaggagacgttgtctgaggaggctacagattcagagaacaaatgctttagctagaagttgagatggcaaggaagaaatggaacaagttttcctaaaaaggtgcccactgggccccctggaggcttgcagctcagctagaacttagccagggcagctctgaagattccattcagacttcctctagagagcatgcaccttctgctggggaaaacaggcctcccgtaggcatttccccatcttaccctgaccttttgtcctgggactcagacaagtatgcattccccttagaggcttccaggctcatctggaggtctgctaaaaggatatggagtgccagtttacattcagatagcacacacatgcccaaagcactttcccatccagcattttaagcagactagtatggtgtcaaaagcactatactgggagtcaagagtcctagccctgctacttactaggagtgtgaccttaagcaaaacactaagccactctgaacctcaacttttagcattcataaactaaggataatagtagtgttgtcctaatagagttgttgggaggattaaataatagtgcttagcatagagtctggctcataataagctctcattagctgccatcctcatcctcatcatcctcatttaacatataaagaacttgaagcatgtattaggcttgaagcctggctctgacacttatgagtcataagaccttgggcaagtcacatcacctctctgagcccatttctttcttctcagtttaaggtagacttggctgatcctacaagatactgtgtgtaaaaagtatacaatacttttcgaatactatagtattcatttcccttttcagagagcatcatctctttttaaagacagggaaaagtacctgagaggtaaaggcatttacccagtgaagcaacagaaaacctggaatgagaacccaaggccctctacttgcaacccagggctcttcctaattatattctctgaaagcagtttggtctggtactcagaatagagtgttccacatggtcccagcaatgcaggctgtgctgatgatgtgtgtgtttccctgatgctcaccagccagaaggcagcagtgctgactgggcccctcgcaggcagatgtcagaagccagaacctcaagctctttgtttgcccctgtagcaagtgactagcattcaaaaatagagagttctggccatcttcatacccaaaatactttcttctccccacaatcacccaaccttggtgtatgaatccctatcattcaagctttgtccttttaagcttcagcccttgttcaaaaggtgaactccctatgacatgcatacaatgcctgctaccaagaataagcaatcagagcaacagtatgaattaaattattcagtgctttttctctctggaagcaggaaagagggagatttcaagtgcaggacactgttcagtcttcctggatagctagaacaaactacagacagcaggaaagatattataaatggagagaggggcacataaagagtaggttgcaaaagcagcccatctctacccattttgaaagtgcaggagcaggacagacagaagagacattcctggaatggtgaaaagagcatccatttagaatgacaaggtcagacttccaatattatggcaaatttcctaacctgtctatgcctcagtttcttcacctgtaaaatggagtgatcatatcatctaccttaccagatagttctaagtgtaagaagaaagaaatgtgtgtgaacatgcttataaatcaatgcccagatctaagtgatcatcaaggattcggttaacttctcagaggaggctcgaggatgcagtgaccttgacagctaaatggccaggagagatgcacctggcgttcctcccatccccttcactgttaagtggagcatttaatgcacctgccatgcttcctctctgagtctgcctctcttctcatctctggcaaagtggaagcatttagtagctctccctggggccagcagtaggtttcaagggctctgatctgagagcagtggaggtgggcagttggcagagggcaaggctcttctgagactgaatgccttccctctggccagctgtagcctccagacagatacggaagtcctgccaccaacctagggtagcagagacaattaggatgacctctcagtgacaagactctggagtcattaaagcagtgacataattggcctgacaaagctgagacggcagacacacagtccagcaatatggcaaaatagttgtctcgaggaataaataaagcaatctataaataattactgaggctattagctatattttatcttctcccctatcctgcttcctgacactactggattcagaggccccacaggggtggcagtcagagtaagagaggtgacaagggaaggaatggctggggccaaggactccagctggctagaggctattggggaccctgcaaaatatctacctacaagttccagggaccccccaaagtcttctgtgatgaaagcaggcaggaatgggtgaagagtcacctctagtgaggaatggaagagagaaaggactgctaataggacagaaatacctaaggcccacttatcaggtcatgacttagccctagccactacagaggtgactgaccctgggcaaagctgaagctccggatatgtgtgggaagttagttgagagggtggtaagatgccgggctgtataattaccctgaaaggccattctcacgatttccttctctttgcttttattaaataaaccctgaactgaaagtgacagaaaggggaagatcatgtatgaacaagtaaaatcagaactggtaaggagaaaacaaggccagccacattatccctcaaactgagaaatttaagtttctttgtactctgccctaaattttatttaattcattttattaaacacttggcatattccagacactaagtgctttacaaatattgactctcataaccctcatcacagccctctgagataaagactataataattcccattttacagatgaggaaaacaagagacagggacattaggtaaattgcctgaaatagcataactaataaatggtgaaaccaggattcaaacacaggctagcccaattctggagaagagaccatgcttttcacctctatgatatgcttcctgacaacttacattcaaactctacacctaccatgttctgttgatatttgatatttattggtgggtatcccctaccagtctaagcattgatggtaggcaccatgaaggccagggccagacctttctggttcaccaccgtacaccgtattcccagggcctaacacaggggctgaatgattaaatgaattcattaatgaaatatagatttcatgagtattcaatgaaaacaaccaaatgccaaataaaataattgcaatagtttgagacaggagctattttcaatgtatgtgcagaactgtagatgattctgtgctataggaacacagaagcagaagggtttggttctgcctgaagaagtcagggaacgctgtacagaagggatgtaacataagagctgggacttgaaggagaagtaggtattcacaagcagagaacggccatcaggtggaggtattctaggccaagagaaaggcatgaggaaagtcagagctgtctggggacaggtagttggtgtggttggagtctaggatatgcacatggtagccagaggtacctttggagagctaggcaggaacctactggtcaattcaaacttgatcctacagccagagcagaaccatcagccaactttttttttttttctttttggaaatagagtcttgctctgtcatccaggctggaattcagtggtgccatctcagctcactgaaagctctgcctcccaggctgaagcaattcttgtgcctcagccttagcacaccaccactcccagctaattttttatattttttgtagagatgagttttcgccatgttggcctagctgctcttgaattcctgacctcaaacaatccacccgcctctgtctcccaaagtgctaggattacaggcgtgagccactgggcctggccccatcagcaaacttttaagtaggacaaagttatgacaatcaaatttgtgttatggaaatgtcataatactcaagggaaagatggaagagaccatgaagccaaggagaccagaaaacggaggtttgaaggcaatatcctaaatcgaggatagagattgttagaggctgtattgatagctcttggtgataggatgtggaagaataagggaaaaggaggattcaagaatgactcccagttttctggcctgggaaactggatagatggtgttgccaaaaatgaatacgaaatatgtgaggtaggttaagataagcgtgatgataaatttggtattgagtatgttgagtttaaggtatgtgtggagggattatataccagtggtgatgctcagtaggcagtttgacacatagatgttaaactcaggagagagatataagaaatcagatttgattcattgctgtgcaagatcagtcattgaaaccaagtgtgtgaatgtgtgaatgaaaataacctttttgttttttttttttttttgagacgtagtctcgctggtctcccaggctggagtacactgcagtggtgcgatcatggctcactgtaagctctgcctcccgggttcacgccattctcctgcctcagccccctgagtagctgggactacaggtgcccaccaccatgcctggctaattttttgtatttttagtagagacagggtttcaccgtgttagccaggatggtctcgatctcctgacctcgtgatccgcccgcctcagcctcccaaagtgctgggattacaggcgtgagccactgcacccggcctaatcttttcttttaaactcacacagatcatgatttgatccatcctatgatgaaaggaaactctgtaggtcttaggataaaagagagatgccttccctttcaaatactcattcctaaacttttcagtagagagattattcctgatacatttctagatgcttagggaaagtcagtcaatgattatggacaagccagaggcttggctcccattctgagaagttgagccaaagactccaggtacttacttcctttgcattttggaagccagctgtcagaggtgtatgaagctggcacaattggtagcagctctatggtctccacattgcaggagggaatatatctttcttccagttgccccctacacttgtcgactgactggctattgtggcccaaagcaaaggttggcaaataggctttccttttcagagaaaaagaaagaagaattttaaaaaagggcatttttgctaaaatgctcagtgaacttgggtgagtaatttatcctctccatggcttgagatataatgctatctacctgacagcaagaaagttgtgaggatcaaattaatcacggagtattaaaatgctttttaaaatacactacaagcaagatatattataatttcaagcaccaagatctctgggctctagtttccaatacttcattgttccaattaaaaatggtattttacttggccttcgtttactttcctatatatgacagaagtgaccatagacctttcatattttggattgtgcacatgtttggggggcaggatgtgtgctggcttgtagacaaatgcaatgatcataaatggctttagaataagtaagcacttggccggacgtggtggtgggcgcctgtagtcccaactgctcgggaggccaaggcaggaaaatggcgtgaacccgggaggcggaggttgcagtgagccgagatcgcgccactgcactccagcctgggcggcagagcgagactctgtctcaaaaaaaaccaaaaacaaacaaacaaacaaaagaataagtaagcacttaaaaatgctaagtaggtttttatatactacctgacattattcttttaatctttcacatctcttcctctgatatctctttttcttcaaagaattcatgcaagcatacactactgaacccagtcccctgtgaggaaaggggggaaaaatgtcttcctgtgccctgatctagaggcagaaagtgctcctttatttaaattaacaaaacaaaactaacatttttattagttgtctatggttgtataaaaaagcagcaaatcacagtccctgaaatgtctgcagttctcaaaagccaaaacaagcatgaagacatgagctaatatcaggcagacaggctatgccacacagaaaagtaaggaagaaaacatgccaatggataaaagttatttagcccctgaatggattgcctagaaaggtaatttggggcaggatccacggacttgaaatctgaatgaaatagcaagagagatgaatcaggaaacaatggaattgatctgtcatagtttgggttgacccctacaggccagagttcaaacaaaccagtctagaatctctaggtcccttcaaacctcagagtctcaggttataattatatgaaatgcactgagactaatatttttgcaaaccagcctaagacatcattaaacaacttctaagcagaaataaaagacatctgtggtaatgccaccactattcctcagtctcatgggctagaagttgaagtcatcctaccttccaccgctcctttgccccatatatataattaagtcactaagcactcttcttttgaattctgcattttgttattgcctatcttactgcattttccactgctattaccctacttactgcccttatccgcaagctaagcctccgagctggtccaactgcctactgtctctccctgtcaatccattctgcacatagtcactagattcatcctcccttgacattacccttctaccttcagtagttcccccactacctataggataaagttcaaacccttttcccatggaccttaggccttccattatctggcaccaacaacgttttgagtatgatctttctctataaatcctctgctctagaaaaactatttgcagtgtctcccaacacaacctctgcttcctctgcatttacctataccagtattgtagcaagaatatagctcccattctaaactgcctctcaaaatattatctatcctttgagatccagctcaaattctaccttacccaataaatatatgttgcatgtctagtatgcaccaggcattttaaagccttgctagctttcccagtcttttattgctccctcctctgagtctattgagcagtgtctaagtatcacaattggcccttcgtagtgattctcttatataattattagccatttttttgtcttaatgttttttgtacccaagtacactgtaagcttcttgagagcaggatcttggttctgtatttctttcttccctcaccccttactctacaccctgaaagtaacatattgctttgcattttgtaggaaggaaatgtattttaattatttttataacagcatatttccagtcagaaatcctgttgacctgagagagttactacatcagcatcaaaacagcctaaatgaagcagagtaaaagtaaaaccagttggctctcttggagccaatacaattaaattctaagtctagaaggaaaacacatctgttctagtaaaatggaatagcctggagatataaagaatccctataacatataggaggaagaaaaagatgactatagctcataaaagaaaatcaaaccattatatcattgaaataaactgctcctggttttagacaggagaactaattcaaaactttcaatgacttccagttataagttcactttacggttccttgcagattgaaaattagtgtaaagaaggagcaaagaggtagccagcaccagaagaacctgcttctggactttttcttttattccctttccctccttctcccactattttctccctgctacatctccaactaccactagaccccctacacacacacatacagacgtttttaatagtcatgtgtgtgtgtaaacaagtgtattagctgcctttgtaaagactgctcttctctgtctccttggaggattccagttaaggagggaccacagccctaaccccaaatcaaatgccagagactctcagagtcttcctgacctgctctgccttcacagctcctcctcttcttttgcttcaactctgtttcaggccccaccctcatctcagatctgaagactaatatggtcctcagttttccccctcagtattcctcctcagacatggcttttcattctcccttagtttcaactcacgcttggcctcccaatgaaacaagcctgtttttatatccaaggaccatctccaaggatacccccaggacttgtacaccacagggaatctgacagggctgaatgctgatgttcagtaggagatgaagataccctctctcaactcttgtctcttttgccaccctttctgtagccttcaacacagatttgatcaaaatggatcttggccatacagtaaacagagcttgatacagtccaagaaactctgtgtatgtttaattaataaacagttgttgaacagcttcaatagcctataagctgaatcagagataaatcaggacacagtcaacccaggaagtgttatccccaacattggaaagaagtttctaaggaggaaacagaaaattaaggtccaggaaatggccagttgttggagggtccagacgaaagccaaggctgagccaggaggcattttcatctaagagtccacaaaattagaaaaccaagaaagagaggttttattttccccatttcacagaggaactgtagaggcgtgagttcaaagagaaagcatattgcagctaacaaagcaacccttttgggggaagcctttccaactaggttctgttgatggttttcagtcatatattattttggtggggggaggatattcatgcaaacaacaaactgcagttagcaacatatcatattgcacaaagtgatttacaataagaacttcgcttgggaagtgatgataggttcatgtgcacccccagtggagaaacactgagttaaatcagagggatcaatccaaccaaacacaggaaccaggaaaccccaatgtttttgacaaagaacctcagataacctcagaaaagattctttatttcaaatctggtcatatttaagtaatttattatgctaaatatattacatgaataggagcagcctcatgttcattaatattggaaaacattacatcttagatccttcaaaagaatattactattactcacaacctcactttattttgtgagggaaatatcttttatttactcttgttttaagttctgaatagatgcaggttgccctgggtggtcacctctccctgaattggtatataattttgtcattctcaggtagtttggcaggagttgcaaatgtaaatatcctcaggtgtcaggcagtaacataaaactgtgaaactatggggtaggagataactgggagtagtaaaaactgtggtgatcagcagagggcatgcccaaccaagaatttaaattcaaaactttttaaggccacatgctggtcaaacatatgtttctaagttttggactcaacctctggcacctagttttctatctctggttaaaactcaaaggaaagagggatgggcttgataagtcctcagtgtctttcagctggaatatttgtttattttgcattaaatgttgcaaatcaatcagaaacccctttactggacagattctaagtggaattcagtacaaatccattttctcataccttaatatcacttcccttattctattcttcagaataaaaaaaattgcatggttttcctttgactgaaacatcttcataaaatttcctttatttaccatcaacattggtccctaactgctctctgtgagagctactctggcattttggagactatagagctgatgccctaacttggtcctattctgagaaacacataggtgaaaatttggaaacaaacactttagcctgagtttatgatggtagggatagatgtggagatttggggttatcagaaaacccccgacttggtgttggcctctcctttctacaccttcctaaccttccatcccttaaactccagggtgatataactcagaagctccagaaaacaaccttgtccactgagtgcatacccttaaccaggctctttgaatgggttttacgtcaagaatctgaacagttctagaaatggaactgcgtcatgtggcagagactgtagcaaccaaaataacagtaggcaaggagaagctctgctgcccatgcagctgcagagatgcttcagatgtacagtttcttgtagagcagagattattccatgtgttgtgcatagaatagcaccaaacacatttcattaatgctgaataaccacccagagaggcagaatgggcttcattagatggtaaaatccaggagtggcaatgcaagatgtgggtggtgaattggggttctcatttcaccatatttggggctcctcagaaactagtgaagctagttaagatttaacattgttaaatcagaattcaatgtcactttttgagaatggaattaacatgatggagagagtttgataaagagtatcttggtaatcctacctgttgtgtttgagagacaggaagcctagtggttaaacccagaggctctcgagccagtctgtctgggttcttctaattccaactctaaggtcatctgtgaggccttgggcaatttgcttaacttttctgtacttagttccttcatctgtaagatgaagatcataagatccaccctatagtattgttgtggggcttaaatatgaagcacatagaacagtgcctattatgtaatgagtactcaaaaagattattaaaatgctttcctcttaaaagcttttaagaataagaataaagttgatgctcactgtttaaagatttgaagaaatcttaagcaagtcacatcgcttttctgagtcttagtatcctctgtaaaatgggatgatgagagtatatggcaagatgtttcaagcatttttttggtagtacaaccttttattcaagattaattgatgcttctttttatttaaatcttggtataagggaataatatcctacatatgccttagatacttttagtccacaagactgagagtgacgctttcctctgctatttcttggtttcttaaccctatgacaccagaggcatggaatgcccccagcttatctgctcacaccagctgttaggggacagtagagattttcctttagagtgaaagctgcaacaagcatctgagaataatttgttatttatcaagtgtttccttttgttcaccatcaaacctgacactggtcattggaatcacacaaaccagctggtgagtaaaaacactgagtttagttttggcttgcttctcatcctggcctgttatactgaatgtcagggtaagtctgctctgaagcctaggtgacgagctccaagttaggagagaaaactctaatattattctttcttcactgggtaggggctctggagaaatcactttacctttgtaagtctgaagaaaacagagtttgcaatcactgtccctccttctctcacaaagacactacacagagagcagaaacaagaatagacccagggctagagaaagggcaagcaagaacaggcataggtggtggtctctctccattaccatcttttgaataaaatgtttctccaacagtggaccactagccccctgaaatgaagccatcttgggtgcttgctaaaatattagattcctaggcctcacccaaacccactggatctgaatctgtggtagtggggaccagaaatttgaattttaataagctcctttaaggattcatttatccactaagaaacttgcttaagaaccactggtctagtcaatcaccagctctttgaatccatctggaaacgatgatcatctatttgagatctcagttatggacaagttagttatgcacagaaaataagtgttaattgtagctggagatgattgaatggggtaaaagggaagattttctggcagtgtgattagacacataggaacgtggaatcaataaaagctgtagaaactcagcacacatttctgttttgaaaataagatgactaagtttggtaattcagggaaaagcttgcactatatgaagcttgaactacctgaagggaggttcatatttctgtctccaggaataataataaaaaaagtgtaagcaaaaacatccctttaattgtgctgtatacatttcttgagtcccttgaagccaaacaaacttattttaccactaaggaaactgaggtttaaagagaaagtcatttttcccgggtcacatagctagttgattggttacaaatctttattaaatcagtcattgatgggaagacaaaacttacttgatttgcctatctgcccacatttcccttccctcccccaattttgagaagaaaacactgtttctcccactatatttttgccttgcaattaggctttaatgcttgtcagctgaagcagaaactcttctgagcatttaggcagagcgtctaaaggagatctaatgaccctcgtgactgaaagtgaaaagattcaaaaaccagtgtttacagatcttcagctgctctgatcaagccttaaaattgctgaagccagacctttggttgcacagctatctacaggagcagccaaggaagaaaatgttttctgaataatttacaagatatatgagtaaatgtgatattcaattaagcatgtagtcataggaaggaaaatcaaacaattgaaattgccactcaatggttggctgtaaatgctgcctatgccgctaccccactttagagatgcctgctagacactggcaagaagaagacagtgcagttaatggtaaaaatggcccctctctaaaaacagagttagagtgaacatatgccttcaaccctcttaggaaaatgagccaaaaccagccagtaaaatgtagctgcacaggctgcctggcagagaattttcatacattgctaagcagcaaaatgcatagaacatacggtgctatggctggaaaggaccttccagatcatctaattcaactcctttcattttataactgaagaaactgaggcttcagagagggaaagtgattatctcagtatcacacagctggataattggttctaaatattccctaaatcgaactccttggtgtggaagcatgtttgatttagtgagatgtcagaattacagaccactttttaaaatgcatttcttttaagaattctacgaagtttatagagtaaataagtaaacatgtatcccagtaattcacaaccttggcttgttatcagaatcacacggggagacttttaaggtagctctattaagcattctcatgcagggccactgtatacaattgtgcaggccacgcactgcatgagagtgtccactgatggaggtgaatgggggcccaacttgagccactgcacagacttaccaagctatgcaccctgatttagggctgcacctgctcaaaggaagatgtgcctttctctactttgtgaaaagggtcaatatggattagtagcagcactatattcttggctccccacctcacaggtatcactgcaacttcctacttcaccctatcttgatgctccaatatactttgaatcctctcccactcctgaaataggctcaattggtggttgcctcttgtgtatctctggacagaaaaagccctttcaatgtgtggtacaatttctccctcccccttactacaactgtgcagttgtttaatgcaatgactttcaagttttcttgatttctaactcaattactaaaaaaaccctcccaatatatgtacaaatatatatatataaattatataaatgtaataatgtatatcatgtataaacatatatttataactaaacatatgctactgtactagaaacacacaaaattcctttaacacaggcaaaaaggaaaatttaaagtatgtaataaggatgaaattaaccatatttaaaaataatatataataaatatattatagtctgaaaatctttttggctttcactaaaaaattaacattaaactaatgtctttagagagagaaatgttctttaataagcttcatttgttataaaaaacttcaatctttcataatgcagtaatctgaagtcctgattctaaattcagcaatttcaattcttggaattaatggctgtcagccaccccccaccgccaaaaaaaaagatacctcacaaagacttgcagcaaatctgtttcgcctacttcttatcagtttattaattggaattgtgctgttttgacttggtaatgtggctaacaaagagctcatcctatgagtagaaccttctagaagcagaatggcattagctctgccatttccttattattttcttgtgcttacactaagtttctcctcaatccctgatttacttgcatgaaaaattgcaaactacttgctcatttgtgaggattaggttaattaaaactagacagtataatatgtaatttcacataagcaggcacacacaaactgcaatatattttaatatgaggagagtaaatgaaggcatgaggataatttcatcaacccctccttattctggaatttccatgcttcccttaggatccttcccatattgttcatgacatgtgactggcttagttcctccaattcccctctgaactcgagtcctcaagtttcctcatatcctgtcctatggtaactacaggagacattacagcagttaggaggaaaacatgaaccagggaggacttctcagtggaggctatatctaagctgaacgctgaataatggggaggattttcaaggagatggagagagagggcttctcaagaggaggtgacagtatgagaaatgtcataaatagcagagtggttatgttctataggctttaaagacaggtagacttttgggttcagatctctagttctggctgtggtcttcacctctctcacatgtcactattcaatctctatacccacctctctcacgcccaccccatgaatcagaattttggaacatggcaccagagtatctgtattttttagggcagttttgagaactgccatgtataccatgttcataactatagttatgtagtatgtttacccacatcttgaccctctctcttgcagtattgtagagtggctccctattacctattgagttacatcctctgtccagcctccagcaccctaactgcaaccacctcatcttggtgtgctaccatgtttccttgggcccttcaaccacaacacattccctccttttagtattctttaacatatgataatcccctactttgacaattcatccccttccactaccaatccacatcactcccttcaaggctctgctcagaacacattgccccaaagaggtactctccatattcctctgctccaccttgcctactttctaatcccacatcacctcaaagtgttataacatctttgtaccacaatcaagcctcacctattttagatgaattgagcattccaatggatgaagaaaaagatcacatttgaagaatatggaatgtatcttttaaatacatatatccacccataccactgactcataaagtattaccaaatagtagcctagtcatgtctgctttattcagatttggtaaagctataatttgtacaactttagatacatgtaaatcaggtacatgtgagctaattcaatatatgtgacctaataggttacttaaaaactgttttatgatgttaagcacactcctatatgggaaggctggaacctggttccatgtctatctccctgctgtctcctttcttcaacctcagggaaagcatgcacttgcagtgctcatcatttttttccacttagttaataacaccaagaaattattttatacacacacacaaacacacatgctttcttcctcccccttcctatatctccattcaagccatcccttacaccaccaggccatctattacaccaccagcaaaatctcttcaccactcacctgtacagccccaactagtcattcctcttagctctcaataatggggtaaaaaatgtgcttttgagacactaatattagtactggtgccattaacctattaagccctttcaatgtaagggaacagcatttattaacactaactacagaccaagttctgtgatagatgctaagcatacagaacttcagttagtcctcactacaacaccgaaacataggcaccactgtcaccattttataaatgaaactgaaactcaaaatatcgaagtcacatagctagacagtagcaaactcttcatttctacaagaaaatgcatgccaggttccccaaaccaatttaaatatcacattctggaatttgaaccatttaaggatttgtatacccacgagtaaactcctttgaaaaatgtgtccatttaatacttccagttagactgctttctccttgagtacactaatgttgtcattaaccaacaggttttcttcataatgtcaaatatttccatctgatttatcccctgactcattgctaccccacccctcagcttcatacttcagtgggtgaggggagtcacttctataccacaaaaattatttagaacttttcataaaagttttcctggcacacaaaggcagacatatatgccaatggaatagaatagagtacccagaatcacttatatggccaaatgatttttgacaagagtgccaagaccattcaatggggaaataacagtcttttcaacaaatagagttgagaaaagtggatatcaatatgcaaaagaatgaagttggacccttaccttacaccaagtacaaaaattaactctaaataaatcaaagacctaaatataagagttaaaagcacagacctccggggggaagcttcatgatattgatttgaaaatggtttcttggatatgacaccaaaagcacaggcaatcaaaagtaaaaacagagaaattatactacatcaaaatttaaaacatctgtgcatcaaaggactcaacagagtgaaaaggcaacctatagaatgagtgaaaaatatttgtaaatatcatatctgataagatgttaatatccaaaatatataaagaactcctacaactcaacaacaaaatattccccaaaaaaatcaattttaaaaaatggacaaaggactcaaatatatatttctctaaagatatacaaatggccagtaagcacatgaaaagatgaacaacatccctaatcattaggaaaatacaaataaaacccataatgagataccacatcatactcattaagaaggctaatttaaaaaaaaacagtaaataaagagtattggtgggaattggaaatattggatcccttatgtgctgttgatgggaacgtaaagtggtgcagccactatggaaaacagtatggtggttcctcaaaagattaaaaatagaattaccagagaatccagcagttttgcttctgagtatgcacccaaaataattcaaagcagggtctcaaagagatatttgttcatccatgtttatagcagcattattcacaatagccaaaaggtagaagcagctcaagcacttgttgacggatgtgtggaaaacaaaatgtgacatatacatacaatggagtattattcagcctaaaaaaaggaaggaaattctgacacacactgcaatgaggatgaaccttgatgacacattctaagtgaaataagccgctcggaaaaagccaacttctgtgtgaatcaatttataaaaagtacccagtgttgccaaattcatagagacagaaagtagagtggtggttgtcaaaaactaggggtggggaaatgggaggttgtttaatgggtgtagtttcagttttgcaagatgaaaatagttctagagactgattgcacaaccatgtgaaatgtacttaacactactggactgtgtacttaaaactggttaagatggtaaattttatgtgatgtgtactttatcacaatttaaaaaatagttttctggcaaagctggcttcaagatcagttggagcaatgcagaagacattttttttttctcatgagcattaggcttttgtgttcactttcatcaacttttgaacagatgaacattgccctggaaaacacctctaatttctgctctcacttattgaggcagacagtggatggggaaagcagtggatcttgagaagatacaccgttattaggcagggtttcagcagaaaacagaattcaccccagacagtcaaataaattgtaataaagggaatggaccaagggctgtggtaatgcctctgtggtgaggcacccacatactagcagcagtaggtatccactgtcagccccagaggtggaggaacaagagaaggaaatagtaggaaatgaaacctcgaaggagttacctggcagaagcagaagtcctggcaccaaggaaacagcatcaatgcagacaagaaatatcctgacctctatctcttcccacccttcagtcttctggagaaaactcccattggctgaaccagccagcaaagaacccaggttatacattctgctgcagttagtttctcaaagcacagagcagggcagagaaggacaaagagtagatatcgggtatacacgttgggggtgacaaacagaataagtggcacacttggattatagtcttaggcctgttgctaaccatgggaacttagagaagtcagttaacgtattttgatttttggcccacttagaaatttgctcatagtaacccttgtcttgcccagctgatgggctctgtgagtctcaaataaaataatggatgacagactcctttctacccaacaaagtgctattaaacatagaaaaataatgttttttccactctttcctcggtccttctctcctctacctgagaaggtcaggaaacaacatagcagagtaggaaaaactaaactggcaggtgggagacctgtgatgtcaagcaagtaagtgacttttgcactctgagcctcagttttcacatctataaatatctgaactacatgttaatattaatgccctttctgactccaatgattttcttactgaagagtaggttagcaagatgtgcacaagaccatgcacatgtgcgcacacacagtcctttttcttctgcctcaagtcacacacacatttacacaaacctatatgtttggctttcatcaaaccaatactgctataaatgagagcaggaaccagggcattaattactactttgtctttcatgtcataccatgtgagagccctttcctgggataatcgcctaaggcagtgttgcccaacatgggttccttcagtatgttaacaagtgttacaagaggaaaaagtcaattcagtatcgaaaatgctgggataacaaagcagcacttctcacagcctttgtttgtttgtttgtttgtttgtttttgttgttgtttttgagatggagttttgctctggtcaccaaggcaatggtacaatctcggctcactgaaacctccgcctaccgggttcaagcaattcttctgcctcagcctcctgagtagctgggattacaggcacgcaccaccacgcccagctaatttttgtatttttagtagagatggggtttccccatgttggccaggctggtctcaaactcctgacctcaggtgatccgcctgcctcagcctcccaaagtgctggcattacaggcgtgagccaccacgcccagcctagcctttaatattctaatgtacattgtgcatctctgagagggtagtaaagtaaatggtgggattttttatttgccaaacttatttgactgtagaatcctcccaccaccctacccacagcacctcaaattctttggaatgatatgaattgttggaccaaatcctatgttcagacagcctttctgtacattcatgcttaggcccaaaatacattttgttctatttatacattaagaatatatttttattttaagtctcagctactcagaaggctgaggtgggaggatcacttgagcccaggagtttgagcccagcctgggcaacatagcgagatcctgtctcttcaaaatatatatatatattaaatatataaatatatatttatgtattatctattaattactatataattaattacatattttgtatagtatatatatgtgtgtgtgtgtgtgtgtgtgtatatatatgcgtgtgtgtatatagtagcctgtaatacatgctttgtctctcagttcctgccttggtgccccatgcagttggtggtgcttccagatgaatatggagggcagggcagcataagaaggcatcattccttacccaaatcaggaataggcattccagaatgtctttaagataaggcagtctcttggtatttggcattgtttaggcaagatgaaaagttgctgtcataataacaattcacaaaggaagagcagtttacagttgcagagagctttcacataaaccatctcatttctaaaaactgaggtcagtaggatcatcttcattttacatatgaaaaacagcaagattatttatctcttgcaaggttactcagcagagccaggactcaatagcaggtctagaacttctgtttccagtgcttcttttaatgaaccaagatggaaggcagaaaggctcccttagctttctaatgacccaaactcattggccacacagtgctgagcattctgctgttggagaggcgggatgaggttgccctcttgcttccagggagggagggacaaagagtatttttttaaagctttccttttattgtttgtttttctaatctcatgagttaaccatgctcattacagaaaggtcagaaactacaaataagcaaacaggagaaaaaattaaaataccaataaacacctaccaattcagacacaactactgttgacaccttggtgttccagacacttttctatgcatgttagagtctatgatacgttttctttcatattctagtgtttctggaattgggctgtatcttctaattgatgttcatagctgatgtggtaatccttccctccctcacaaatatggttagggttatcatactgatgatgtgtcttaaaactgtggcatctcagggtccatgagggatcttatatttttcccccaaattatgtcagattgctgttttgaaacatgcttttatcactcatcactctcccctcctttttttttttttttttttttttttgatacggagtcttgctctgtcgccaggctgaagtgcactggcgcgatcgcggctcactgcaacctctgcctcccaggttcaagcgattctcctgcctcagcctcccaagtagctagaactacaggcacacgccacgacgcccagctaatttttgtattcccctcccttttatttcttggcatgatgccatgtcagtagatatttttctaccaaaagtatatttagtgaatgcaaaaccactccactgattggttgcactgtattttttttaaccaaacacctattgctgagcatttaaatcatttacaacttttcccaactacaaacagcattggcgacagatattcactgaagaattgaggttatactaggtgccagacataatactgggtgctagagatagagaaatgaacaaaatagatgtggactcaaccctccagaagttgatagtctagtagaaacagcgggcattaaacaagtgaacactttcatgtatatttgtagagatttattaaatatcaaacactgtgaaagataagaacagtctttctttagattagacaatcaggaaagggctctctaaggaaggagtaattaagctgagatctgaaggatgagaaagaaatagccagtgaagggaaggctgcaccaaactagactcccacaagtacagcaggaaatgcccactctcttgctgatatggaataaatagtctcctttttctttaccattctgctggaggatgaaaggattctcattattttttaattagcattttacaaattatttctaaggttgaacatgtgttcttacttcatgtcgttttgtctccctagaagagcttatcaataacactgtattcactgctgtgacgaggtcatatctactatacaccacagcataaagctagggcaatggctgttgaagtgtgctccctctggaacctccagagtatatcagcatcacttgggaacttgttagaaatgcatattctcagggcctacctcagaccaactgaatcagaaattctgggggtgaggcctaacaatctgtcctaacaaatcctccacatgattctgatatattataaagcctgaaaaccactttcaagaaaatattcaatggatatttgtggatggatgcagttccaacatcctaggatcctaggatgctcctccaaatacataaatcagagaatatagacctcaattgaagcacaaaacagagttttgtgctgaaaagtttgtgctgagagttcattcatttatccagcaaatatttttgagcatctactatgcttaagaactttgctacatactgaagatttaataaggaaataagacaagagtccctgccctcacaaagctaatcgtctagtggagcgattccttctcaaagtgggatggacggccaaggaaagttctagcatgcactgtttttgaactcttgaaaagcaaggaaaatggaacaatggtaatataaacacattgtggtcaggataagtgagacaaaagtgaaaagagagaagcggacagagatggtctgtccatcttggtcctgctgagtctcctctacaaactgctccagaacagaggtagattccagatgggagaaatgccaaggtcctacacagttattattattcacatatttctctaaattgtatgcatcatttcccttttctaggcagcatagtctcagcttccttagattcctgaagtgtgccccaaggatttgtagctctatgttaatgtgatacataaaatagagtcaccttgacttcacatttatctggcttatgtaagctctaaccttttactgcagtgcaacagaaatgccagacccattttgtataggcacataaacaaatactctgattctaaataatatattggggaccctggtgactatgagagcatgacagcctacagggagttaggaattaagctactgatccaagctctggtgtggagggaggcaccaggctctggctccacttcttttcccaagaaaactgctcattgcagtaaagtctttggaaagagcttcagaatttttccttccactggctataaatcaaggaagctatctagagaaggggtctgatgagatcactcacccaccaagtccaatagccttgaacaagctctttataatcctttcttctaatctaaaagaaataaagcaaaaaaaaaaaaaaggtgggggtggcggtagacggggctagttatgaagttatgatgcatctagttttctttcccccctagagcagggtttctcaatctctgcactcttgacattctaggcaacataattatttgttatagggctgtgcattgtaataggtttggcagcacccctggcatccactgactaggtgccagtaactcctcctcaagttgtgacaaccaaaaatgtatccagacatcaccaatgtcccctggagtgtggggagggaatctcctcaagttgagaaccacagcactagaaattaaagcagttagaaatcccagatattaacccctggaaagccacgtggactttattttcccagtttgataaatcgaatcagtttaaatacagaagacaccactcaacggttcacaaaaataatttggatagttatctctctcccacttataataaacccttaactgcctccattgactttaaataactcaacattatcagagcaatgaggtgaattactgagggccaacaattgagggactcaaaatcaagttataatgattactccttgcaaatgtataataattcatgttttacacatctgtcaatttgaattcattttaactttcattggttatttctgtgtgccaggggcctttaattttcataccacctatattagttttctgtgactgctgtaacgaattctgcttaaaacaacataaatttattgtctcacagttctgaaggctagaagttcaaagtcagtaccactgggccaaaatcactgtcagcaaggccacactacctccagaggctctaggggaaaatcattttcttgccttttccagcttctggtggctgtcagcattcctttgacttgtgaccacattactcccatttctgtctccaaagcaaccttacctattcctcttctacaggtcatcaaatctccctctgtccccctgttataaggtacatgtgattgcatctatggcacatcagataatccaggataatctccctgtttttaaattcattatttgattacacctgtaaagaccttcccccacaccccatctctttgccatgtgaggtaatatttacaggctccagggatatggatatgggggaacggaaggactatctattatcagccaattataccacccttgtgacgcaggcaaagattaatatttatagatgagaaaatagtggcacaaacaagttaaatggtttataagaagttacatgctgtgagagattggcacagatgggacaagaatccagggcttctgactcctcttttgaattacccatggcccagaagaatagaaacctattctccccttcctccagcaaacagttaaaaggcactgtgaagttagtataatcatgaaggattagaggatggagtttacaggctagcgaggattctggaaagcctcatatcattctgaggggcttaggggtgagaaatcacacagaattttccaagatattagaatagcacaaggaaaatgaaaggagatgatatggtatgagaagaaagcaaactgtagccttttaatattcattgagtccatgacagcataatgtttcacctgctatttagcatttcacattggcaacactgagtagggcatatgctgtgtataattttatgaagctctttaacaaaatagtctatggttgaattttcacaatatctctgtatggaagggcagtcattatcatcattccatttcataggtgaggaaactgaggtttggggagttaagagattttcccaagctagaataaaatccaagcctttttccttttatgataattgtcttttctaattattgtccctcatgtaagaatgatatatacaggtgtctcataaagttataacccatagctactgagttatcagtatagatgacaaatgttactttatattcaaccttcaggagacccagtacccttcaggcacttttcatgtaattcagatacacaaacaacaggtggcagtaagtgccttaggtaagtgatttgaatgaacaaatttaaacttaaatatacttattttaaactatgacaaaaatggtagattttcaggatttccgttttattgtttacagttgctagtctatcttattctatgcaatatgttcagatgtgtttaaaggtcaaatgtataaaataacttcaagaaaataaaaatctgttatttgctgtctttcaaaataattcctgctaactgcaattaaactaaagttttgtcttatcctgagactaaaattagaatattcatttccactttactctaaatatttttaaaatctaacttcctcctgattttaaaattagattttaaaatctaatttcttcaagatttctatttaacttactgacaaaagagccatgggatcttttactcaagtggaaaaagcttttatcatttcccattttctctctaagttttcagggaaaggacttaaagaatgaggaaatagtaggcaaggacatttctcctcttgagttccctatctctagcttttttttttttttttttacctcttctcaacagagaaactatcaaacagcagtgtgttaccactgaaagtacagagtcttttaacttttttttctatcagaatgaagtaagttttcacgctaggtcttaaaatgatagcaactagcagcattccccttcctgtttatcacatgtaaatttcaagttacactaagccagtagctacttttggaaatacgtgttaggaaggggaatgctgctagtttaactacctgtaacatccacacagtggcttctgccacagataggctccttttttcaaggctaagagatacaaacatacagctcacaccaacacagcaaatcaaagaacccgcacatttaagtactttttatacgaaaatgttcatttgttacattaaagatacactggcatttgtagtaaacaatatccacattgtcagtcaactttaaaagtaacactaatctagggttggctctgcactagggactttgagaactcaggagaaatgtaaaccacagttcctacctcaaaagatttacagcctaattgaggaggtggcatttctaaatgatgcatttgtattatatatcagtataacatgtacataagttcatattcaaaagaatggttacagataccatgaagtacagtggatcatggtagaaaggaaggtttcatggagaagaacttaaagggtgaatatattttgcataagcatataaaagaggcaagaatagttcaggaatagaataagtctcacgaaggcagggggttgagaatgaacctggtaggattgaaggtcagatggcacttgcctggaaggaggggaaatttggtaaaaaaaaaaaatatagctaagatatattacagtcttaaaggtagagagtttgaaaaatatgatcagtttataatacttttcatctgcccctatatagaggctggatctaatagttaaaaatgaaagtttaagccagagtagtagttaggagtactggacagaagaaaagccaggtgttgggaaccgaagagggctaatccatgagatgagaagaaaagacaggggccatgaccttgaggaggtaagctacaaaggatcagaaagccattagcatgaatagaagcctaacaaaaatttaaaaagggtgatgagttctatttggcatggtgagtctttaagagtgatagtacctttacaaaagaaaccacagaagatgggatcccacatagaagaagacagttaaaggaaaaagcatccttgcctcttggagcaactaaacacaacccatcattaacatcagagtccccaggtccaatgtggcaccctttatttttcctccaaatgttcagcatcgtttatcttcctttctcgcggatcctgcatttaacggctgtcacattgcttgggaaacttgattgcaacacggtcatttcatgggcaccagtcagaaggcttataccaaagtccttgcaaaagacaattttcatataagatatgtacttgtcatatctgcggtgagcatctgtcagtctcgtcataggctgcacatagagaattagtttataatccttaacactccagcttcccatgctgctcctcctgagtggattgagacatgcaaattaagcttgttttatttgatttgcatttgagtaattgcctactgtccataaagtaatgataaaacaaaaaccttttccaaattgaccagcttacctaaaaccattgagaataagagagagtcgagctataaaatgcctttcagaaataagaggagccacgttcataaaacacattgatttctttcctactacagagctataagcaatattacctgtggaaaaaaaatagatcagagatttctgtcattttcaaggcactggtccggaaatcggcaaacaaaacttcagcaagatctcctaaatcctctttaccagctgaagcagttggttgcattgcaaatgaaaaattaaaaagataggatcttcaaggtcaccagggagactatgtcgaccccttacccccagagttgtcagtagagtatagcagttttaaggatgtggactggagaatttgactgctggtgttcaaattcaggtctgctcaccattaactgtgtgagcttgggcaagttatttcacctctctgagcctcagtgctctcctctgtaaaatggagataacaatatttcattcacaaagaggattaaatgagtcaatgtatttaaaacacataacatggtgtctggcacacggtaagtattcaatggatgttatgattataatttcaatttctttccagccatatggccctttgtcatcagtttcataggtcttagcgggtaactataattctaatgcttataattattaacttttctttatacaaaagacatcacttatgctcttgtgccaaatgtagcagatgctgtcataccaatacttttttacccttaccacttcagtgcctgccacccccaaattcctactgccagcacctgcatttctttccctggggactttttctggattccaaacttgttttgccaacttgtatagtaggttggaaatgctgagaaattaatggccccaaccaaagactgataggagtcagcgtactctcacctctcaggtggggtaactctgaaggagatgtcttacactgcctccaagactttcccctgaagacttaagccccagacactctgtctgtggcagcaaatgtgataatgttgtctttaacacgtgcttacttgtttcactgctccattcttctatcactatttccttcaactctgaaacaaactacttatacttgaatccctgtctcagagtatattcttgtgggagcccaaactaagatcttctcacaaacctgtgagataattaagggtagacatcataattttgcagtttcagtaagaaaaccgagttgcagttcatgtgggtagttggtagaagagattggcctagaacccatgtctcttgataaactgtgttctttttctgttaccaagtatatatcacagctttttccagctgcatgcagactaataatgtcagtaattccctattatcttcctcctcattgtatatcagttggcctctgaaaagtctgtctggaccaagcaggaaatggtcatattccagctgactcttatcactgaacttccctatgtgtgacatgcgtatttatcagtttatactttaagtgtatgatcttaacaagccctctacctaatgaacactacattatctgccagagtctggaaatggattgttctagatcatcaagagtctagctaataaggaagttctgaattagctggaactgatttgtttttaacgtagcacttagcatagcggttgcactaaaaacacattaaggtccctttgatgatttggtctcaaggtcatgtacgaacacatcaattcttattagattgaaagacctacaaaaggttgttttatctttttaagactttcccccacaacccaaaaggaaggtacccaataaccctgggtaccataactgaaaggctacttaaatagagcatctgttagatgtaagagtacaagaagattctgcccattgagggctcttatttggagagcctccttaattaatggccatctggtcccccatgaaggactataattaagaaagcaatgtaggagcagatacatcagttaaaaactcgcctgtgcttgcctttcctccaagatattcagtagtcaggtaaatgccaaggtcacattgagctatttgtctttttcataaaaaaatggtttgggtgcagaggttgggataaaataaatcactgattgaattaagtggcagacacaggacttgctaacatctgaatgcccctcactgactctgattcagcagagatctgctgttttcgttgtccctgtttttttccagttgattttaggctctgtatgacggtaatagaggcaccctggatagatgaaagaactgaccatccttgatccttagctttgtcaaaaggatctgcacatgtccatttttactgcaaacatgagggaaaattcctgttgtggttattccttaagataataaagatatgttcttcacccaagctcccagagagcatctgctgagttagaaatcatctctattgcaatgttcaaacctagggatatgaccaaaccatacgcttctctaagtatttgcaaaacaacaaaaaacaaaaggagtggcaacctaccccttgctgtctaatgtcctccatctgcaagacctccgggtgaaagccttaagagccccaggcattaggtacagagtgttcctattatcagaaaatggggttgcagcaaatggctacaagccactagtatgcttaaattatagccctccctcagctatgccttttatatatttctctgaaaaaggtgaaataataaaagtatcattttagaacagtggagagcaacatgaaacacattgtcaactacctcctggctttacagtaactttaatgttactgtacaacgtgacccttcacctttctgaaccttaccttacaacaatagcaacattacatacctgtaacataactaagaaccaggaggtaagcaaagagggcatctgagcaccaagtctgtgcactttaactcatgtgcttccttaaaagtgaggccccataggctgggcgcggtggctcacacctgtaatcccagcactttgggaagccaaagtgggcagatcacgaggtcaggagaccaagaccatcctggctaacacggtgaaactccatctctactaaaaatacaaaaaaaaaaaaaaaatagccgggcatggtggtgggcgcctgtagtcccagctactcgggaggctgaggcaggagaatggtatgaacccaggaggcggagcttgcagtgagccgagatcgcgccattgcactccagcctgggcgacagagcgagactctgtctcaaaaaaaaataaaaataaaaaaaaagtgaggccctataggacttgattcagaatctatatacatttgcattgtatgcataattttaaccaagtttgaatgttttatttccagtctcaccaaagattagagacatcctgttaaaagctagtcagtggatgttaaaacaaagataacagaacacctacagcacagggagagaaaaactacggaaaagctggcaaaataactctgcagtcagagaacatttagtgtttgtgcaaacgttcattcttacagcctgtaataggttctgagggcattgctggatacagcacactgaaaagctgaaaatcatagtgtggaccttgagtcatcaagaaaagatgagactgtattccatacagtctgcctaaggaggcaacgaagtgtacaatacatgttagaaaacgttctaacaaaagcagttaaattaaaacttgttgaaatgtaacgacgtaaatttctacaccagaaaactctactatccagaaagattcctttttcaaaagctccatctcttgctgaaatttcaattgttctgacttcatcatttacagccttggtcatctcttggtggaagactatgattttgcatctcatactcccttttgcagtggaaaaatacatgtgcatggttttgccaagtttttaaactcttggaagaagggggaatctttatttttaattgcatattttgtatgcttctgggggtcacaaactgtccccattcttatattatcagtgaatttccaataaaaaactagtgcaaatttagacacctcccaaaatgaaggaaaattacccacaatgcatctttgcagtagaaggttggcccagttagattatgcagcaatttgtgtgatttctcatctggacactcagcacttagttcccatttcacctctaccaactgaagctttgacaatttgtctgacaagtccataacctaacttttttttaaaaaaatgcaaaagaaacagaagctacctatgtttgtaaggtacagttcagagattgtagaaaagggtaagagtaatagacccagagcagagggaaacagaattaagacaagaaattgtataacttagttctaaaagctactgtgagggctaaaaagggacctataggggatggcaatgctggaagaaagatttagggggaaaaagataaggtcaagagggcaaaagaaaattggtatgaatgtcccaataaataaaatagtcagattctagaggaagtagccagtacaagccggatagagcaaatatgattaactatttttgccaatctttggtgacagtggtgcataggggcattagagaagcagcaggtataatctttgaatggatctgggcctttagtgttaaggagtccagactagaaaagctaggtgaactgtgaaaaaaggataagtagggtctaagagaagatccaccaggtaaacctagaataccagaggaattacctaggatgataggaatgtaacatttcagagctgtgcttaggaaagaagtatatttttcactgaacaagcaatgtttacaattgatagagaaagaaggaagaaagaagaaaaaatgacccaaggagataataaatgcatcattgaaagcaattttgaggggacacattttgaaagaagactgcaatttagtcaccagactttgcttgaagccttgctcaatttcctttcccattgccttgatcattagtagagtctttctcactactcagcaacagtcaaatacccatgagtatcctctaactctaagcaagggtttctgtgtagggaagacatatggagaccagcgttgcttataagggtctctgtggagagaagggtctgtagttggcagaagtgatagtcttctcaagccaagccttacaaaacaagccctggattcagtggcccagataactgtttgttggtaagagtgacatcagcaaaatagcagaataggcagctccaaactcccattgctccacagaaacattgaaaagcaagcagaaactgtcacaaccttgtcaaaactctggaaaatagtcaaagatgtacagaaaccaggtatatgctgaatcaagaaaaaggcaacttcctacacattaggaaacttttgtggcatttattccagctcttgtcccacctcctccctagtttggcggtggtcttgaaggtggcaaatcacatttcttgtgtgggaccctggtccctgattccagagggagtggaacagaccttatcaaaggattattgtgtttgtctgttctaatctatgtatgggctccccaaagggctgatgcaaggcactcatcttcatttcacctaactcagaagtcactcagtgtgaaagtggtggacatttctcaaaggtgttgtaaggcaaatgaaaatcctgtacccaactggggtgaaagattatggttgaggcaaatagtagaccacctaaagcctagaagaaaaatctgggcataaattttctttgggaaattaggagattcaaaatcacccatgtatactggggaattaaaaagttatgcatatccccagagtaggacacatgttcagaaaagacttaagaagactctaagctttcacatctggctgctttctgggctcagtataagcaggaagtgaaggctaaggcagtttcagacagctggctaagtgttgaaggaatgccccaacacagagctaatcttatatatatacatatatatatatgtgtgtgtgtataacatataacataatataggccgggcgcgatagctcacgcctgtagtccgagcactttgggaggccgaggtgggtggatcacgagaccgagatcgagaccatcctgactaatacggtgaaaccccgtctctcctaaacatacaaaaaattagccaggcatggtggcaggcagctgtagtcccagctactcgggaggctggggcaggagaatggcgtgaacctgggaggcggagcttgcagtgagccaagatcacaccactgcactccagcctgggtgacagagcgagactccatctcaaaaaataaataaataaaataaaataaataacatatacacataagataataatcaaagatatattcttcacccaagctcccaaagagcatctgctgagttagaaatcatctctgttgcaatgttcaaacatagggatatgaccaaaccatatgcttctctaagtatgtgcaaaacatatatatatatatatatgagttcaaggacatctctgtcaaagcagtagctaaacacaagataaagaaacagaagacttaactgaccacacgtgacagataatacagtctttacaaaaatagtttggaaaagtaattaaacaaatggatgactctagctttccacaatcaaaaatagcaaaccctagagaaaggggagaacctgatatccagagtagccaccttataatattcaaatatccagttttcaacaaaaattcatgaagcatacagagaaacaggtaagtatgacccattcatgggattgtggggaatagaaactgtccctgaggaagtccattgttagggagatttatagctctaagctcttacatttttttttttttaaaaaaaaaaaaggaaaacttcaaatcaacagcgtcactttacatcttaaggaaatagaaaaagaagaataaagcaaacccaaagctagcagaaggaaggaaattaataatgattaatcagaagtaaaattaaggacataaaaataataaagagaaacaatgaaaccagaagttagttgtttgataagatcaacaatattgacaaatctttagttagactgaaaaaaaaaacgagaagagatattaatgaaaaaatcagaagtgaaagcaacttcattactaccaactttacagaaaataacaaggattataagaaactactatgaataattatgtcacaacaaattagatgacctagataaaatggaaaaattactggaaacacacaaattaccaaaaagatcatattaaatatcatatattaaaacattatacactatgactaaatgagatttatcccaggaatgaaagtgtggttcaacataaaaaaaaaaatccatcaatgtaaaacattacattaagagagggacagagaaaaaccacatcttcatctcaaatgatgcagaaaaagctaacaaacaaatgcatcaaagtttcagaacaaaaatcaacatacaaaatcagttgtgtttctgtacattggcaatgaagtatccaaaaagaaaatataaaaataatttaattcaccatagtatgcaaaaaaatcaaatgtctaggaagaaatttaacaaaagaggtgcaagtgttataccaaaaactaaaaaaaaaaaaaacaaaaaatgataaaagaaattaaagaaaatctcaataaatgaaaagacattctgcatcatggattgcaaaacttaatattgttaggatttcaatactgcttaaaaggatctacagattcagtgcaatttatatcaaaatcaatggcattttttggcagaaatggaaaaccttatcctcaaattcatatcaaattgcaagggtccccaaaaatgtcaaaacaatcttaaaaaataagaataagtttcgtgtgctcacattttctgtttttaaaaacttactacaaagcatagtcctaaaaactaatgtggtactggcataaggagagacatacacatcaatggaatagaattgagagtccagaaataaactcatagatcaatggcctattgctttttaacaagggggaaacaatagccttctcttttttattgagatgggggtcttgctcaaacttgcttgtgggctcaagcaattttcctgcctcagcctccttattagttggaatcacaggcacatgccattgtgcctggcaagaatagtcttttcaacaaatggtgctgagataactaaatatccacatgcaaaaagacgaaattgcacatacttcacaccatatacaaaatggggcagcaacctaaatataagagctaaaactataaaactcttacaagaaaacataagggtaaaatcttcatgaagttgaatttcacaaaggattcttagatatgaatacctaaagcataagcaacaaaagaaaaacataaataatttggacttcatcaaaattaaaaccttctgtgcatcaaaggatattatcaagagagtaaaaagacaacctatagaatgagagaaaatattttcaaatcatatctctaataaggatctggtatgcagaataaagaactcctgctactcaataacaaaaagataaaacctctatttttttaattatactttaagttctagggtacatgtgcacaacatgcaggtttgttacatatctacacatgtgccatgttggtgtgctgcacccgttaactcgtcatttacattaggtatatctcctaatgctatccctcccccctccccccaccccactacagtccctggtgtgtgatgttccccaccctgtgtccaagtgttctcattgttcaattcccacctatgagtgagaacatgcggtgtttggttttctgtccttgcaatagtttgctgagaatgatggtttccagcttcatccatgtccctacaaaggacatgaactcatcctttttatggctgcatagtattccatggtgtatatgtgccacattttcttaatccagtctatcattgatggacatttgaaaacctctattttaaattgggcaaaaaacttgactatgcatttctccaaagaagatatatgtatggccaaaaagcatatgagaagatgtttatcatcattagtcattagagaaatgaaaatcaaaaccacagtgagagagctcacacctatcaggatgtttcataattttaaaaaagacaaaaacaagcattgatgaagatgtacaaaaattggaactcttgcaccttgctggtgggaatgtaaaatggttcagccactatgaaaagcaatttggtagttcttcaggaagttaaacatagaaatgccatatgaatccatatttctactcctaggcatatacgctatgtaactgaaaacaggtactcaagcaagcatatgtacatacattcctagcagccctatttataatagccaagagatggaaacaacccaaatgcccatcaatggatttatgtatggataaacaaagtctggttgattccatatgttgtctattgtgaacagttcttcaataaacataggaatgcaggtatctctttgacatactgatttcccttcttttggatacatatccaatagtggaattactggatcatatgagagttctatttttttttttttgaggaaccttcatactgttgtccataatggttgtactaattcaccttctcaccagcagtgtgtaacagttcccttttctccacacccttgccaacatttgttgtcttttgatttttttgatagtagccattctgactggagtgaggtaatatctcattgtagtttttatttgcatttccctgatgattagtgatgctgggcattttttcatatgcctattggccacctgtatgtctttattggagaaatctctattcagctcttttgcctatttttaaatcaggttattggtttatttgttggtgagttgcttgagttccttacctattttggatattaacctttcatcagatgtatagtttgcaaatgcattctcttattctgcaggttgtctctttgctctgtttattgttttttgagattatatatatatatatgtaatatcaaagtctatatgaaatatatatatatacaatggaatattacctagatttaaaatgaaatgaattactgatacatgctacaacatggatgaacattgaaaacattatgctaagtaaaagaagtcagatacaaaaggtcacatattgtatgatttcattcatgtgaaatatccataataggtgataatattatctatatctatagatatatatacatctatgtatatagatatatatctatttatctatgtctatatctatgataatattatctatatccataataggtgaatttcacctcaataaattatttttttaaactttgctggtgctcaatatgtattttaaatgtttattttttagttaactcctattaacataattaagaatacacagcttcagcaaactgaaaacaaaattagccaataaacaggtgcagaaattggaaacagtaagattggagggaatgctcacagttaaaatgacaataaaagcactgtctgagtttcatagccaagaagcaattcccagatgcctgtccttggtttgagtagagcagggaagctattactcagacctttcattcaaggcagggactggagggagcaggaaataatcctttaattccatgtctcaaggagctgggggttttgtccccttttcttttctgcagaagatagttcattgtgttcatctgccctaggggaacctccggagagttggagccaggatttagaaaaaactaagaaagatcgagatttccctgcttatcagaactcttatggaaagcaataactgtgcttttaatgaaggctgagtagtatagtggaatagacattaggttgtagagccaaaaagacctgatttcaaatcccagctctgccccttaatagccatgtgatgtcaagctatttacttagctgactcaaacttcagtttccccttctgttacatgtagatgtataaccctgcaggatccttgtaaggattaagtgagatagatataaaatacctagcacaaagctgggcacacagtgggtactcaacactagttatttttcttcagtcaaataacagatgtcctctccatcccactccacctctcttgcaaaaatagtaattagaattgattgatgatgaagtatagtaggccaaaatttcaattagaaaggatacttaaacaattatataggtgatggatgcaatgctttttcacatagtaaaacattctgtgtgaaaggatagaagcagattcctccaggagagatcagcaaaatgagagaaagacaaggctgatggacaaatccatcccagaattcctgtttttttctattgtccccacaagaaacaaaagctatccacatcccataagcaatgggaagctcaacaaacagattcatcacaatcatttgagcaagaagagtaatggttttcttatcctccttatgaggctccaggattcggaatgctatagcgattaacaagaatgtgtgtgtgggttgagaaagatgttggttcaaattccagatctctcacttactagctatggacttcgggcaagtcacatatcttcgaggcttagagttctcatttataaataataatacttagcttgtagggttattgtatgtattacacaagatgatacatgtaaagtgcttagcacaatgcctagtacttagtcaatgaccaaaaaatattcatttctgctctctttttaatcacataaaattctactctgttttacagaaaggagctctttttaaagatgaggctatcagctgggtgcggtggctcacgcctgtaatcccagcactttgggaggccgaggtgggtggatcacctgaggttgggagtgccaggccagcctgaccaacatggagaaacccaatctctactaaaaatacaaatagccaggcgtggttgcacaagcctgtgatcccagctacttgggaggctgaggcaggagactcgcttgaacccgggaggcagaggttgcggtgagtcgagatcgcgccattgcactccagtctgggtaacaagagcgaaactctgtctcaaaaaaaaaaaaaaaggatgaggctttcatgaaaacgactcattattctacctttcttctaattttgagtatcatttaagggtcctctactttgggttatatagctacctattattctgtctcaatttgaaagttgagagacagttcactccagttaaaatggcttacaccaaaaagacagtcaataacaaatgatggtgaggatgtggagaaaagggaaccctcttgcactgctggtggaaatgtaaattagtacaaccactacggagatcagcttggagattcctcaaaaaactaaaataaaggtgctgtacaacccagccatcccactgctgggtatagaccccaaagaaaagaaatcagtacatcaaacagatgcctgcactcccatgattgttgcagcactattagcgatagccaagatttggaagcaacctaagtgtccatcagcagatgaatggacaaagaaaatgtggtacatatacacaataaagtactactcagccagaaaaaaagaatgagatcctgccatttgcaacaacatggatagaattagagatcattatgttaattgaaataatccaggcacagaagacattatattacatattctctcttatttgtgggatctaaaaatcaaaacaattgaactcacagacatagagagtagaaggatgattaccagaggctgggaagggtaacggggggttggagggagggtggggatggttaattggcacaaaaagaaaacagaaaaaataagtaagacctactatgtgatagcacaacagggtgacaagagtcaataatacattgcgtattttaaaataactaaaagttgaaaggcaagaagcttttgtcagcagaaaattcaacaaattaaaagttaaaagcaacagataaacaacagatgctggagaggatgtggagaaataggaacacttttacactgctggtgggagtgtaaattagttcaaccattgtggaagacagtgtggcgattcctcaaggatctagaactagaaatacaatttgacccagcgatcccattactgggtatatacccaaaggattataaatcatggtactataaagacacatgcacatgtatgtttattgtggcactattcacaatagcaaagacttggaaccagcccaaatgtccatcaatgttagactggattaagaaaaatgtggcacatatacaccatgggagtactatgcagccataaaaaatgatgagttcatgtcctttgtacggacatggatgaagctggaaaccatcattctaagcaaactatcacaaggacagaaaacaaaacactgcatgttctcactcacaggtgggagttgaacaatgagaacacatggacacagggcagggaacatcacacaccagggcctgtcatggggtgggggcctgggggagcgattgcattaggagaaatacctaatgtaaatgatgagttgatgcgtgcagcaaaccaacatggcacatgtatacctatgtaacaaacctgcacgttatgcacatgcaccctagaacttaaagcataatttagaaaaaaagaaaaaaaaaagttaaaagcactaagtttcatcccagcttttctaataactagcacagcatctttctgggcctgtgtttgtatatagtgaataaggatctttgaacttgagtattccttccagttttaaacttgcatgaaactaattattcaggccaacaataaaagacaagtcaccactttgctagcaagaagaaaagaaatatgtacatggggatatttgagggaccttgagaagtcaaccagtttgcttaatgctaggatgatttaagtctgacacctgggatagagatcccatacattctttgttgatgttctctaaggtttttctccctgaaagtaagcctctgtgatttatatgtacggaataagtaaagtatgcaaatatcataagtatataatagtcactgcactgatgcagtgaatcaacctatattctgagacatgatgggctctgcagtatgaaataactttgaggtactcggccaggcgcggtggctcacgcctgtaatctcagcactttgggaggccaaggtgggtggatcatgaggtcaggagatcgagaccatcatggctaacacggtgaaaccccgtctctactaaaaatacaaaaaattagccaggcgtggtggcgggcgcctgtagtcccagctactcaggaggctgaggcaggagaatggcgtgaacccgggaggcggagcttgcagtgagccaagatcgcgccactgtactccagcctgggcgacagagcgagactccatgtcaaaaaaaaagaaaagaaaagaaataactttgatgtactcataaaagaggatccagaaagataatttgttatttggtctgaaacttaaacataatctgctctcagggctgagggtgttttctcctattatcaagcctatgtagttaaactttggcccatgtattttgaaagatgaagcataactaaacttacagaacttcccaatcatgcacacacatgcgcatacacacacaacatacacacacacattttcctttcctcctaaaggagacaggatctatttttcaaattatatcagtaagatttgattcaaagaacacatgaattatcttcaccctataggtggagcaatttaccaatactaccaagaatagagcttctagaaggccaaaacttagagaaggtcactaaagggcaagttcagagtctcaggatcaagggcagaaatgtggtaactgttgcttctgtctccctagtccaggaaaaaggcaagaaatttcttcagatgaacagaaaactaaatgcctccatggaagcttgtcctccttgacccaaatttctttctttctttctttctttctttctttttcttcttcttttttttttttcatggtctcactgtcacccaggctggagtgcagtgccaaatatcttaatgtagcaatttctctccacaaggcaatatataatctagaaattcaatgtcatacacaatcaccgccattaagaagctttcaatccagccaggactctacacatacaaatagaagcattgactatagggttccatgatggtcaggaatgagaaaatcaaaattaaaaaacaacaagcatagactataagaactgaaagaggttaagataatctagtccagtggttttcgtactttttggtagaattttttagggttccatagaagggcctcaaactattgaaaaagagtctagggcatttctttgcacctaggaggctctagcttcatgaccttcttttatttaactttatttattgttttatttaacttttactttatcttatttagttctacttatattgttagcagaaagggttccatgaccaaaacaaaatgcttgaaaaccatagctcttattcaaattcttcaattaaaatataaagaaatgaaggccctgaaagggtccagcaatctgtccaaagtttttctgtaactagccaagccatgaagtgttgaagaaaagatacattaccttgtgacatctctgcttctttcaagtgccaaataagtgctggagacaaatcatgtaggtggatacaatcacagggggacttcagtggacagagagtgcttcataagggagattgggcttgaactgggctatgacctgtgaggagagtttcaagagttggaaggagggtatcatggcagaagtacagtctaaatgaaggtgcaggggcactgatgcatccaggagtgctcttataactgtttcttgtggaaacggtatgattatgaaagctgttaaataatattgagaataacactattgtgtgtttgtgtcaggtgagacacaatgaggaagtaaaaccaaaatgcttgaaatgaaagaagtttattactcacaggttcaagaggttgagggtgccaacaggaggctaataggaagcctggggatagcagagtgctcaaccagtggatggggagtgagaaagggggtatatctgtgggactatggctttattaaggtccatgggcattatctcttaggttttcctgtgagaattgtggattggctagtttaaagaaaacacacatgaagagggatcttattcacatgactctggtgttcattaggttttatcatgattaccagctgtggagtgtgctgggtttggggttaatgagatgcggaatttgtgaactatattacaaacaaacacatggagagtggaagttttaactaggtcaaaggtgatgggggcatgactaggttaccaataacttatgtcaggccaaaaaaaatgaatgccaaggcagtgattatattaaacaaatttacgacatggtgttagtgacctatggttcctgctcaccaaacattttgattctcattctgacaaaatctgttgctactgatcttttcagaatggtgtctgtactggaggattctgtcaaatcagctttggtatgaaccttaataagctataatttctataattggcataactggctaatttttcttttcatatccatcagcaagcttagagataaaataccaaattttatcccatatactgaaataccattatttacagtgcgttttgattatctgcagctagacttttttcataatatctgggtacccacttccaacacataattctgtttaattgtcatgaccacaaagaccattcttcctgaaaggcattgtatccccatttctatttaaaagacaccaaagaaagcaaggggtttgtgttgtatttggtatgaatagtttcagggatgattaacaaatgattcttggctaaaagaaagaaatgttgggagttgatattattgcatactagtgatgatttagttgctttacttttttagctttactatggcataggcatagagtgagagagttcattagaataatttctctctttattaaatggaagtaatcccagggaggtgacttacccaaagtcatgtcacacataaattgagtcaggattacaggtctcttaatcattcacaaaacttcctttctctaaaatcaccctaatttgaaatattttctgaagtctagtaagactgcttgagactttctttcatcttttcttgtgctgttcatggagcagcacaacttgactgtggaagggtaggtgtattagtcaggggcctctgcaggcacttattaaaaaattgacttgcatgattatgggggctgagagtcccaagacctgcaagctggagacctaggaaagctgatggtatagttctagtctaagtctgaagtcctgaaaaccaagagagctgattgtacaagttctggcccaaaagccacaggcttgagatccaagaagagctgatatttcagttcaagtctgcaggtaggaaaagactgatgtcctagttcaagtagtcaggcaggaagggtcccctcttactctcagaagggtcagccttttgttctattcaggccttcaattcattgcatgagggccatcctcattaggtagggcaatctgcttcactcagtctaccaattcaaatgttaatctcactccaaaacaccctcacagacacacccagaataatgtttgaccaaatatctggacactctatggcccagtcaagttgacagataaaattaaccatcacagtcaagatgagggaaactcttctttttgtaaagggagatagaacttgggaaatcattagtcttctgtccttccactcatagaatgaccagcatctccaagcaggcaggttcatttttaagatgatttaaaggtggatgaagcttccaagaccagagttcctataaaagagatttctagagattgaaggcaccatttccctaactctataaatgagggaggggtgtaatattgctagttggaactgctctcacccccttttcaatttttatgtatttgggctgatctcaccatgcatttttccctctgctggggtttgggcagagtttggagtagcaaatatatgaggatattcagcaagggaaccataagccatggaaaaacatggaaatatagctgtaaatggaggcagattatagatgcagaatataggaacatgtcaggaaaatagtccagatataggaagttcatggcaattgcagataataatgagataataggtcagagcctgacaagtaatcaatagcagactctagaagctaaatggcaagccaagtccaaggaaagagtcagaatagtataaattgacacaaggctccaaagacaagaagatttataaaccagacaacttctgtctctgacaggaagcctcttatactttttttatagtagtctggggcctgcttgccaggatctagccagttcaggaccaacattgctgcaagtcacagaatcacgatctttgtcagaagtacctgccaaggactgtgagaaacccacaagaggctggaggttggaaacagatttcagtagaaggaggtaaatttgtaaaaagaaggccaaaaagaaaggagacagaaaagaattttaaagtaactaagtcctgtttgtaaaaaaaaaaaaaaaaaaaaaaaaaaaaacaaaaaaaaaaactgctgggcgcagtggctcacgcctgtaatcccagcactttgggaggctgacgcttgcagatcacaaggtcaggagatcgagtccatcctggctaacacggtgaaaccccgtctgtactaaaaatacaaaaaattagccgggcatggtggtgggtgcctgtagtcccagctactcgggaggctgaggcaggagaatggcgtgaacccgggaagtagagcttgcagtgagccgagatcgcgccactgcactccagcttgggtgacagggcgagactccgtctcaaaaataaaaaataaaaaaaaaaatcttcctcaatccccacagacaagtttaacagagggcttcacattgttgtaatcagactacataaatgctaaacaataaaagatagaaaatgttagtattgttgtcagtaaaattcatagcagttaatcttgtcccagtaaaatgttacttatggtatatcccctggccattaacatgtttttatttcttttcttgagcttaagcaaaagtgaagggcattaccagtcgaattttctttttgtggttgtaattttgaaactactgtaaacttttcttcctctcataaccatgccttttctagagtccatagtcccactccatgacaattacactacaaagcaatgtacaggttttagttatgatgttctgtctggaacggtgaatgtgaacactcactcatccatgcaacacaggtattgagcttctactatgtgtcaggcattgttctatgctctggagatacagcagtggaaaaatgcacacaaaactctcctctctcataaagctcatgttctggtgaactttctaacatgctgtttagaggacctgataactaggacttctggcctatcatggtacacacatgaaaaatcagcttttcgtttcaaccaaaagctctttcctctctgcctgtactttaatggtttagtggaatatctcagttttagaaaagcattcctattctccatcaaaaatgatataagattgggaaaaacagaaatctgaatgtgacttagatcatacttcttattgcataaatacagtatatcctacctccatagatttcttgtactcttatatactccagaatgtatacctgggcttgacttcaagctcctgggcctgctgaaaccagaccctttaggggccatcattcagaatctacagatatttactgaacacccattaagtgctggtcacatggctagacacaatcaaatcatcatcccgtttattcctcacaacaattctgtaaaaggtaaagaacaggtattcttaatcttcacagactttcggtttctcagcaagatgtgcaatgacttacccaagatctataaaccagtaagcattccattggaatatgaaaatcattctttgactctatgatcttgcctcccagtgttcttatgggggactctttttccctattgatcaccttcattgaaaacatgcatgccgacataacacacacagtagccttggtctttatttagaacaggtatattcaattatcctgactgttcaatgtctattatttcctttagattccacatttgcatgggaacatcaagtggggacagcaaggtattggtgataatgaaaagaccattcactagtatatgactgagagtttgaacatctttccctattccatttggtattggtaaatctgaggcctgagcagtttctcagtagagattcatgcaaaatcagaggaaaagccccagacatctgtatgagtagcaaaatttatgaatattctattgtaccactggttagtagggaaaagccttcagttatgactcaacctcagaagttaattagatggaagcacctatactaatcttccgcaggcctccctgtgttctgtttttgtttcgtttattctacttgcctactatacttactgtatgggttgacatagtggacatcatttgatattgtgaatccagagggttttgtggaccacgaagtctgttctcaattatatgtaaggatggggaagacagaaaaaaaagagaaaaagctataggtgataaataattcttcatggctcagtggaatcaactgtttgtttctaccccagctcccacaggacctttccacaaagcttctaacaaccagaaagcaaactgattttctgccagtttcttccattctcctgtggccctgtgatggaggtggtaacgaggaagataaagaccctaaagtccagtagcaaatggaagttatcaagtggcctgaagcatcaggcaactagataaatatccccagaagagttgaaaattgactgctgtcatgagtgggaaaagtcagctgcagtcagattattgattattttgtagtagaaaaattatccccagtgtctgaatccttggaaaaatgaacaatgaaaagaaaagattttcaataaataacctaagctgatttgacagggatctgaatcaggcccctgcaaaggtaagaaatataggaggcagccatacctttaaattcagtctttgacagagtcagatatgatcattgacggtcacaccccagagatttcattatttttagatttcattattttttctgcctctgcaaaaataatacttgctcatctcatcacattgataatgtactgtcaacactggagaaacaaactgtgtgtgttttttacattcaggcctaagaatgtcactcaggtaaggttccttcaagaccctaggatattacatttccttctgtgttcctcatcagatcctttttaatggtctaatcagagaactttgaagctcaaaggtaatttccatcctaagctgttatgattactcgccttcaaagacccagaacctctgagtccctgtccttaaaagactgttctcaaataattccatcactacttggtcctgaaagagaaatagagctgtgtctttgcccaagttactcacctcttaaacaattggtttaaataaaaatatacatctgaaaaatggaagattcagcacaattcatgatttaacaactagcattgctgggcatggtggctcacacttgtaatcccagcagtttaggaggccaaggcaggaggattgcttgagcccaggagttcaagaccagcttgggcaacatagtgagaccctgtctcaaaagagaaaaacctagtatattcaatgttagatacgaatgcgaggatgaatccaatgttatatacaaagtagttttctttttctaaaacttgaagaataaaagtgtttttaggctttaagttatttcagaatgcaggtagtcatggagaagatgagaaagttagtttgatgagagattttaagctcatcagatctcaaatgctccattttccagcccttccaacagtcaatagattctagaaagaaaaaaaaataacatgagatggctgccaatgatcactaccagaaggcttccacttgctaggcctccatttcctcatctgaaaaatggcggagttattggccaggcacggtggctcacgcctgtaatcccagcactttgggaggccaaggtgggcggatcacggggtcaggagatggagaccgtcctggctaacacggtgaaatcccatctctactaaatatacaaaaaattagccgggtgtggtggtgggcgcctgtagtcctggctagtcgggaggctgaggcaggagaatggcgtgaacccgcgaggcggagcttgcagtgagccgagatcgcgccactgcactccagcctgggcgacagagcgagattccatcccaaaaaaaaaaaaaggaaaaccgggggagttattttatattatatttaacatgccatgcattccagtgctggcattgccttaattcaaatgccccttcacagttcctgtggctacttcctcaataggctttctctagcttcgaaagaattgcctccttctgtagactcaaagtttcttctcataatttatttctcactgaaatgatggaggcccttgtcagaatttctgtgataggtggaattctaagatggcctgccaatattctcagtcgctggtgtatatacaccttctcccagttattcaatccaacaccaatctagatactgctatgaaggtatttgcagatgtaattaaggtcccaaatcaggaccttaagatggtatgattatctagatgggactaaacagttgcataagcgctttaaaagcagagttttatctggctggtgagagaggaagtcagagagacaggatccagctgacttggaagaaagcaaacatttatcttgtgaactgcctttgggagccacatggcaagatactgtgggaagcttctaggagctgagaggtcgccagccaacagctagaagaaaaccaaattctgccaacaaatcgaatgaaatgagaagaggccttgaacccagatgagaaattcagcccctgccagacaccttgatttcagttcagtgagactatgagcagaaaatcaaagcatgctgtacccagacttctcacgcacagaaactgtgaattaatacgtttatgctattttaaacctttaagttttactaatttttatgccgcaataaaaaactaatataggtccttttaaccatcaaggcctggcttctcttggcttccccacttttcttgctttaaatttcccttagcttgggaattatttattcttcttcacatctcttctctgaaaagacatgagaaagatttacagataatatatttgtaaatggaacaacattacatgacgtagccacagccacaacttcctgtcattagtgaaactaaagacatgaaatatagtaatatgagttaaatactcagtcacccagaggaatggaaaaataaatccaaaatgattccatgaaccttttagccaaagtttcagcgttcaatacaaacctagatataatatcaattcctttattcaattatttagaaatatttagctagcactatgtcagatagcagggacaccatgatgggcaagacagaaaaggtttctgccctcatggagctgacagtctagtgcagtgtggtccagtagaaatataatacaagccacatttgtattaggttggtgcaaaagtaattgtggttttgccatttgcatttattaccttcaaagatgtcaataaaaaccaagtgaaattatttcaatgtaatttatttaacccactgtatccaaaatatcattcaacatgtaatcagtatacaaaattatcaatgagatattaggcattcttttttattgtactaagtcttcaaaatctggtctgtattttatacttactatgtatctcacttcatactagccacactttaagtgctcaatagccacatgtggctcatagctactgtactagtttaataagtgttaaccagatgaatggcaggtaaaacggtgttctagaagaaggaaatagcataagcaaaggaccagcagtgcaagaagatgaatgtgcccaaaggctagaggaaagaaagcagaacatttgcagaaaaacacaagtatttcagacgctgctggtgtgtggatggggaaggaagaagaaaggcccagcgccccaaggtccaaggcccaacacctcacttcctgctgagatactctgtcagctctgcttctttctacattaggtccctcataagtatattcctttctctgcttggaaattttattctctaaacctctcctcccaagaatatctaacctctcatatcccgtaaaatagtaggcttaattctgccacattattagtggcaatcacccaaggaaaaggctatcactggggccgaaaatagttttgcagtgcctcagacatttagtttgtattgccaccactctgggcttctctacctgccccagaagtttctctcttcctctgtaaaagtagtaataatcgtggctgggcgcggtggctcacacctgtaatcccagcactttggaaggccaaggcgggcggatcacgaggtcaagagatcaagaccatcctggccaacatggtgaaatcccgtctctactaaaaatacaaaaaattatctgggtgtggtggcacacgcctgtagtcccagctactcgggaggctgaggcaggagaattgcttgaacccgggaggcagaggttgcagtgagccgagattgcaccactgcactgcagcctggagacagggcaagactctgtctcaaaaaaacaaataaataaaattttttaaaaaggagtaataatgataaacaacaactgccacgtattaagtacttaaaatgtgccaagctaagtgctttacacggattacctcttttaaccctcacaagagccctctatatcaggctgcttcattatcttttgtttacaggcaaaaactgaggcttagagtagtgaagtgatttcatcaaagtaatgcagcaaataggaggtacagttgggattcaaacccaaggagtctaaatttggatagtttacattaagttattgtgcttcacctccctctacacacacatgcacacatgggtgcatgcacaagtacacacagagcaaaagctaaggctctgggaaatacatggtcaagttcgaccgagccctcaggagggtgagctggtggtcattctgaggaaagagagatgagaagatggtcttaaagtactaggatgtgggaccaggaagagaaagggtatcaggactgacctgccaactatgctttctgagcacccctgtctgggccaggatttatgccagctcatccttaccttggactatataagagaaacacaggtaagaaagactgaattgctattaaagttgatattgttgggccagtctctccttgagatacacacacacacacacacacacacacactccaaccttccagaggtgcttctctgtacattgtaatgtaattggtgtctcagggctactgggcccatttattgcctctgttcttgcctttgatcctctagagaagaggtgatggatggcaaatgcaggagccgccttgccggtcattctaagcaaacagaatcactaaccaatttcctcccaacctcatcatctctgtctagttgttccccacccccatctttgtagagaataattaaacttgcaagcactgggcattgttacttaaagctaactgcaatattcaaaaacaaccccaaagattttttttcctggtctgctgccctggattaagggtggctttgttttgttctgatttcttgctgcctgtgatatctaatttgccattgtgctttaacaacaactctctttaaatactagaagacagttctaaccatggcagggggagatggaggcaaagacgcccaagctctacagacactgaatcaggataaacatcctaattatttaactctttcttcagctactggcctcctcctattacccaggagaacatttgcttagttcctctaatgcacaccatttgtatttcatctgtcttcgcaaatggatacttggtaactttgatacagctctacccaacacagctgtgtgggtgtgcaaacccttatagtgcttgaaaattgtcatggagattgaggtctaaaaaaatcagccatctaaattgtcttttaaggggcaccggatgacgcgaattgtgccccttccaacagtggtttacaaagtgtaatccctgaaccagcaacattcacaccacctggaaacctagaactctaaattctggccaaacatggtggcccacacctgtaatcccaacgttttgagaggccaaggtgggaagataacttgaggccaggagtttgaaaccagcctaggtaagaaagcaaggcctcatctctaccaaagaaaaaaaaaaatccagattctttggccccacaccagccctactgaatcagaaactctgagagggggaaaatctgcatgattcaggtggctctgaagcacgctaaaatttcaggaccaccgaatctagagttagagaacctgtgtttaaaaggcaagaagacccctgtctctcctaaaaatacaaaaaattagccaggtgtggtggcaggcacctgtaatcccagctattcaggaggctgaggcaggagaatcagttgaacctgggaaggggaggctgcagttagccaagatcatgccattgcattcctgcctgggcaacagagccagactctgagactatgtcaaaaaaaaaaaaaaaatggcaagaaggcagagtagagggaaaagcggctttatttttaacagtggttttcaacattggatgcatactagaatcatctggagagctctaaaaatactgatgcccaggtcttactcctagaaactctgactttgttggtctggtatggggcctaggcattagtattttttcaaagctacccaggtaattctaatgtgcaaccaggactgagagccactatttttagaaatataggggaggatgtcatctggagatcttttaccttttcagttataacctggtccatgccctgttttggatcaggggagtgctaggatggctcatgagaaatcaggaggtattaccagtttgagaaggggaaggaaaggcagctaacatgcactgaatgtctgctatgcaccaagcactatgctaggcactatatccacacatccttgaacagatagatttgctggcagcaatcgctgttgagcatccaagggaaggaattagaataaggagatgattagttcacaggagcacatgcagagaagcttctcattataaccactcaaggaataaacgaacaaaaaactgtaaagagccaagcatatatttgggatgagttaggtagatcccagtttagatgcagaaggctggactaaatgacctaatattttttcaaaatttattctagaatactatgaaaaggcataatgtcagatacaatctggaagctatttctgcacattcaaaatgatggagaaaactgaggtactatctcccaaaccattctcactgaaaactttgagctggctcaggcaaccttaaagaggaacgaggttaagtattacacccattttatagactaaaacagtggttctcaatgtatggtccctggaccagcagcaccagcagcacctgggaacttgttagaaatgcaaattccccatccccatcccacttctactgaatgagatgctccaagcttggggccttgcaatctgtgttttaacattctctcaggcaaccctgatgcatgcttgagaaccggttttagaaccacagtttactgagtttgttcaactgatcctcaagggaggagtcatttttaaaatttttttcacatcagcaagtattcactgaggatcctgcctatctataccccaacgatgcccttctctgaattgtactggaaaactaagagatgcaaggctgcagggaggactggcaatgtggctggcaggaaatactagagactgaggctccaaatcatataatgtgcttgtagtgtgaccctacaaagattacctaacaactctgagtcaaaatctagcacatggcaggtgttcagtaaagatttggtagctaaatacctgtaaggatgatagtgctgaaggagacaggatacaatgaaggaagcaggagtcagacatatctcagtttgggccctgcctctgcctttgaactagctctctgatcttgagcaaggcacttcccattttagcctcagttttctcagctataagatgagggagggagattctgattacatgatctctataggctctgttgacatctaaactgttctgtttcaaaatgagccaggcacggtggctcaggcctgtaatcctagccactatgagaggccgaggcaggcagatcacctgaggtcaggagttcaagaccagcctggccaacacggtgaaaccccgtctctactaaaaatacaaaaattagctgggcatggtggcgcacgcctatagtcccagctacttgggaggctgaggcaggagaattgcttgaacctgggaagcggaggttgcagtgagctgagagagcaccactgcactccagcctgtgtgatagagtgagactctgtctccaaagtaaataaataaataaataacaacaacaacaacaacaaaatctacactatgatcttgagacagtttagtgatccaatttctataaagatagggctatataaatacaaaatgtactgaagcctcaagatacattttatatacaggatcaatttccagcacccggcaaaatactgctatttaacaccaaaggaagtggcttaataactagagctttcaattgtctgagtagtacacaggagtatttcctcatggtaggaagttgtttggagtagctgggaaacattatgcacaaataactggggcaagctgcttgtgttcattaggatcgtagaactggaggaacccctcaataacctttaaacttttgaaggtgaaaagtattagcaaagggtcaagaaaaaccctacatacagattaacaggaagaaatgcaaatagtgaaaagagctagggcgatggaaagaggccagacccagattcaaatccctgctccacagtaactgtgtgaactcagacatgccatttagcatctctaagccacagactcatctgtgaagaggagataataacacctgcctcataaggctgttctgagcattaagtagaacaatggactacataagagcccagtaaagacacacccccatcccaccaagctgaaatgctccatcaattagagatgatgttattattctgaattgcctttgcatgtgaaagcaaagagaattgtgagatcctggctgcctgcaacttcatcaaaaaaaagaaaaagaaaaagaaaagaaaagaaaaaaaaagagacttgacaagaacctgctgcctactctgtacaggatattgtgaggcatagccaagaaatggtaggtggaatcacaccgaactgcagtatttgaccattttaccgacaaacccaccaatgttatgtggttcaacctaagataggaggctgtcccttattttatataaagtctgatcctgtcaggaaatgattgatgcccaggaaaacaatatcaatccccaaatgtctacccaagtcctaagttgaatatacagtagaccccgttatccatggtttctctttctgtggttacagttagctgtagttaatggaagtctgaaaatacgtgagtacagtaagatattttgagagaacatttacataactttcatgacagtatgtgtaataattgttccattttatttttgattactgttgttaacctcttactgtccctaatttataagctttgtcatacgtatatatgtataggaaaaaacataatgctgtatacatgaagtttgatactatctgcagtttcaggcatccactggggtcttggaacatatccctccagggtactgtaaagcaaaatgtgcagtgcagggaggcagctggtgaccctagaggtagcaaatgctctattttggcttagtgaatgaacggactcaccactattttgatatcaaaatagccaccttttagccacccacctgaccccactcttttctttctcagtcatggatatgagggcagtggaacactgagcccctgctgcagaagccctagcatgccaaagccccccactggggagcctcccagttccaggcaaaggaattcagcacagccaaagcaaggttgagatgaataactggatttactccttgagatcccgggagcctccaacgggaacaggctgtttcatagggccagtctcagctgataagaggcagcaaatgactctttccaagtcacagtcattatgatgcctgtaacctttttattataaaaatatatgcatatcccgcagaaccctacttacttgcgctttcttggatggctgctaggtttcacacacgccagattagatacattctgacttgttcaggcactgtcagtttaggtcctttcctcctggaagcaacaaaaccaggcaaagagattaataaggtccactacatataaggagaaattggggggcactttcttagccagaggttgctcaaagacagccccatcccagttgatgaaccagtctaccatgtacatggtgtctagctgatccttttttccccctacacagcctgctcagacatagcctgtattttacccttgtcaaatgggggagggtagcatgtcccttctgcagaggattaaaaccacacagtttccagcctggacactgctcatgctctcccctgagggaagtgggtagttttctggctggccctctcacaggcaggaagtttggctgccatacatcctcggtttcacatttacttaacaaacaattatgtaacagtttccatgtgccaggcactagtctagccactacacacatatcaactcatttattatcctcataagaaccctgagaagtacagtcacatgctgcataatgaaatttcagtcaaggatagaccacatatatggcgttggtcacataagactataatggagctgccttatacagacataccattttttatcatttatatcatttatcatttttattatatataaattatattgtgtataaatgatattgtgtgttagatacacaaatacttcccattgtgttacaatcgcctacaatattcagtacagtaacatactgtacaggtttgtagcctaggagcaatagaccataacacatagcctaggttcctagtaggctataccctctaggtttctatgagtacacactatgatgttcacacaatgaaaaaatttcttaaggagacatttctcagaacatatccctgtcattaagaaatgcatggctgtacgtacagttattaagcccattttacagatgagaagtctgaggcagagaaagatgaagtaacttgcccaaggtcacagagctgctaagtgggagagctaggatttgaccaggctacgatttgagctggtaagtgggaaagctgtaattatctccccttcacagatgaatctgtggcttagagatgctaaatggcatgtctaagttcacacagctactgtggagcagggatttaaatctgggtctttcctctttccgttgccctagctcttttcactattgcatttcttcctgataatctgtatgtagggtttttcttgaccctagctccagagtttgttctctaaactactagagtatcctacctcttgaagtacgattttttttattatactttaagttctagggtacatgtgcacaacgtgcaggtttgttacatatgtatacatgtgccatgttggtgtgctgcacccattaactcgtcgtttacattaggtatatctcctaatgctatccctccctgctccacccaccccacaacaggccccggtgtgtgatgctccccttcctgtgtccaagtgttctcattgttcgattcccacctatgagtgagaacatgcagtgtttttaagggataggtagaggcagagggaagggcagaggctctacccacagatgcagccactttcaccaggtcttgaattgagaggcactaaagacttctgctctaaaatggttttcccttgcctttatgcgtcagagttcatgctgtgctccctcttctgaggcatccaaggtcctcacttaattatgaataaaacttggcaggaacagtacagttatcattggtcattaacacccagacccaaagcatgttatcacattcaaagtcaggcagacttctgagaatctgggtccctgaagaggcaagttgtgaagatgaggaagagagtttaagaaaggtctatggctgtcaaagctgcctaggagagaaaggcctgaggatgatcatgatgaagatacccgaagcagcctaagggattttatgaaaatattgggtgcctcagcagcaagaccctacaggaggaaataagactacactgaaaacagactttactccttcccggtttggcccccgcaatctcgattcataaactacacccaactcaaacgtgacacatggcagctaggttctcttctgcagtggcagaggatcccaggttaataaagaaggcccgtggttaggcaagtgtccaaactcacacttgtcctcttcttggctgtgtcaaagatacagtcctcagtgaagcctgtccctagctcccccacgctagggcagcatttgagaaaacaaagcaacattaaagcatccaggtcagaaggcacaagaaaaccctcacatggtctggataagccagggttattgactgtggcagtgacaggcagatcctctcagacggttacaacccagattcccagctggttgtggttgcacagcccacacactctaacgactcagcttctctcaatatgattaagattatgattaatctttcatttatcaaacatttgatatgtgccaggcactgttattagtgttttacatgtatgaactcatttactcttcacaattatgttattacgtagttattattatgcctagaaaaactgatgctctgaaaaatagcaggccagaggtcacacagctacaaagtggaaaattggggtctttctctcctctgtctcaaaagtcaccttctctctatattttttttttttttttgagacagagtcttgctttgtcacccaggctggagtgcagtggcgtaatcttggctcactgcaagctccacctcccgggttcacaccattctcctgcctcagcctcccaagtagctgggactacaggcacccaccaccgcacctggctaattttttttttcttttgtatttttagtagagatggggtttcactgtgttagccaggatggtctcgatctcctgacctcgtgatccacctgccttggcctcccaaagtgctgggattacaggcatgagccaccgcgcccagccatcaccttctctatttctaaaatacaataaggttcatacaaaaggaggtgatttctgcatgaggctctattggtcttttatctctcatcaaggacccagcagcttggggatcaaggaggaagttggccaaggccactcacatcatccaccaaggcactaatctcctcacttatgtccaagccaggctcttcttatgagaggaactaatctatgagcatgtgtttggtgggtttcaccttggatatagtggagggctactttctttgtagggtgctatttagagtatagctggacactttacaagacaggagacaaacagggaatggccagcaggatgtacggtggctatgtgatgaaattcctctccccttaactccccctaccacccatatggttagcccataattggtaaactccgccattctggtcctttaatatggaactaccctaccactggtcaacaagcagacttgccaggctgtgctgggactgaaacctctcttattcttctgggtccagtcagtccctttatcagagtgacctggatggagagcaagggcatctgctttggagccatttaaaggctcctagagtacctctgtgtcctaaggggcagattagaaagaacagggccaaggaagtgctgagaatataggggagactagaagtcaaggtaatgaatgactctgttatgccggcctaccacagtgtacctggaatgatcttcaggatctgcacaaacccttaggtgtggagggagggagaattgattgctgtgtgctctgtaactgaagcccatgtaggaactccctttatagtccaaagaaagcatattgaaggaaagcttacttgtcctggctctggctccctgaaacaaactaaaaaaatctcttaaatctctcttctcacagggaggaaacaaaacatagtttcatggcaaagcaagagaccatgtcacttaagggacagtatcccatgtgaaatagtaacatccatactcatctaaacaccaagtatgcagatggaactgagtaggtttccaaagcaaatttatcaatttctccttcagattagctccccttccagtccttccattcagtcatccagactcaatctcagagttttcactgaagttgggaggtgagagaggaatgttcatcaaaacctattgattctacttttccatcctattattcctagcctcaccaccaccaccccagtcctagaccttatctatgccactccacccccactccaccccacctccctatactggataccttcttgactgccttcctatcttcaggactagcttcatagtcatgctatctgagcaggctcataggtactcacacttggtttaatgctctgctgttaccaccttgaaagtcctaatttttttttctttaacaaggagccctgcaatttcattttgcactgggccctgcaaattatgtagccactcctgcctgtttctccccatctggacccatcttacacatagtgtttattgccagagtttgtttgctaatgccaataataatgcatctaatggctctccgatgcctccagaatcaaacccaaacctcgcagcctggtcttcaaggccctctgttacctggcctccatctaatttcccatacatcccatataaattctactcattccagaatggaggatggttttactattaacaacttcagcagaatgattaacagctgtggagtctgactgtggagtcagacccagttgaggggcctggttctacacttgttagctgtatgactttgggcaaattccgtagcctctctgaacctcagtttcctcatctgtaaaaaagagataccaacagtgcctatctcataaggtcaatataagaattaaatgatataatcaatagaaataagtctctaagcatagtatctggccggcccttagtaaacactaaataagtattagttactaatattatttgttgtaattgttacaaagctgagtagttctaaaagtcactatgcctaatgcctatctaattggccatattgctggctggatttcaggtaactcacagtgacctgccatggccctctacttccctttcatgtacctctcaaccaccatcctctggatggagatgattataatttgcatgttgttgagctgtgttcaccacctccctctttttgctctctgctagtgtgggagcaacttgatgggccagcagaagctgcagaggcagacatggagaggaagcagcacatttgccaactgggtttcagagggaagcagctctgggaactgacgttcaggctttgaccaacccctgccccccgccgccaccttccccctgccaagatctgtccattctcctgggaacccatggtcggccttgggggatacatagagattttggatgagatttgtccaggcatctgcatgaaacagctccgggacagttccctctatcatatcaggtcaatttcaaatttgcagcaaaggttcatcctgagctgctgaagtaattcacaaagtagtcacagaagtggctcaccctatataaagactaaggaccccagcttaagctttttgcatgggtcctttgccacaccccagctgtggtgaggaaaacagctcccagcagggtcactcccagttccttcccatccatttacagatgtgctttatacttctcttagaacagggatcctcaactccggctgcactttagagtcacctgcagaacttctgaaacataccaatgttgggccaccagtaagactaattaaatctgaatgtctgggagagggaccctggagttggtaagatatttttttttttttttttttacttttaggttcagtttcaggggtacatgtgcaagtttgtgacacaggtaaacttgtgtcacaggggtttgttatacagattatttcgtcacccaggtattaggcctagtacccattatttttcctgatcttctccctccccacctccatcctccagaaggccccagtatgtgttattcccctctatgtgtccatgtgttctcatcatttagctcccactcataagtgaaaacatgtggtatttggttttctgctcctgtgtcagtctgctaaggataatggcttccagctctatccatgtccctgcaaaggacatgatcgcattctttttttatgactgctgggtacgtacccaaagaaatggaaatcattctatcataaagacacatgcacgcagatgttcattgtagtaaaattcacgatagcaatgacatgaagctggtaacattgacaaactcctgaagtgattctaatgtgtggccaggacagagaacaagactatatgagaaatgtagcttcttaaccaatttcctggtgtccatgttgttctcccccttgaacctatgtcacttattacttgaaatgtaaagttcaagaaacctccaatatgaccctgtttattttttgccgcccctacccatgcactctaccctccagccacacctggttctttcccagtccacagacacaacacctatattaatctcattgaaatgttgctcacactgtttccctgacttagaatacccccactacttttccaaaagcagtggttttcaaatgtgagtgtgcctcagaatttcctggagggcttgctgaaatacaacttgctgggatccatctcagagtgtctgatttagaaggtctaatatggacctgagatttgacctgctaacaaattcccaagtgatgctgctgggcaaaagatcacattgtgctgctctctcctcaagtttccaaatggcctcttgcaaattgatagtgtggttccaggaagaaatgactctagtgggatctgcccttggcaaactttggggaagaacaggattgccttcagcattcttctatctcacttcattacctcctaattgccaccctcctacttccaagcactcaaggttttcacactggttactacttgttcaaaatgctccacagcaagcattcttgtgttccagccagactcttatgccctccggtctccatactctactaagatgttctgttgataatataacaacagaacatacagataactctatggttaattaagtgcaacatggactctggggtcaaacaggtctggtggacttgtggatccaccacttctctgctgcatagcactgcaaaatcactaagcttccctgaggctacatttcttcatctgtaatatgaggatgtcatgcatagtttgcagggtaattatgaggaataacataaaataatgtatgtaaagaacaaacctgccatatgttaagcattcaataaatagttgctattacaaatgcattaaaactttactattagtaactggtgagagattgcctaggtagccgttgcattttaacaacaaccttcttagtgaggatctctggggaaaccctccatttttgcactgttgccagaatgatcttttcagaatataaattgaatcactttgtccctctgcttaaactttttctcattgctcccctcttgcttgtagaataaaaccctaaatccttaaatgacttatatgcccccatattcagtggttcttaactggggagtatttggaagtttggggacattttggttgtcataaataccaaggggggcagtattaccatttagtgtgcagggaccaggacactaaacctcctacaaccttgcatatgcaaaccagcactccccacccctatggaaaactgtctcaccccaaagccaatggcactcacattaagaaacacccgagtcaaactctctagcctcacctcctatcacttccttgctctgtgtactccagccaccctggccttgcttttagtcctccacagcaccttggacattctgttctttctacttggaaagcagttcttttctgatggatcatttaactcctactgacccttcaaatctcagcttaagtgatattgcttcatggaggccataattcactccccattatagtatatacctccttagaactgtattccttgccttcagaatatttatcttcgtttataattgtgtactctgtaatgttttttgaattatttgattaatgtttgcctcacacataagaccacaaattccaagaaagcaagcatcacgtctgtttttgctcaccattatatacgcaatacctagcccaatgcttggctagcagtaggtactcactctctctctgagaaatgaatacccacataagcagcccctagtcttaatcaagtctccagggagagggggcagttattaacatgctctgctcttagaggtcttagaacaactggctcctactgaactctttgaggtaggagggggacctagatagagtagaaaagtgcttccatgtaattattctgtttgcattcaagcttattagaatgcaatggttggtcacaatgtttatgtttccaatttctacacgtagacattctgattgattgcttgctcccaatcctaaatatattaaaacaaatgaaagattgtttaaagcatgttgtgtatttactttttgatgcttctaagacatgcggggtacctgtccaatttttgtcaaatttgaaaaataccctgtcaagagtccaacagtcttggaacatggtactacatgtgatagagctacttatacctcaactctctagtgaattctgcattaaaaatcaagacaataggctgcttcagctctaagtagcttggagttggtttgtttgtatgtttaatgccatagtccaggcaataagaaagaacgagaaaaagaaagagcaggagtatgtgtttggtgcataaaagaaatgctgattctagctgggtgtggtggatcaggtctgtagtcccagctactcagtaggagactgagtctggaggatcacttgagctcaggagtttgagaccagcctgggcaacacagtgagaccctgtatgccccaccccccaaaaaaatgctgattctgttccagtgtgactagaacccagtaagcaaaggggaaggtaatcgaagatgaagtcatagacgtagctaagaccaggtcagtgaaaatttttgtccattcctgtgagtaggctgggagccatgggatggttttgagcagaggagcagtgtgatctaacttgttttgaaaacagatcactttcagtactgtttgaagaaaaaaatgtgtggaggaggggtgatgtgtgagcaggttgcagggtataaaggacagaagcagccaggccagttaggagactattgtgataattcaggtgaaaggagatggaaattattgaccagatggtagcagagaaggcagtaaaacctgattggatcttagatatattttgaaagtagaacgtgacgtgcgagagaaaagaaatcaaggattcattttttattcaacaaatatttactgaacacctactatgtgccaagtactgttttatgtgcttaggatatagcagtgaacaaaacaaacaaaaatctccatctaatttgagttcactttttgttttgttttgttttcagtcagagtcttggtctgttgcccaggctggagtgcagtggcaggatcttggctcactgcaacctccgactcccaggttcaagtgattctcatgtctcaccctcccaaatagctgggattacaagcgtgcaccaacatgcctggctaatttttagtattgttagtagagacgaggttttgccgtgttggccaggctggtctcgaactcctagcctcaagtgatctgcccagctcggcctcccaaagtgctaggaatacaggtgtgagtccctgcaccttgtctgagcttactttttaatcaataatagataacatgttttgagcacttcctgtgttccaagcactttgcattcttaacttatgtaattctcactacaacccaataatgtatgtgtgtatggtattacctccatttctcagctgaggaaactaaggcacagagaggcaagtttcttgaggtctcacagctgataagtagtgaagctgtgtttccaacccaggaaattatgcttgagagtctgagttcaaagcacttcattctactgcctctttaccaggccagtattcccacaacaggagcaaagctggaccacctgggtgaaaactagggatctaactgctagatgactcaaagttttttggcctgaaaaactgcaagaatgtacttgacatttacaagagcttgattctgaatataaattggtagcctgggcacagaaagatttgggccagtgagtactctctaaaatgtccaatattatttgacacaaaaatgttgtgtcatagcaccatgtaagtgttagctctaattatccactagaatggttaagtggcattcaaaagggcagaatttatcaggcttgctgagactctgacacactgccaggcaaatcaggaggctttggtcagtgaaatcgccctaggattctttcacagaaatctaccatcaaatgtggtagaaatatatgggaacaaaagtgataaggaaacctgagattaggagatatactgatagaaattgcttgcatttttgttaggtgcttaccatgttgtaggtatctacatgttgtaggacaggatgtacctatcctaagtgttggcaatgtattacatcatctaatcgtcgcaacaaccctaggaagaagatattagtatttccatgtataaaactgggggtctgaaaggtttggtgacatgcccaggctctcctagctcaaatgtggtagcagtgggacgcaaacacacatctgtttgactccaaagcccacgctgctccccaggaggttaaattctcctgctgtgctccccagtgaaccctgtccagatcatctactcacctatatttgaattgtttctaacacttaaatttgtacttctttgtatatttctgtacgtgctttggtaccatctcattcaaacgtatgttccttctctcccatttattttataagctcactgaggttggggccctgatttgcttatcttgctactttccagtggtgttacttatgggcatctccccacaagtgagtgtctaataaaggttgctgattgactgcaataaactgttttagaaatctgctggtgattctaaatctggtatgctttcatccaagacaagattaatatcacagtggcaggtaaaataatagctgccatttctttaagatttaatttgtcctaaacaactataccgtgcaaagtgcttcctgtgcattatctcatttaaccctgaaaatatgagtcagatactctaattgctttttaaatttttattattattactattattttgagacggagtgttgctctgtcacccaggctggagtgcagtggtgcgatctcgggtcacggcaacctccgactcccaggttgaagcaattttcctgcctcagccgcctgagtagctgggatcacaggtgtgtaccaccatgcccagctaatttttgtatttttagtagagacggggttttgccatgttggccaggctggtctcgaactcctgacctcaggtgatccgcccacctcggcctcccaaagtaccgggattacaggcgtgagccaccgtgcctggccagatactctaattacaattcccctatttcatgatctagcagtcccactgctgggtacataccaaaaagaaaggaaatcagtatatcaaatagatactgcactcccatgtttactgcagccccattcacaatagtcaaggtatggagtcaatctaagtgctcatcaacagatgagtggacaaagaaaatatggtacatatacacaaaggaatgctcttcagccatgaaaaagaatgaaatcctgtcatttgcagcaacatggatagaactggagggcattatgttaagcgaaataagccaggcacagaaagacagatatcccatgttctcactcatacgtgggagtaaaaaaaaaattcatctcatggaggtagtgagtaaaatagtgtttccaagaggctagaaagggcagaggggactagggtgtgtggagaggttggtgaacacatacaaaactacagttagatagaaggaataataacttatagtgttactgcatgttctcactcataagtgggagttgaacaatgagaacacatggacacagagaggggaacatcacacactgggaactgtcaggggttggggcacaaggggagggagagctttaggacaaatacctaatgtatgtggggcataaaacctagatggtgggttgataggtgcagcaaaccaccatggcacatgtatacctaggtaaaaaacttgcatgttctgcacatgtatcccagaacttaaagtaaaataaaataaaataaataacttatagtgttcaatagcactgtcaggagactatatataattaacaattcattgtacaattaacccttgatttttttccaaccaaactcagactgaacatacgttcatccattggtatgcatggggagttggttccagtatgttcacatgtaccaaaatccacacatgctgaagtcctgaagctggccctgtggaaccccatatttaaaaagtgcaggttttgtatcctgtgaatactgtatttctgacccatgattggttggaaaaaaaatgtgtgtataagtggacccatgcagttcaaacccatattgttaatgagtcaactgtacagtatttgagaatccgtggatacagagggctgactttttgtatctgtgggtttggcagggctgactgcagacagaaggatgtttggattttggaatacaagggtcctggaaccaacccttcacatatactgaagtatgactatatatttttaaatagctggaagagaatatatacagcattcccaacataaagaaatgataagtttgaggtggtagatatcccaattgccttgattttattattagacattgtatacatatatcaaaatatcacatgtaccccataaacatacatataaataaatatgtccaactattatgtatcaattaaaaattaaaaataattttagatggctaattaggaacagctctggtctgcagctcccagcatgattgacacagaagatggatgatttctgcatttcaaactgaggtcatcaggatcaaagaccaaaggtagataaaaccacaaagatggggagagaccagagcagaaaagctgaaaattctaaaaatcagagtgcctcttctcctccaaaggattgcagctcctagccagcaacagaacagagctggacagagaatgacttcgatgagttgacagaagtaggattcagaaggtcagtaataacaaactactctgagctaaaggaggatgtttgaacccattgcaaggaagctaaaaactttgaaaaaagattagacaaatggctaactagaataaacagtgtagagaagaccttaaatgacctgatggagctgaaaaccatggcatgagaacttcgtgacgcatgcacaagcttcaatatccgattcgatcaagtggaagaaggggtatcagtgattgaagaccaaattaatgaaataaagcaagcagacaaggttagagacaaaagagtaaaaagaaatgaacaaagcctccaagaaatatgggacaacgtgaaaagaccaaatctatgtttgattggtgtacctaaaagtgatgggaacaatggaaccaagttggcaaacactcttcaggatattatccaggagaacttcccccaacctagcaaggccggccaacattcaaattcaggaaatccagagaacaccacaaagatactccttgagaagagcaaccccaagacatataattgtcagattcaccaaggttgaaaagtgttaagggcaaccagagagaaaggtcgagttacacacaagggaaagcccatcagactaacagcagatctctcgtcagaaaccctacaagccagaagagagtggggcccaatattcaacattcttaaagaaaagaattttcaacccagaatttcatatccagccaaactaagcttcataagtgaaggagaaataaagtcctttacagacaagcaaatgctgagaggttttgtcactaccaggcctgccttacaagagctcctgaaggaagcactaaacatagaaagaaacaaccggtaccagccactgcaaaaatatgccaaattgtaaagagcatcgatgctaagaagaaactgcatcaattaacggacaaaataaccagctaatatcataatgacaggatcaaattcacacataataatattaaccttaaatgtaaatgggctaaatgtcccaattaaaagacacagactggcaaattgcatagagccaagacccatcagtgtgctgtattcaggagacccatctcacatgcaaagagtcacataggctaaaataaagggatggaggaagatctaccaagccaatggaaagcaaacaaaacaaaacaaaacaaaacaaaaaaagcaggggttgcaatcctagtctctgataaaacagactttaaaccaacaaagatcaaaagagacaaggccattacataatggtaaaagggtcaattcaacaggaagagctaactatcctaaatatatatgcacccaatacaggagcacccagattcataaagcaagtccttagagacctacaaagagacttagactcccacacaataataatgagagactttaacaccccactgtcaatattagacaccaaagagacggaaggttaacaaggatatccagggcctgaactcagctctgcaacaagcagacctaacagaaatctacagaactctccaccccaaatcaacagaatatacattcttctcagcaccacatcgcacttattctaaaattgaccacataattgaaagtaaagcactcctcagcaaaggtaaaagaccagaaatcacaacaaactgtctctcagaccacagtgcaatcaaattagaactcaggattaagaaactcactcaaaaccacacaactacatggaaactgaacaacctgctcctgaatgactactgggtaaataaggaaatgaaggcagaaataaagatgttctttgaaaccaatgagaacaaagacacaatgtaccagaatctctgggacacatttaaagcagtgtgtagagggaaatttatagcactaaatgcccacaagagaaagcaggaaagatctaaaatggacatcctaacatcacaattaaaagaactagagaagcaagagcaaacaaatgcaaaagctagcagaaggcaagaaataactaagatcagagcagaagtgaaagagatagagacacacaaaaaaaaaaccttcaaaaaaatcaatgaatccaggagctggatttttgaaaaaatcaacaaaattgatagaccgctagcaagactaataaagaagaaaagagagaagaatcaaatagatgcaataaaaaatgataaaggggatatcaccacccatcccacagaaatacaaactaccatcagagaatactataaaatatatataaaatacctctatgcaaataaactagaaaatctagaagaaatggataatttcctggacacatacaggttcccagaactaaactaggaagaagttgaatctctgaatagaccaataacaggttctgaaattgaggcaataattcatagcctaccaaaccaaaaaaagtccaggaccagatggattcacagccgaattctaccagaggtacaaagaggagctggtaccattccttctgaaactattccaatcaatagaaaaagagggtatcctccctaactcgttttatgaggccagcatcatcctgataccaaagcctggcagagacacacaaaaaaagagaattttagaccaatatacctgatgaacatcgatgtgaaaatccgcaataaaatactggcaaaccgaatccagcagcatatcaaaaagcttatctaccaaaatcaagttggcttcatccctaggatgcaagggtggttcaacatacgcaaatcaataaacataatccatcacatcttcagaaccaatgactaaaaccacatgattatctcagtagatgcagaaaaggcctttgacaaaattcaagagccattcgtactaaaaactctcaataaactgggtattgatggaatgtatctcaaaataataagagctatttatgacaaactcacagccaatatcatacagaatgggcagaaactagaagtattccctttgaaaactggcacaagacaaggatgccctctctcaccactcttattcaacatagtgttggaagttctggccagggcaatcaggcaagagaaagaaataaagggtattcaattaggaaataaagggtattcaattagcaatcaggcaagagaaagaaataaagggtattcagttaggaaatgaggaagtcaaatcatccctgtttggagatgacatgattgtatatttagaaaaccccatcgtctcagcccaaaatctccttaagctgataagcaacttcagcaaagtctcaggatacaaaatcagtgtgcaaaatttacaagcattcctgtacaccattaacagacaaacagatagccaaatcgtgagtgaactcccattcacaatggctaaaaagagaataaaatacctaggaatccaacatacaagggatgtgaaggacctcttcaaggagaactacaaaccactgctcaaggaaataaaagaggacacaaacaaatggaagaatattccatgctcatggataggaagaatcagtatcatgaaaatggccatactgcccaaagtaatttatagattcaatgccatccccatcaagctaccaatgactttcttcacagaattggaaaaaactactttaaacttcatatggaaccaaaaaagagcccgcattgccaagacaatcctaagccaaaagaacaaagctggaggcatcacactacctgacttcaaactatactacaaggctacggtatccaaaacagcatggtaatggtaccaaaacagatatatagacaaacggaacagaacagaggcctcagaaataatactacacatctacaaccatctgatctttgacaaacctgacaaaaacaagaaatggggaaaggattccctatttaataaatggtgctgggaaaactgactagccatatgtagaaagctgaaactggatcccttacttacactttatacaaaaattaattcaagatggattaaaggtttaaatgttagtcctaaaaccataaaaaccctagaagaaaacctaggcaataccattcaggacataggcatgggcaaggacttcatgactaaaacaccaaaagcaatggcaacaaaagccaaaatagacaaatgagatctaattaaactaaagagcttctgcacagcaaaagaaactaccatcagagtgaacaggcacggcacagaatgggagaaaaattttgccatctacccatctgacaaagggctaatagccagaatctacaaagaactcaaacaaatttaccagaaaaaaacaaacaaccccatcaaaaagtgggcaaaggatacaaacagacacttttcaaaagaagacatctatgcagccaacagacacatgaaaaaatgctcatcatcactggtcaccagagaaatgcaaatcaaaaccgcaatgagatacaatctcacaccagttagaatggcaatcattaaaaagtcaggaaaccacagatgctggagaggatgtggagaaataggaatgcttttacactgttggtgggagtgtaaattggttcaaccattgtggaagacagtgtggcgattccttaaggatctataactagaaataccatttgatccagtgatcccattactgggtatatatccaaaggattataaatcatgctactataaagacacatgcacacatatgtttattgtggcactattcacaatagcaaagactgggaaccaacccaaatgtccatcagtgatagactggattaagaaaatgtggcacatatacaccatggaatactatgcagccgtaaagaaggatgagttcatgtcctttgcagggacatggatgaagctggaaaccatcattctcagcaaactatcacaaggacagaaaaccaaacaccgcattttctcactcataggcaggaactgaacaatgagatcacttggacacagggcatggaacatcacacgccggggcctgtcagggggtggggggctgggggagggatagcattaggagaaatacctaatgtaaatgatgagttgatgggtacagcaaaccaacatggcacatgtatacctatgtatcaaacctgcacgttgtgcacatgtaccctagaacttaaagtataataaataataataataataattttaaaggctgggcacacacctgtaatcccagcactttggccaaggtgatgaatcacttgaggtcaggagtttgagacaagcctggccaacacagtgaaaccctgtctctactaaaaatacaaaaatcagcttagtgtggtggcaggtgcctgtaatcccagctactcacgaggctgaggcaggagaattgcctgagcccgggagtcagaagttacagtgagctgagatcgtgccactgcactctagcctgggcaacagagccagactcagtctcaaaataataataataataataataataataatgttttaaaaaacaattcccatatttcagatgggagaataagatttaaagaggataaaaacctcaaagaaattcagctagtaagtgacagccataggtctgtctaactccacagtcagttatcttagccactggggttaaggtagaaattatgccatatgataatttttctcaatgagtaaatgcaattttaaaaaatgtatatcttcaaatgcttaaagctgctttcttgagatataattgaaatgcagtaaaaatatttaaagtgtgcaacttgatatgttttgacatatgtatgcacctgtgaaaccatcaccacaatcaagataaatagaaatatccatcaccttcaaaagtttccatgcttttgtaagccctccttcccaccattttctagtcttaccctgtgcccaagcacaaattatttttttgaatgtgcaaggtagtaacttgggaaagtctctacttgccaaaggatcatactggctctatccctcatatactggattcatttgattaatgtcacagttagctgatctgtgacttgtgattctcagtgctgaaccctaaattgagtctgacatccaagctaagtacagtaataagagtgatgataaattctctctgagttagaaagctaatctaagaagccagctgggctgattgatttcttcttttcagaaacaaaagatgtagattatttattagatagcctgaaaccctagggatctttttgggctcctgtgtattaggaaaaatgggcttggtatttataagcttttgaaaaaatctctatattgcccagtagagagatttccaggctatgacaaaggtagcatatccagtcagcagctaaattcatttttttaaaaaaacctatcaaattatttatttgatgaatagacctaggtgtgatagattgctgccaggtttttagaaaatgatgtgcaggagccctaaagggcttttctttatcaaattgattcatctatctactttgctcatttgctcatggtgtcctccacccaaacgttaacctaacattttcactctaagtgggagaaaaaaatggtggtgaaggattgtatgaacatctgagccttgatggaccattgcctttggccactgtcccccattcgtctaaatctcagccctgtttatgaaataggatgatagagaaagaaggttaacattatctaaatgatgagagattaatctgtatggttcagctaataagtcataagagtacagggaaaagagcagtcactgtgtactgaggtggtcagggaaggcttcttgaaggaggggctagatgtaggcccagaggaaaatgggaaagaattccaaatgcatctagccactggcatgaccactgtggtaccggcaggaatgagtataacaaatgcaattggtatagaggggaaagggagcatctccaggactgaaggtctctaacagccctgcattgctgacctagaagagatagagacacaaggaaggaaagaggaaagagacagacaactggtgggagtaaaagagtagtttctgatcaatttttctgtctcttttacctcattcagtggcaatcggatgtctgggtcttttaatttcagacaagcccttgcctacccatcaaagataaagcagttctgcttagagcagtttctactagcagcagcagttagcataaaagaaaagtaagtcgcacgaggaatttctgcagagaaaacatttttccttgatttttctgtcaaaagatggaagtatgccatggtgggaaatatctgagacaattcgatctctctgtagtaggccatctggtaaccaagcacttctgatcctccactgatgcccagacatagctcatgcaggatcccagaaagcaatcattcatttaagagagctgaagagaacatctttgcttgttttcatagacacacggggttgaaataaaggtggtctgctctgatctcccaagaaaaaaatttacccaaagtgggctcctggagattgtcttctttatctccctgtcttggggccattttaacgtgatctatttatcccagagaagtgtgcatctccatctcaagagaattttgagatactgttgcaacctttcactactgaatttctccttgtatcttaaagccatagaattattattattatttttgagatggagtctcactctgtcatccaggctggagtgcagtggtgtgatctcggctcactgcaacctctgcctcctgggttcaagtgattaacctgcctcagcctcccatgtatctgggattacaggtgcccaccaccatgcctggctaatttttgtatttttaatagagacagtgtttcaccttgttggtcaggctggtctcgaactcctgacctcaagcaatctacccaccttggcatcccaaagtgctgggattagaggcatgagccactacacccggctgcaaagccacagaattttagatttcaaaggaaccttggagactacttagtctaactgtcccttttaaagaaaaatagaatgttcttgattttagaaaactagataaaaatatttttaattcggaatagaacactacagataaagctggcaactttctcccaatccaagaaaccttcttgtgccttcattttccccccaaaggtaaaaagtgttattggtttctgaattttcttacagaacattttgatacttctacatatgtgaaaatatgtagtattatttttgtgtgttttaatttgtttcaaagatatcatacagtatgcatcttgctttcttcattcatcgttttgagatctagatcattccttttaactgcagttcagtattccactgtgtgaaagcatcacattttctttatccaattctctcttgattcatatttacaaatctgctttatggagagagaactgcatagagaagttgcaggattgcctcaagataagctttggtacaactaaaactagaatctacatctaagatgagaggcagatgaatagatgaatttctcaaaagttatcttgaatgagttaggctcattcatgaaagtcttaattggtccaatatgaagttgaaaccttggctttaagagtgtgaaaattctgaacattcttacttcctagagtgggcgagccaaaaaactcataacccatggtcttatgtgctaaagatcttcaggggtcactcctgagaaagaaaatagctgtgacagagttacatttgtgaataagggaaagcatgctggaacactgtacactctaagaagcatcatgcctcagcccaaaatatttcctctaactttgctcatggggtctgaaaagcctttctttccaacttacagctttgaatcttgaaggtttttcatctgtaaattccctgagaattaaattgatattggccattaacagacacttgatagcttggtttactaggttgcttgctagaacaaagtcattatggaaaatgggtataggatatgcatccaggtacatcgtcaggatgaggcaaagggaacaagaaaggaagaaaatgaacatttattgattacctgctatgtgccaagcaacgttctaggaactttatacatatatttgcacaatgggattagtaatgctactttccatattaggaaacaagagttcagggagattaaataacttgcccaaagtttatttgttcattcatttcctcaataaaattttttccagctacttttgctctatgccggaatctgtgctcagtgaggaaatattttggtgaatatgagacaacaagttttgtcttcatggaattaaaatcaaagaaaatatgtaccatgagcaagccaagataagcatggtaaaggacattggacagtaggcaaatcatatgcaccttgaggtctcatttatttagcgaatatatattgaatacttactacattcaggcaatgagcctgaccctttaggggaatataaaaatgaataagatgctccatactcctaagaatgcttagggtataacatgttcactcaatatttgaataccagcctaaaatctttacgttcaagttcaagtgacaactcatgtttccaagctatttgtcttgtcaggtacaagggtaaatttgtgtcaagcagaggaagaagaaaggaagggtgaaataggtacaaaatgactaaatatcagctaccatctccattaaactggagtgctctataaaagattgcaatcaatagagctagggacaagacagtttttttcaccaactgactgacaggcatatggcacctaattgatataaggtgtcagcaggttcttgttctctgactgtaagtaaaatgacaaaggggttgccagtgtgtctagatatgaggtgttttatttttcctaagatccagagcaaagagaagcatctgctttagaggtagaaaccctgcctaccaccaggataaacttatcagaagccaaatacttgttctccatccagtggtgttctggtaaatgtttaacaaccagatctccagaaaaaatatctatttgctgctttatattgctatacataaatcgtggtggttaattttatgtgtcaacttgactgggccgtgggatgcccagatatttggtcaaacattattctatgtgtttccataaggatatttctggatgacattaacaattgaattggcagaatgagtaaagtagagtgccctctccagtatgggtggccttcattcaatcatttgaaggcctgtatagatcaaaatggcttaccctcccataagcctcccatgagtaagagggggctcctcttgcctgactatttgaactgcaacatcagtcttttctggacttcagactattgttgacgaatggataaggaaattgtggtgtacatatacaatcgaatattattcagcattaaaaagggagatcctgtcaattgcgacaacatggagaacctagaggacattatgctaagtgaaataaaccagacagagaaagaaaaacactgcatgatctgacttatatgtggaatctaaaaaaaaaagttgaatgaatagaaacagttgttggggtgtggggagatgaaggtcaaaaggtacaaaggtgtggttatataggatgaataaatctagagatctaatgtgtagcatggggtctatagttactatagttaataatattgtattgtgtactggaaatttgttaagagaataggttttaggtactcttactacaaaaaaaataaagaagaaagaaaaagaaaggtaattatatgagatgactgttatgttaatttgcttaaaagtaacaattgcctcactatgtatacgtatatcaaaatatcatgttgcacagcttacattatacaataaaaaagtcttaatctaaaaagacactaatgactttattttcagtagtaaagagagcactgatggtccatggtgtgatctggcaatagataaaagcaaaatatcatattgaatactcctaatcaaccacttataagaaacaaagatctggatgatttgtatatgatacacccaaacatttttttgcaaaccaacaaatgtaatgagattgtctggctgctcctgatgttgctagatacaatagagaaagaaaagaatgagctcagggattcaaattcccaggtcaagtgccacataaatgatctgaaagcttctatatgtgccctgaaggagacctttatctcctgtatccataggactgagattgctgaaaatcaaatccagagtttcaacctgaaactggctgaattacaatgaaagttaaacttccagctttgtagattgtctactgataaagtgaaggcatttattgggaagagatgaggtcctgaattttggagtggggatatgtgggaagcccataacgaagctagggacatagagctcctaaattatgacacttctttgccagttaagtaggcctctgtacccccagtggtagcgacttctctacccttgtctgagaggattaaccctgcattgcctgggaaaagtgtaacggcctcccctgaggcagttgctgtgcaggacaatgctgagtcttctcagaacttactcccaccactcctttttgcttctacactgataagtagattcaagccccagcaggcccctaaaagtgaggtacaaaccatgaggaggtatactatactccagaagaactatttgagttttctgtcaacagacagaaatccagggaacatatgtgggaatggatattaagaatttgggataatggtacctggaacataaagttgaatcaggccaaatttgtcgatatgggctcactaactagagattctgcatttaatgttgcagcttatggagttagaaaatactgtaattgtttgggtgaatagctgaaagaaggaccaaaaggcctccagtggcaaattgaaaatgccagacctaccttagtttgatgtagagtttaatgtagaggaaagattcaaaagtttagagattgggatgtttcagtggatttgtcatttaaggtcttctcatttatccttgaaaggtccagaagacatatcattcacataaatttgtgaggggagtctcagcattcttgaagaattctgtggttgctcttctctgtaggccagaccttacagtgaaaactgcagtgactgaattgggaaacctaaatgctatgggagtacctagattctggtgtggcaggggccaagtgcagcactcaactgccaaagacaaggtgggcatggttaccataagggacaacagagtcaaagcagcatcagaatgatctgacttgtgcagacctatggtattaactacttaatcacggagtccctaaaagtgaagtagttaggaagcctactaaattcttacttaatctggatgagcagaaaatttctaggtaaagtgagccaaagtctaacctgaatcataaaaacagatagtcaatcaattttctgactttagccagtttacctacccagaaccccttgaatgaaggggaaaccaggtctcctagaggaaggaccctgatacactgaaaaaatttattctgttaatctttatcccagccttccccaatggggcctatgaccttttaccaaggtaattgtgcatttgggggaaagaaaataatcagatatttgagggactacaagacactggctctgaagtgaaaataattccaaaatatcaatgtggtccactagtcacagtagggggttatggaggtcaggtgatcaaagaagttttagctcagatctgtctcacagttggtctagtgtgtcttcaaacccatcttgtgtttatttttccagctccagaatgcataattggaatagatatactcaacagctggcagaattatcacagtggcttccagacctatagagtgtgagccattacggtggaaaaggccaagtgaataccactagaattgcctctacttcagaaaatagtaaaccaaaagtaatagcacattcctggcaagattgcagagattagtgccaccattaagcacttgaaaaatggtgatggtgattcccaccatatcctctttcagcttgcccatttggcctatgcagaagacagatggatcttcatatgacagtgtattactgtaaacctcttgcagctgctgtactagatatagtgtcattgtttaagcaaattaacacatcccttgatatatacatagtataaatgtattagtctggcatatgtctttttctccatccctgtacataaggcccaccagaagcagttcgcttttatctggcaaggccagcaatacaacttcttggtccaacttcagagtatatcaactgttcacccctatgtcataatatagttcagagggattttgatcacttttcccttccacgagctatcacactaattcattacattgatgatattctgctgcttggacccagtgaacaaaaagtagcaactattctaggcttattggtaagacatttgtgtgccagagagtgggtaataaatctgacagaagttcaaggaccttccacctcagtaaaatttcttggagtccagtggtgtgaagcctttcaagatatcctttccaaggtgaaggataagttgctacatttggcctttcctacaatgaaagaagcacaatgctgagtggacctctttagattttgaagacaacatagttctcatttgagtgtgttactccatcttatttaccaagtgacctgtaaacctgctagttttgagtggggcccagaataagatccaggctgctgtgcaagcttctctgtcgcttgagctacatcacccagccgaaccaatgatgcttcaagtgtcagtagcagatacggaggttgtttggtgcctttggcagtcccctagaagtgaatcacagcgcaggcccttaggattttgccatcctctgtggttaactaatccccttttgagaaacagctcttagcccgctactgggccttagtagagactgaatgcttgaacatgggacagaaagttaccatgcaacctgagctgcacatcatgaacttggtgttttctgacacaccaagctataaagttgggggtcacttcatcatcaaataaaagtgatatatacgtgataaggcctgagcaggttctgaggacaaatgtaagttaaatgaagaagtggcccaaatatccatggttccctctcctgctacgccgtcttctgtctcccagcctgtacctatggccttatgaggagttctctattatcagttgacacaagaagggaagactcaggcctggtttacagacagtttgacacaatatacaggcaccacccaagagtaaacagctgccacattacagttcattttaggatgtcccttaaggagagtggtgaaggaaaatcctctcagtgggcagaatgttgagtagtgtacctagttgttcactagcttgaaaggagaaatggctggacatgagattatatactaattcatgagctatagccaatggtttggctggatggtcagggacttgaaaggaacatgattagaaaatttatgacagggaaatttgggaaagaaatatatggatagacctctctgaatgggcaaaaaagtgaagattttgttccccatgtaaatgctcaccaaagggttacctcaacagaggaagattttaataatcaagtggacagtatgatctgttctgtagatagcagtcaggctctttactcagccacttccatcatcaccaatgggtttatgaagaaagtggtcatgatggctgtgatggaggtaatcgatgggctcagcaacatggactcccactcaccaaggcgtacctggctacagtcactgctgagtgcccaatctgatagcagcagggaccaatacctcctgcaaaaactatcattcatggacttacagaatgctttatccaccatcatattattccacacagcattatttttgatcaaggaactcacttcacagcaaaagaggtatagcagtgagtccatggtcatggaattcactggtcttaccatattcttcactatcctaaagcagctggcttgaaagaacagtggaatggccttttcaagactcagttacagaatcaacttggtaacaatacttttaaggttagggcaggttcctccagaagggtctatatgctctgaatcagcatccaatatatgatgctgtgctcccatagccaagattcacagttccaaaaatctaggggtacaaatgagagtggaatcgctcattattacccctagtaacccactagcaagatttttgtttcctgctcccatgaccttatgccttgctgacctagaggccttagttccaaaggcaggaatgcttctaccagaagacataacaacaactccattgacttggaaattaagactgttgcccagccactttggtcccctcaagcatcttaatcagcaggcaaagaagggactcatggtgttggctggtgtgattgagcctgaataccaatggaaaattgaactactactccataatgaaggtaaggaagaatatgtctgaaacacaggagattccttagaggatctcttaatattaccatgccctgtgattaaggtcagtgaaaaactataacccaatccaggcaggatgcttaatggcccagaaccttcaggaataaaggtttcagttatcccaccagataaacaaccgtgaccagctgagatgcttgtgaaggcaaagggaacacagaatgagtagtggaagaaggtagttataaatgctaactgtgaccacatggccagttacagaaattagaactataattatcatgcgtatttcttccttattttataacgaatattatattattccattctcacactgccataaaggactacctgagactgggtaatttatgactaaaagaggtttaattgactcacagttccgcaggctgtacagaagcatggctgaaaggcctcaggaaacttacaatcatggcagaaggtgaagaggaagcaagcatgtcttaccatggtgaagcaggaaagagagagcaagagcgaggggggaagtaccacactttaaaaccatcagatcttgtgataactcacttactatcatgagaacatcatgggagaaatttgcccccatgaaccaatcacctcccacctggtccctcccctgacatgtggggattacaattcggcatgagatttgggctggcacacagagccaaaccatatctaataagtttgtgtttatatatattaagcaaccatctttgtattatttccttttttattcctttatcatgaaatataaaatgtattaactttacatcgtggtaattaagttgtgagacatcaaggcaaagagtaaacatcactcaaggattttacctcctcttctagaaaaggggttagtgaattttcagttgtacacaggacagttgcatcatgttaggctgaattatgaccttgttattgtttttatttggggatgaagtgtggtttaatgagatgtgtttaggtgccaaattgacaaatggtggacatgtgatgcttaattttatgtctcaacttaactgggccatagggcgccaagatatttagtcagatgttattctgggtgtgtctgtgcaggtatttttggatgagcttgacctttgaattggtaaactgagtaaagcagattgcccctgttatgtgtgtggacctcaatccaatcagttgaaggcctaactagaataaaaatgctgactctcttatgagcaagtggggactcctcctgcctgaccacttgagctgggacatcagtcttttttttgcctttgaacttgaactgaaacatcagctttttaggggtctcaagcctgctggtttttgaactggaacatgcatcatcagctctcttggttctcaggcttttggaatcagactagaactacaccatcagctctcctgggtctccagcttgctgactgcagatcttgggatttctcagcttccataattccatgagccaattatttataataaatctctctcatatatacatatacggatatatacatacatacacatagatagtcttctctgtatatacatatacatataaatttatgtattagagttctccagaccaacaggatgtgtgtgtgtgtgtgtgtgtatatatatatatacatatatataatatatatatatattagtcacagtcttcaggctaatgggatgtgtatctctgactaatacatagatatattgcagattttattgatataaatgatgtgtagcacacaatttagaaataataatgaaatatacaatactctattgtaaattccatatagcctattgaatctcacaaaatgctttcaatgacttttgctgaagcttgtatccttagctgggctatgtttgtaattgatgaaggagtcaagttttgatatgaacattggttgatatttttatttaagttaatgagtgaaactaaaatgaaaaaacaatgatgtatgttgaaattttattcatccatcaatgacatgaatgaattcattgattaatctgaattcaaatactaaaagaatatttcctcaatttttgtgcaatttacaattttaataaggtatagaacatataagaaactgcacataaagtgtaaaatttggtgggttttgacatatatcccattaaactcctgaaatcaccacaaatgaacatatctatcacactcaaaagtttcctcctgtcccttttgtaatgcctctgcatccccatcatccacaggcaaccattgatctttttctcactatagattcattttaattttcaagaatattgtataaatggaataataatgtgtatactctttttctcttgcttcattcactcaccatacttattttgaaatttatcaatattgtagcatgcattgacaatttattccattttactgctgaatagtattccattatatgaatacacctcaatttacttatccatttacctgttgaagaacaactggattgtttccagtttggggctattaaaaataaagccactatgaaaattcacgtacaatttttttgtatggacatatacattaacttttctgggataactacttagttatttttagactggatcatacggtacatgtatgcttacttttaaaagaaattgctaagctggtttacaaagatgtaccattttttcattccctctagcagtatatgagagttctagctccttcacattctcacccacgcttggtatggtcagtcattttaattttaggtttaacttaatagatgcataatggtgtcacattgtggatttaatttgtatttacctaaaaactagtgatgctgagcaacttctcatatgcctgttttccatttatatatcctttttggtgaagtatcttttcaaatattttgcccaacttaaaaaccagattatttgtttcaattttggggtgttttaagagtctttatatgttctgaatgagtcctttatcagattatgatttgcatatattttcccagtctgtaactcatgttttcattttctcaatagtgtctttagaacaacagataattttaattttgatggagtgtgattaatctttcctttcatctattatagattatacttttgatgttatatcgaagaaatcattgcttagctcgtggtcacaaagatttttcattatatcttattctagtcatttatgattttaggccttacacataggtctgtgatccattttgaattaagttttgcatatggtgtaaagtatggctcaaaggtccttattttcacatggaaatccaattgttccagcaccttttgttgaaaaagacccttctttatccacgaattgcctttacctttttcagacatcagttttgtatatatgtgtaggcatactactggactctttttttccattaatctatttgtctctcttgatgctactaccacatttcttgattgctatacctttatcaaaagtccaatgtgtacatctttcatttcttattatttccttctagcactagccaaaacatccagtataatactaaataaaagttgcaagagtggatatctttgctttgtttctgatcttaggtggaaagtattcattcttccataatgaagtatgatgttagctgcgggtcttttttaaacaactttattaagatataattgacatataaaaattatatatacttaaaacgtatgacttgatgttttgttataaatatacattgtgaaattattaccagctaattaactaattaatggtaacctttacatagttaccatttgtgtatgtctgttgagatataatttaagatccagcctcatagcaaacttcaagtatataatatagcattttttactattgtcaccatgttgtatattataactccagaacttattcatcttgtaagactgaaattggggctattaaaaataaagccactatgaaaattcaccaacaatttttttgtatggacatatacattaacttttctgggataactacttaggtacttttagactggctcatacggtacgtgtatgcttacttttaaaagaaattgctaaactggtttacaaagatgaaatgttgtaccctttgaccaacattacccaattcttccctcctccaactatccaactctcttcttccttgaatttgactatctcagattccacatattaaatgagatcatgtagtatttcaatttctgtgtcttgcttatttcacctagaatgatgttcatcagttccatccatgttgtcacaagtggcaagattttcttcttctttaagactaaataatatttaattatacacacacacattaaagttatttccatattttggctattgtgaataatgctgcaatgaacataggagtgaatattaactctttgtgatgctattttcaattcctttggctacatacacaaaagtgggattggtggatcttatggtagttctatttttaattttctgaggaactttcataatgttttccataatggctgcactaatttacattcccacaagagtgtacaaaaattcccctttctctacatcctcaccaacacttatattttgtttttttttgtaatagccatcttaacaggtgtgaggtggtatcttactggggttttcatttgcatttctctgatgattagagatgtttaacacctttgcatatgcctgttggccatctgcgtttcttcttttgagaagcgtctatttaggttctttgcccattttttaattgggttatttgtatttttggtattgagttgttatgagtttcttatatatgttggatactaaccacttatttgatacatagtttgccaatactttttcccattctgtgagttgcctttttgttttcttgattttttcctttgccaggcagaagctttttagttggtgtaataactcttgtctatttttgcttttgttgtctgtgctttcggagttacatcctaaaaattatagacaagatcaatgttaagaaggtttttccctatgttttcttctagcagttttgtagtttcacgtcttatgtttaaatctttatttaagttttgtgtacagtgtaagatatgaatttaatttcaatttttgcatttggatatccagttttcccaataccatttgttgaagagtctatcctttttccattttgcgtttttgacactccgaagatcagttgaccataaatgtgtgcgtttattttttggttatctgttctattctattgatcggtatgtctacttttatgctggtaccgtaatgttttaattactataatataacttagagtcaggaaatatgatgcctccagcttatccttttgcacaagactgctttggctgtttcaggtcttttgtagttccatacaaatattaggatttttttttctattttttaaaggccatttgggattttgataggaattgcattgaatctgtagatcactttgggtagtatggacattttgaaaatattaattattctagtccataaacttgggatctcatctcatttatttgtgtcttttctagatttcttcatcaatattttatgattttcagtgcatacgtcttacaactctttggttaagttaattcctaagtattttctttttgcttgttcttgtctctaatgtaaatgggatttttttttttaatttttcttctggataggtcattgttggtgtatagaaatgccactgatttttgtatgatgatgtatttttctacaactttactgacttatttattagtgctaacagttttttgtgtgtgaattctgtagggttttctacatacatgatcatattatctgcaaacaaataattttacttcttcctttccaattttcatgccttttatttctttttcttgcctaattgctctgggtagaactttcagtactacgttaaatagcagtggtgagcatgagaatccttaccttcttctggatcatatagaaaaagttttcagtttttccccattgattatgacgttagcctcgagtttttcacatacggtctttattgtgttaaggtaagctttttctatatttatttacttattttattatttatttattcagagacagggtctcactctgtcagtgagagtggcactccaggctggagttcagtggcacaaacatggctcactgcagcctcgatctcttaggctgaagtgattctcccatgttagccttccaagtagctgaaattacaagtgcacaccaccacacctgggtaatttttctattttttacagagacaaggttttgccacattgcccaagctaggctcgaactcctgggctcaagcaatcttcccacctcagcctcccaaagtgcaggggctataggtgtgagtcatcatgcccagcctccatattcattttgttgagttttatcatgaatagatggtgaatttcataaaaaaatttttctgtatctattgagatgatcatgcagcttttttattctgttaatatagtatacgacattgattaattttcatatgtatatgttgtattctcctttcttagggataaattctacttcatcatgtaacatgatttttttgttgttttttgttgttgttgttgttttgtttttcttttggagacggagtcttgctctgtcgcccaggctggagtgcagtggtgcaatctcggctcactgcaagctctgcctctccgctttgctccattctcctgcctcagcctcctgagtagctgggactacaggcgcacgccgccacgcccggctaatttttttcttttttgtatttttagtggagatggggtttcacagtgttagccaggatggtcccgatctcctgacctcgtgatccgccctcctcagcttcccaaaatgctgggattacaggcgtgagcccccacgcccggctgtaacatgatctttttagtctgtcggggggtgtggggctgggggagggatagcattaggagaaatacttaatgtaaatgacgagttgatgggtgcagcaaaccaacatggcacatgtatacctgtgtaacagacctgcacgttgtgcacatgtaccctagaacttaaagtaataatatataataataattatataatatggcacctatggaaatcatattagtcctccttccagggtttattgctattgctgtttgttattttgttgttgctgctgttttttttttttctatttagtgaatttcccggactaattttaaaaagtttgtgttctttattgtatacagtcactcaagtctctgctcaattatcttagtcgccagtgattggacagagatttatttaaatgccttgaactaataattctcccaccttttgctgacgtggagcaaccctcaattccctggcaagcagttaataattctgccttaatcttcatttcttgtttgtgcagagcatcaaggtcactcttacatgagtgattagggccttctcaggtgctttctgggcatagacacagccatacatttgtcccccacccttcagaatcccaggaaaatttcagagctctttaaagctccctgtaaacatctcattcccgatattttccttttaagttttttgtcatcctctattttgctccaactagtattatttcctcagggaactatagtgttaaacaattgccatggattttgtaaattattttaaaaacaatttttgtgggtacagacagtctacggatagggttttcctcactgacaaagccctggagtaaggtcaaaataaagacaagcttttcccgggattttccagacagctcatatagtcacagctctctggtgatgggtctttggggagctccaaacccattctgtcttctccagtggttactagcctgctgaattttccagttgctgtatttctgaagttgcacgttttcaaagctaccatcaagcaggagagtggattatcagactacagcaagtaaaaatgccacagtgctatctgttccaataaagatttaactgtttttcttgaataaatgcttcttagattgttgcaagtgtttggttaatttccagagttctgaaaagtcattttttttttcctagtgttctcattgcttttatgggggaacagattaatgttctccttaatacctatggaagaccctgtgcagatatttggggtactttctctgtacaactatctcttatccattaccctctcctgtgatctctagctaccttcaccagaagtccaccaggctctgcttcagttccctctccctgaaccatgacctggaaactctctcaaggtagcaagcttagaaaattatagaacccttctaccttgtttcccatcactcagagaccactgcttttcattggctagtgccctgtgtcctgaaaatcaccatataatatgttttattttattttttggttgtttcaagtaggagattaaatttagtccctgttactctattttagccagaagtataaatcccctccatgacacacttttaagtttaatatgcattattaatattttcctcatcacttctttaattctaaactgtcgacagaacagtaaatctagcactgatttatagcatttgccaacttatattgtatatatactcccgctatggccaatttcaagttaacaacatatgtaatatttctacaacatatgtaatacaatagatataaataacctcaggagcatagattctcctgtaaatgaagtaaaataaataggaaattactttgttttcattattactttgtttctaatgtaatttgtttaattgtaagttgaaataatttaatttttaataactatttaaaaacagcttacaaagtttctgaaaatttaacaatctgttcttgtgagatagtatgagccatctgtagtacactactgcttctgtctctagagattagaatcactgtggaaacatcactataagccagtatgcaaggagaagaattcatccacctagggatatgtgtgcatgctccctgctcaccaagggcattaagctaccctaacaaatataaaaagcaagcgtttcaccacttttttctctccagaggaaaaatattattctcagaattccaccattaaaaattcattactaaagatcttgaagtcttttcaatttctaagaatcctctattaaaatggcaaggtatttcctgtgagcagtaatactttaagccttttaatcggctaatacctttatggatggtacatagctaagtaagaacaaggccttgtgtcattagctcctaggctctgtgcttggcagaggcagtggaaatagatgtaggagggaaattaaaaagggaaagtagcaatactccaatttaaaagtgtctttttaattgactttcagaaagtcagtcccaatatatccatatataggactgagtttttacatactaagaaaatagctggtgcctcctcctatcttggcctgactacccactagcagtgaaggtcacatgagctgctaaccattttgtcttgctcatctccaggagaacattctaatgttggaggaaaaattgaaagaagaaaaagataagaagtccatctataaacctcaaaagtttaaaatatctttacaacagtagccatgccaaaatattaaaaagctagaaatgttcagcagtttatgtaagaaaaggaagcccataatgagaaacaagagaaaaatgaggaagaataattttctaaagacaagggggtttgtgaggaaattgtcacttttgatgagttcaagataatattttttctcaagatttaaaaattaaattagaaatgggtgatatttggcagcccattcataaatatgtagaatgtatacaacctttgaagaaggagggtgccacaagccagaccaagctcctctaaccacaatcagcaattcctgtacaaagctgttagacccacgcaccaagcacgcagtgcaaattcccagtcagctacactgagttcccaggggcagaacaatgctgacctttgcccctgtaaaaattttgtatcgctctctcttgtgcctcatactcacgtagtaaagttttcttcctacttcctaaccccaaaccctaggcaacctctcaatgcctactatgcgtggagtctattaatagtaatttagcctgcaaaactctagaaggaaatgagcagaattgacttgtccccatctacacagctgttggaatatgaataccgtcttcagatttctgaatttttctaaggcaagaagaaatctaaagtggggaaggtctctgtcactaaaaaggattgtaagcacggtccaacttggtaaagggcccaaggaaagaatcatctctggagcttaaaaggaacatggtggcagaagggcaagagatgcaagacagggtaattgtaacctgaggcagtgggagaggcagaacactgaaaggcagccaaagtttgcagccaagaaggacgcatttcatatcagtatttaatccatagaggaaggtagatgcgatgggtatctgggagaatagatagcatgagagaaggaggattgaattgagtcaggagatgaaaaacgtgttgagcagagctattatatgtgttagtgtgctcctttatttacatgggggctcagcacatatcgaagaactagattaaatgcttaaagaaattaaattaaacttacagcaatattttatagggcccatagagagcatcctgacttccaggtgatctttcctccagatttctgaagtactgaggttaagttatgaatgatagaatcataagcaatcattaacaggcaatagagagaccctgggaatagtcttaatttttggaagggacacaagggaagaaaacctcttataacaacatactcctcagagtttctattagaggaaagatcttgggctggtttcccttaagatggaaatcacaatgatcaggattcattaagatgcctttgagcagtatgactgttatttctgggaaacagcactcaagaggctacagtcacagacctcaagatatcagagcaactccatctctgagttgagatgtactaccttctgagtacaggtttacaatccaaacttggattgcccccgccccagtgtcaaaaggaattgagattctatctggattatctagtttatttcatctataaaacagcctaaactgataactgaatctcaaacttcatttcttttagtctgaatcatcctgtttgcctgtcttcatagtataaacaaatagctaactgataaatgtgccctcctttggtgctgtatctaacccaatagtctctaagtaccataattgttggtaatactttgcaaacttttatcgtgttaataaataattgatgttagggctgacatcgataacaatcaccttgtctatcgccctcatttttcagaaaaggaaatgaagacataaagaagcggtaatgtggccgggcgcggtgactcacgcctgtaatcccagcactttgggaggccgaggcgggcggatcacgaggtcaggagatcgagaccatcctggctaacacggtgaaaccccgtctctactaaaaatacaaaaaaattagccaggcgtggtggtgggcgcctgtagtcccagctaatcgggagctggggaggctgaggcaggagaatggtgtgaacccaggaggcggagcttgcagtgagccgagatcgcgccactgcactccagcctgggcgacagagcaaggctctgtcaaaaaaaaaaaaaacggtaatgtgacttgcctgagttcacgcttcaagttagtggcagagctgggactacaatccacgtctcctaattcccaggacactatttttaaactgcaccaatttacaaatagaggtacataccattgctttcagaaatgttccctgataagtttttctctttcattttgaagctgttctattgtaacattttaagtcttaatgttttatgtgggggcaggcaggaatgtgcagaattaaccactttgcaggaaacatgaccttgtacaaaagtaaaactctctgagtaacaataagcttgacctggttttagagcacccgatatgcaaaatgagaaatttataagataatcgcactgaaggtgattgcagtataagggagtactcagcagaacttcttgagtgcatttaagcatttaagatcattatttggcagaactctctggggccgagaaacaaagttaaaacgttaaaagttactgccaaatgaaaaccaaaaaagcaaattaagcatctttgaagaataatagaagtcatgaagaaatagaatctatttgacaggaactcagattctcctggaaatatcagggccctagtcatcagccttaatgaatggcctttctcagtcacacagatagcagcactgtaactcctccagtcaccagggcttaaacttggatattatttgaaggttcctcctatgcctcattctctagagtttattcactaacaaggcttgttttatcttcctttgaaataactctaaaattctcgtcttctccattcagactgccaccattctagatagaatctataaacgtatgacacagtcccattctcccctactctggttcaccattgacacagccataggagtcaccatataacatacagctttcttgatcacttctttaagaacctagagtgtctcttcaatgcctataagatcaagtcacagcttctcaaccagatgttcatcaccctccaacaagtaggcccagcttacttactcctacattcttccctctctttctaaatattgccctatccaaaacagtaccaattctcacccctgacttccacccctaccccacatataataaaagttttctcctagctcctacatctgtctatctatatcctacccagcctttaaaaatcagctcaagttctacctcttccatatacctttcctaaccaccacccaataacttcagctaacactgatctttacaatttcatttagtgctagcaatgctatagacactgatatcctccatgtatttttataattggaaaaaaatagcaggtaaaatttggaactcatttaacaaagtcctgccctgaaacagaaggatggtcaaatgtttatacaagcatacctcggaggtattgagggttcagttctagaccactgcaataaagtgaatgttgcaagtcaaatattttcatctcccaatgcatataaaatttatgtttacactatactatagcctattaagtatgcaataacattatgttaaaaaacaatatacaaaccttaattttaaaatactgtattgctaaaaaatgttaacgattatctgagttttcagcaagtcataatctttttgctggtggagggtcctgccacaatgttgatgactgctgactgatcaggctgactgataagggtgggggttgctgaaggttgaagtggctgtggcaattttttttgttttgttttgttatttatttattttttttgttgtttttattttattttattttattttattttattttattttattttattttattatactttaagttttagggtacatgtgcgcaatgtgcaggtttgttacatatgtatacatgtgccatgttggtgtgttgcacccattaactcatcatttagcattaggtatatctccaaatgctatccctcccccctccccccaccccacaacagtccccagagtgtgatgtttcccttcctgtgtccacgtgttctcattgttcagttcccacctatgagtcagaacatgcagtgtttggttttttgtccttgcgatagtttgctgagaatgatggtttccagtttcatccatgtccctacaaaggacatgaactcatcattttttatggctgcatagtattccatggggtatatgtgccacattttcttaatccagtctatcgttgttggacatttgggttggttccaagtctttgctattgtgaatagtgccgcaataaacatacgtatgcatgtgtctttatagcagcatgatttataatcctttgggtatatacccagtaatgggatggctgggtcaaatggtatttctagttctagatccctgaggaattgccacaccgacttccacaatggttgaactagtttacagtcccaccaacagtgtaaaagtgttcctatttctccacatgctttccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggtttttttgtttttttcttgtaaatttgtttgagtttattgtagattctggatatgagccctttgtcagaggagtaggttgaaaaaattttctcccattctgtaggttgcctgttcactctgatggtggtttcttttgctgtgcagaagctctttagtttaattagatcccatttgtcaattttggctttggttgccattgcttttggtgttttagacatgaagtccttgcccatgcctatgtcctgaatggtattgcctaggttttcttctagggttgttatggttttagggctaacatttaagtctttaatacatcctgaattaatttttgtataaggtgtaaggaagggatccagtttcagctttctacatatggctagccagttttcccagcaccatttattaaatagggaatcctttccccattgcttgtttttctcaggtttgtcaaagatcagatggttgtagatatgtggcattatttctgagggctctgttctgttccattgatctgtatctctgttttggtaccagtaccatgctgttttgattactgtagccttgtagtatagtttgaagtcaggaagtgtgatgctttgttcttttggcttaggattgacttggccatgcgggctcttttttggtcgctatgaactttaaagtagtttttttccagttctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattccttggtattttattctctttgtagcaattgtgaatgggagttcactcatgatttggctctctgtttgtctgttattggtttataagaatgcttgtgatttttgtacactgattttgtatcctgagactttgctgaagttgcttatcagtgtaaggagattttgggctgagatgatggggttttctagatatacaatcatgtcatctgcaaacagggacaatttgacttcctcttttcctaattgaataccctttatttccttctcctgcctaattgccctagccagaacttccaacactatgttgaataggagtggtgagagaggcatccctgtcttgtgccagttttgaaagggaatgcttccagtttttgcccattcagtatgatattggctgcgggtttgtcacagatagctcttattattttgagatacgtcccatcaatacctaatttattgagagtttttagcatgaagagttgttgaattttgtcaaaagccttttctgcatctattgagataatcatgtggtttttgtctttggttctgtttatatgctggattacatttattgatttgcatatgttgaaccagccttgcatcccagagatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggattccctctttttcgattgattggtatagtttcagaaggaatggtaccagttcctccttgtatctctggtagaattcggctgtgaatccatctggtcctggactctttttggttggtaagctattgattattgccacaatttcagatcctgttattggtctattcagaggttcaacttcttcctggtttagtcttgggagggtgtatgtgttgaggaatttatccatttcttctagattttctagtttagttgcgtagaggtgtttgtagtattctctgatggtagtttgtatttctttgggatcggtggtgatatcccctttatcattttttattgcatctatttgattcttctctcttttcttctttattagtcttgctagcagtctatcaattttgttgatcttttcaaaacaccagctcctggattcattaattttttgaagggttttttgtgtctctatttccttcagttctgctctgattttagttacttcttgccttctgctagcttttgaatgtgtttgctcttgcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggattcaaagaacatctttatttctgccttcatttcgttatgtacccagtagtcattcaggagcaggttgttcagtttccatgtagttgagtggttttgaatgagtttcttaatcctgagttctagtttgattgcactgtagtctgagagacagtttgttataatttctattcttttacatttgcggaggagtgcttcacttccaactatgtggtcaactttggaataggtgtggtgtggtgctgaaaaaaatgtatattctgttgatttggggtggagagttctgtagatgtctattaggtccacttggtgcagagctgagttcaattccttgatatactttttaactttctgtctcgttgatctgtctaatgttgacagtggggtgttaaagtctcccatttttattgtgtgggagtctaagtctctttgttggtcactaaggacttgctttatgaatttgggtgctcctgtattgggtgcatatatatttaggatagttagctcttcttgttgaattgatctctttaccattatgtaatggccttctttgtctctttgatctttgttgttttaaagtctgttttatcagagactaggattgcaacccctgcctttttttgtttttcatttgcttggtagaccttcctccatccctttattttgagcctatgtgtgtctctgcacgtgagatgggtttcctgaatacagcacgctgatgggtcttgactctttatccaatttgccagtttgtgtcttttaactggagcatttagcccatttacatttaaagttaatattgttatgtgtgaatttggtcctgtcattttgatgttagcgggttattttgctcgttagttgatgcagtttcttcctagccttgatggtctttacattttagcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagggtgttgaatattggcccccactctcttctggcttgtagagtttctgccaagagatccgctgttagtctgatgagcttccctttgtgggtaaccccacctttctctctcgctgcccttaacattttttccttcatttcaactttggtgaatctgacaattatgtgccttggagttgctcttctcgaggagtatctttgtggcgttctctgtatttcctgaatctgaatgttggcctgccttgctagattggggaaactctcctggataatatcctgaagagtgttttccaacttggttccattctccctgttactttcaggtataccaatcagacgtagatttggtcttttcacatagtcccatatttcttggaggctttgttcatttctttctattcttttttctctaaccttcccttctcgcttcatttcattcatttcgtcttccatcactgataccctttcttccagttgatcgcatcagctcctgaggcttctgcattcttcacgtagttctcgagccttggctttcagctccatcagctcttttaaggacttctctgcattggttattctaggtatccattcgtctaattttttttcaaagttcttaacttctttgctattggtttgaatttcctcctgtagctcggagtagtttgatcgtctgaagccttcctctctcaactcgtcaaagtcattctccgtccagctttgttccattgctggtgaggagctgcgttcctttggaggaggagaggtgctctggtttttagagtttccagtttttctcctctgttttttccccatctttgtggttttatcttcttttggtctttgatgatgttgacgtatagatgtgtttttggtgtggatgtcctttctgtttgttagttttccttctaacagacaggtccctcagctgcagctctgttggagtttgctagaggtccactccagaccctatttgcctgggtatcagcagcggtggctgtagaacagcggatattggtgaaccgcaaatgctgctgcctgattgttcctctggaagttttgtctcagaagagtacccggccgtgtgaggtgtcagtctgtccctactggggggtgcctcccagttaggcttgtcaggtgtcagggacccacttgaggaggcagtctgctcgttctcagatctccagctgcgtgctgggagaaccactactctcttcaaagctgtcagacagggacatttaagtctgcagaggttactgctgtctttttgtttgtctgtgccctgcccccagaggtggagcctacagaggcaggaaggcctccttgagctgtggtgggctccacccagttcgagcttcccggctgctttgtttacctaatcaagcctgggcaatggcaggcgcccctcccccagcctcactgccaccttgcagtttgatctcaaatggctgtgctagcaatcagcaagactctgtgggcgtaggaccctctgagccatgtgcgggatataatctcctggtgtgccattttttaagcctgttgaaaagcgcagtattagggtgggagtgacccgattttccaggtgccatctgtcacccctttctttgactaggaaagggaactccctgaccccttgcgctgtccgagtgaggcaatgcctcgccctgcttcggctcgcacatggtacgctgcacccactgttctgctcccactgtctggcactccttagtgagatcaacccggtacctcagatggaaatgcagaaatcacccatcttctgcatcactcacattgggagctgtagactggagctgttcctattcggccatcttggctccacccccggcaatttcttaaaataagacaacaattaagtttgccacatcgattgactcttcctttcataaaagatttctctgtagcatgagatgctgtttgataacattttacctgcagtaaaacttctttcagttttggaatcaatcttctcaaaccctgccactgttttatcaactaagtttatgtaatatgctaaatctgttagtgtcatttcaacaatgtttcacagcctcttcaacaggaatatattccatctcaagaaaccactttatttgcttatccataagaagcaactcttcatgcgttaaagttttatgagattgcagcaattcagtcacatcttcaggctccacttcgaattctggttctcttgtagttttaccacatctgcaggccatcatttgaagggttcctcaatctttctttcccacaagatggaagtatcatctattggaacatcttaaatgtacttcattcatgacatatttttcatctattacagaatcagagaatcttaagactatatgagaggggaagggactttggatcataaatcatacattgtacatgaagaaactgaggttcacttctgtttcctgggatttctttttttaattttatttagatttggggatacatgtgcttgtttgttacatgggtactggtggggaatgggcttctagtgtacccattatccaaatagtgaaccctacctgatagatattttttcaaccctcattccccttctatcatccccatttctggagtcccagtgtctattatttccatctttatgttcatgtgtgtccactgtttagttcccaattagaaatgagaacatgtggtattggttttctgtttctgagttagttcacttaggataatggcctccagctccctccatgttgctgcaaaggacatgatttctttctttttatgtctacatactattccacatttttttaaatccagtcaactgttgattgtttcctgggatttctgatatgttttcattccccttagaaagccactgctgttaaatcaataaaataatttaggaagaagttcagcagtatgtgttgagagctttaaaaatgctgccaggttttggtccagtaatttgacttctaggaagctatactgagcaaataacctggatatatgtgaagatctttatgtacagaaatatctctctcagcttcatttacaataatatagatcaatgaaagaaatcttaaatattcccaagcttgagactagttaaatacattgtagtatacctgacatgaccgaatgaaacattatgtagccattttagtagagtattttaacacagaatggtagaaagcatactatctcaatctcacctgtcagagctacttccccacaagagaaattggtggtgggaagggcagtatatgcaaagagtgttattacagataattatgtatgaaaaattcctacacaatattaagtaaagaaaactgggtagaaaaatgtgtattaaggatgagttaatttaaaaatgcataggggaagaagactggaaagatttattttaagccatatagttttattttatgtattcatgatttgctggtttaagtaattttttgcaatttttgttttgaaataatttcagacacatagaaaaattacaaaaatagtaaaaagaactcccatgtacctttcatccagattccctaactgttatcatttaaaaacaattttgtaggccgggcacgttggctgacgcctgtaatcccagcactttgggaggccaaggcagacagatcacgagatcaggagtttgagaccagccttgccaatatggtgaaacctcgtctgcactaaaaatacaaaacttagccgggcatagtagtgcatgcctgtagtcccaactactcgggaggttgaggcagaagaatcacttgaacctgggagatggaggttgtagtgagccgagatcgcaccactgcactgggcaacagagtgagactctgtctcaaaaataataataataataattaattaattaaataataaaataaaacaattttgtaaagtagtccctttgtcccatttaaggaagtttggccaataagctcctgtgtgaacattgtcatattacattccaaagtaaaggggcaacggaaatgggacaggctcatttctgatggcctgtgggatctgggattaaagacaatccaagactagtaatgaaatgcaagacttttaacgaattacgctgcttattatttgctgtttcagtgtgtttccattctgcttttaccttgactacttcaaagaatatcacgcagacaaagtgataatgagtgttgagcaacagatttaaaatcccccatgcagctgaatgacttaagggaaacaaatatataactttttacttatgtcttcacctcagtgaaaataaaatatattgatttcatccagatgtcagtggttatacaaacctcccctggacattggagagaaggagaggaaaaagcttacaaaaataaaatcacacgtgtttatagccatgaaaatacattattcaaatgaaagtactgacattttaacataggcactgcatttttaaccttaaaattgaaagagtcccctgtattatagtccttttagagtcagaagagaaatttgggtcatttggcactatccaataaaactttccacaatgatgaaaatgttttatgtctatactttccagtacagtaaccgtgagccacatgtagctattgagtgcttaaaatgtggatgatgcaactgaggaattgaatttatttcattttaatttatttaaatttaaatagccacttgtggctagtggctactgtactagacagcgtgctagactaccatcctaagtagaaatttcttttccagttcccctgatctctttgcattctccctcgtgatcatatcaattcctaacagctccagttaccacttataatatgatacatcatcctggctgcatgttaggttcacctggggagctattttaaaatgtcattgtggagaggaggggtgacctaagcatggatatttgtaaaagggtatttaatatgtagccagggttgagaacctttgatcaatatgcaatgattcccaattttatattactagctctcaatgataagcttcagatgctgactggatctcctcctgatgtcccccaccccaaagaaagcctcaaacaccaacatatccaaatgtgacatgattatgtcccatcgccctcacccaaatcctttgaattgtaactactggacttgcttctgccattttgccatttgttttctatatgtcatatattttttgttcttcaattccttcattaataccttcttttgtgtttgactttttgtagtgtatcattttaattcacttctcatttcctattctagctatttcttagttattttcttagtagctaccatggaggttaaaattaacatcttaaatatatagcaaactggcttgaattaataacatagcttaaatagtataaataactctgttcctatgcagctctcttttcctttatgttgttattgtcacaacttttttatatcatatgtgtccactaacatagattcataattttggtttcatgcatttgtcttttaaatcatgtagaaaaaaatagggcttacaaaccaaaagtacaataatactggcttttaaatttagctatgcagttacatttatcagcgttctttatttcttcatatggcttcaaattgcaatccaatctcaaggactccctttagcatctattgttggacaggtcagtaaacaacaaacttcctcagcttttgtctaagaatgtcttacttttgccttcattttagaagaatcattttgcaggatatagaactcttgattgaagatattttatttcttttagcgcttatcatctactgaatttggatctctgtgtgtggtttctgaagagaaattggatgttaattttattgagcatcacttgtatgtaacaagtcacttccctcactgatttcaagattctctgtctttggcttttgacagtttgattgtagtgtgtatcagtgggaatttctttcagtttttccttcttggaggtctttgaatttctcggatttgtagattcacaaaaggcaatcacttttgcaccaacctaataacttagccttagactaattaagactcagtccttgaggtgaaggaggggcttcttgcccgagcccatgactgcgtggggatgtggttaatctcacaaacaaaagcagggctctgccaacagagcattctcccatctctatccccaccattctttcatggaataattcaatacatatttattgggagcttactatgtgccaggtactgggaataaaatagtgaacatgactgatgaggttctggctattatggagtttacatttgggttgggagagccaaatgttaaaatagtgaacaaataaaaatgtagtcaattcaaataattataagttcttgaagaacttaccttgaaaaaaatgtagatggaaatgaagctaggatagtgagatgtagaatgacatgtgtggggcttgaaagcgtggtcttgaaaggcttcactgaagagaggacatttgttctgaaactatacaataggaaggaaaatgtgcagctttatggaagaggactaaagtgtaaggacccctatgtgatcacatgtttgacaggtttaaagagcagatagaaggccagtgtgttcttaaataccattgtgttttatatacccacatctgagcacatgctgtgtctacaatctagaaagaccatccctagatcattgctatgtaggaaactcttatcaacccttcaagacacagctcagatattacttcctctgtgatgccttcccttatctctaacacttaaagttgaatacttccttctttgtatccatactatcaattagaatatctatcaccctgcactatgtttaacttatttacatttttgtctccccctctggacttggagttgcttgatggcaagggcaatgtcatttatatatgcatatttgtgttccctactaccaagtgctctgggcgtgacaaatagtagatgcacagcaagcacttattgaactgaaacactgaatatctactattgctggcactctcatagattttgtggagcatacaaaagaatctgccttcattgaagtagtcaggaatgtagactctggtgccagaagcttgactccaatcccattcccaccacttactagctgcgtgaccttaaaaaattacttaacctctctgtgcttcaggttccttatctgtaaggtgggagataacagtggtaactgtctaaaagtgagtattaatttaaataatgtatacaaaacatttagcacacacagtatccggcacagaataagtgttgagtcttaccttatttataaattaaggaaataattagattgacaagatttatacacatgaaaaacaaactactgcaaatatattactatacagaactgtttaaagtacctcctgaaccaagatgttgcagcactatcacctcaacaaagcattgctgaatgaatgaatggactaaaaaacaaaaagccacagtataatctgtgctgatctgaccatttctagagcactatgttcacttctgaacattacactttaagagaaacaaagtactttataactagaagcagaccagtaggatgctccaaaatctggaaagtatctaataagaatgactgaagaaactgagaatggttaggtagaggactacattactgctgacattaaacatttgaaagttgtcatgtgtaataaaggggagctttgcttgatgctgctctagagagcagaacttgggccaggggataaaggttataggcaggtgatttcagctgaacataggagagtatttgctgaaagtcagtgttcaccacgcaggtgaggaagtggtgagttttccatctgtggaggtgctgattaaccgaacaaccacttaacaaggatactgtcaaggggactttttcattgggctgggggttattctagatggactttggagttctttgcaggaggttcaagatctggacctttcagggaaagaatagtgtcactacattaaaattagttctcaaagtgataatctcaagccaaaatgctctcaaaatcaacaaccccataactttcccacgaccagcccacccctgtgcttttatacaagaaatttccactataggcactttttggactgctcattcaaggtccctgttcaaatattattttttttcctaggagaagtatggttttaagccactcagccattatcatcagcttctattatagtgcccggtatatattaagaattatttattcaatgtgttaccagtcattcacacctgagatcgtacaaatttatcagattaaatttacttgccttagaaaggccctggagagataaacaactggacagataagtttggaaaattgtgagaggtcacaagggttttaccatttaagcttcagtcttcatgacacgtggtgcaagccatgcacagataccacgacactctgaaggcactgatgttttcttagttaggtagaaagccagcctttcctcctcacagatgaagtcttatgctgggcagaaatctgggctgggatttgccaaagccattttgtgccctggccttctgccaagtccatcgatttagctctttgaatcgcatcatttaagcccacaaatgtcacagattctattagacaaacgcctctggccagcagcaaagaaaagagggaacatgataagccctctgaggcagcctgttagacaattcttaatctttcatggttggagaactacattgcgagcgggttcactggcagaatggcaagaaatactggcaggttttgtttctttggttaagaatatacctagaggcttagctttggttaatggcagattagtgcatctgccaagtataaaggtaaagggtcatggggaaaaaccttccaaataatacattcttaaaagataccagaaactccatcactagttacttattctcagaataatggcagagtaggcctaacagcaagcatgcagagaaaggattggcctctgagcctggagtgaggctgaggctaaagctatgagtgagggtcaagtggctgcagctgtgggggattggaaaagggcaaagaattaggcaagtcattagacagctatgtgagtctgcatgtcaacagacaatgcaggaaatccatttttgcattattctttattcgtagtatagagctgggcataactatttaacagagttttccaaggctggataccagacctctcctttaccctccatcacttcacccgcattcttttagccagacattgctttaattccaaagtcacagcaacgttcctaatgagggaattcatgttaatatattactagtttttagccatgtgatttattatttcatccaggggtagttttggcaatgtagtcccttaaagcaagagtgactctaatggtaaaatctcaggcaaacctttgtagatttattttttctaaagaggaatactattgaagcctcttacaacagagcccactggaaaattacatagaccagactaattccaaatgcaagagatgaaaattaaaactggactttgaactgactatatatcatccgattatacttgcctcaagttacaaattaccatgattttactgttgtctctcttcactactttaacccatgcatctggcacatagtgagagttcaatgaatggtactgcttgttgccttcattatgattaccattagaggcagtggtagtaatagtgccactccagtacctggcaccatgcctgagccacattaagtattcaaaactaatgattatttttataactttattgccccagcttctggcacagtgcctggcacataataggacaccgattgagttagtttccttcattctcacctttccctgggatacaatattcttctgcttccccccacaactgtgccttactaaaggggttgcagatcttcctgtagcagtaatgcttcctataccagtaacaccaccagtgacaccatctgaaaggacatctagccttttcttccatggtagcctcttaaatggcaaatgggcagcaagtgttcaagaccatttttcagatgaggataccaagattatgagctattgccttggaatgttagctcacctctaatccctatatcctattaagctgaaaaaataagaccccttgcattccccccaacccatcacccaactaggccataactgatctcatctttcttgttgcactcggcagtgcctggactgcccccacactttcatgtttaattcatcctccaaggattagcctaagagctaccatctttatgaaactttctgtgaggcctccagccttcaatgagcagggttgtattgtttcctatcccctagcaggggctagcagagtgctagacacaatagaggctctcagtgtgtttgtattgattaaataaatagaagctaattgggttgttggtcctcactttaggaggtcacactatcccttctctcccccactcatttttgtttacaaggtaaaggcacagaggcagtctacaattagtatcattaaagttttgtgctgtgtattggcaaatgcttactctaagtgctgtttgtttagccactttcactactttcactttacttgaaagtagtggaagaatgtatcagtgcttcttcaggcagtgaaacagcaccctcttctcttgggatttagatgtggagagagatttgtcatttgggtcttgaggcagtgaaacagcaccctgttctcttgggatttagatgtggagagaaatttgtcatttgggcctgctcagggcaagaggcaacactcatcttcaaatactaacttcccagaaagacacaagcacatgaattgcaaataccacttgatataaggtaggcctctccctctgccaaagcagggatgtcattacctggaagactgaggtaaatgttggtggaagcttcatgtctttatcttttcttacatccagaaggtgagaaaaggggctctttagcacatttccatgtcctttagctggcaaaacagttaagtaatgaaagacactggaataggtccatcctaactcagcctccagagtggcctggaggcctcagggatgaggggaaaagtggagccaacacctaatagatctgagcctcattttctcccttggagaagataatcattcccatctcacagggatgctacagggagttaatgaggaatgtgtataaattttacctgtaaactatgaggcaagagctctatactgcgattcattctatgtgattgaagacaaaggctatctttttacctttgtctcccagagacagtttaaacacattgtaggagctcaataactaggtttttactttaaaactaattctattaaatataacctggatttaggtatgatacaaataaaacagaccattcacttatcagaatttaatcatacagattctcagatctgttagcttttcatttgaaatggcagaggaaaaaatcatgagcaggcacagagggtacatgtttatcttttgcagttggctttggcctattggagtcaatacccctttccccattgagcagcagcaagaagcagggttgcagttagaactgaaataggatttcaatccaggatgtgcatgtgggacagttacaaatgtaatcctgaaaattagcataggaccagagacctagagcctgaaggaaattggccaaagaagatttccaactttgcatcactaatcagaagtgttaccatgaatattttcaggcaccagaagagaaggaaggtaggaattagcttatgccatgtcttaggaggtttaccctatgccagttgctttgataatgtatatcttatttaactctcacaatagctttatgaggtaggaattattgtgtagcacaggacctggcacacagtaagcagtcactaaatgataactgcgagtaatattattaagattgataaccttagtatcatcaaccttagtaataaataaagcacagagggcttgagtaacttactcaaggccacagaactggtaagtcataaaaccaggatttaagcccaggtcttcctgaccccaaagcctgggctttttctgttatacttctttgtaagcggaaaaaagacggcgtcattgaagtagtttaggattttctaaccccttagcagggctgcctccataactggccacttgagacctccacgtatctaaggatattttggtctttctctgtttcctcactcagatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtaagagaaattcctataggctgggaaatagccaggcacaacagggcaccaggtcagaagccctgaaactagggaaggttaggtggtctggaattgagatgccctatctcagaaattgcaccagtgatctcaggtagcatcctggagctaccctacgtggcccatgctgagttttactgatttaccttttccttattagtgtttgcccatatacattcagtactcactgaatgtacttagcaacccaatgatgtgttctttgtttccagactatttaagccccttctaactttcgtataccctgctttctatcttctgtttcctcctctactcaaaggttatattctagaaaaggagagacaaaatacagacttggtctttctacttctcattagcctctctctgaagacaacacaggaggcctttaaacttgagtgccatggtgcagatgcttatggaataaggcctcatatattttcccagtacctgtcaagtgacttcattccacttccaaatgtttgggattttgcctctgtgattctcatatcctccaaggcacctaggtttgatactctgaagtcatcttttatttgtctggctcccttgcccccatgtccaatccccgagtcctgtggttccttccttccaaatatctttcatatactttctctcctctctagttcgtctttcaccagtctggctctggttctcaacatctctctcttagatgagtggttcctaaagtgcggtcccttgactagcagcatcagcattacctgggtacttgttagaaatgcaaattctcaggcctctgccacagccctattgaatcagaaactctggggtggggccccaacaagccctccagaggattctcatgtacaatcaagtttgagaactgctgtcctagattaacataaagctcttctgactggtctccttgtctctagcatgttcccctctctcaaatcccgagcaataatatcccaagaataaggcattattctccctaaatagcattattctccctaaaataggatatgagcctgccattcctgtgcatccttttgcagcttcccttctgctgtctaaaggttcactaaaaatgaacttacaataggcagattaataggagaaaatggcatacaaaatttattaacatgcatatggacatggaaaccatacacaaagtttgaggctcaaagaaaagtcagatgtttgagacataaatactttcttcataagggagaaatgaatggacctgggaggcaaacattattttataaatgattatctttggactctggacggtgccaacaagttaagggaaagtgaggggtggaactatacaagaactaatgctgtcttttttgttcttaaatttccatagattattgcagagcaggtagtgtttggttacatgagtaagttctttagtggtgatctgtgagattttggtgcacccatcacctgagcagtatatactgcagcctatttgtagtcttttattcctctcccccttcccatccttgtcccctgagtccccagagtccattgtgtcattcttatgcctttgcatccttatagcttagctcccacttatgagtgagaacctatgatgtttgtttttccattcctgaattacttcacttaggaaaatggtctccagtctcatccaggttgctgcatatgccattaattaattcttttttttttttgagatggagtctcactctgtcacccaggctggagtgcagtggtgcgatctcggctcactgcaagctccacctcctgggttgatgccattctcctgcctcagcctcccgagtagctgggactacaggtgcctgccaccacgcctggctaatttttttgtatttgtagtagagacagggtttcactgtgttagccaggatgttcttgatctcctgacctcgtgatctgcccaccttggcctcccaaagtgctgggattacaggcgtgagccaccgcgcccagccaactcattcctttttatggctgagtagtattccattgtataaatatatatatatatatgccacagtttctttatccacttgttgattgatgggcatttgggttggttccacgtttttgcaattgtgaattgttctgcaataaatatgtgtgtgcaattatctttttcgtataatgacttcttttcccctgggtagatacccagtagtgggattgctggataaaatgatagttctacttttagttctttaaggaatctccacactgttttccatagtggttgtactagtttacattcccagcagcagcatagaagtgttccctgttcactgcatccacaccaacatctactattttttttattttttgattatggccattctagcaggagtgaggtggtatcgctctgtggttttgatttgcatttccctgatcatcagtgatgtcgagcattttttcatatgtttgttggccatttgtatatcttcttttgagaattgtctattcaggtccttagcccactttttgatgggattgtttttgttgttgttgttgatttgcttgagattttcattgtggattctggatattagtcctttgtcagatgtacagattgtgaagatttttttcccactctgtgggttgtttgttaactctgctgcctgttccttttgctgtgcaaaagctctttagtttaattaagttccagcaatttatctttgtttttattgcatttgcttttgggttcttggtcatgaaatctttgcctaagccaatacctagaagggtttttccaatgttatcttctagaatttttatagtttcaggtcttaggtttaagtccttaatccatcttgagttgatttttgtataacgtgagagatgaggatccagtttcattctcctacatgtggctagccaattatcccagcaccatttgttgaaaagggtgtccttcccccactttatgttttcttattatgcagataaagtcccttaggtaatctcttgcagctgtcatcagacaaatacatgaaaagtccatcgggtcatggtgatgactgcccatctcttctccatggttgatctttcttggttatttgattagatttctagggagggagtcttaagacaattgcatttcttttggaaagaagcttctttactcagataaggaagttacagagagtccctcagggtgtatccttaaaaaggatcagagagacagggaggtggacaaaggtcagaaagagagctcagttctgaggcttatttttgagacctttccactttttttcttttttttttttttggagttggagtctcactctgtcacccaggctggagtgcagtggcacaatctcggctcactgcaacctccgcctcctgggttcaagcaactctcctgcctcagcctcccgagcagctgggactagaggtgcacaccgccacgcctggctaattttttgtattttagtagagacaggatttcaacgtgttgcccaggctggtctcgaactcctgagctcaggcaatccgcccacctcagcctcccaaagtgctaggattacaggcatgagccactgcacccagcagcctttccatttttctaagcactcagcatgcttaagtgccatattttggggaattattttctgtaccccaacactttcaataactgtagttattagaaaagaaaccaatccgtgaagcttgcacctcaatgccctcaggcaatggtctttccagtcctgtattcccctagccccttctaaacacccctcaagtcagacaggtctctcttcactgtctctcttctttaggaacacagaattctgcacatagtagggacaaaaaaaaactaaatcatcaaaattggaatacctcaacactttccaaaaagtagaaatagtacataacaaaaccaaaattgcaaatgtcttagaaatagtaataatagaaacactcagcatcaaatctaatggcatatggccaaagctgagtctaaaggaaattcatagctttcatatttgcctaattaaacaaaaaagaatgaaaataaacttaattataactcacggactaagaattgtaataaatggagcagaaagcaaagacactatgtgataataaaagttccttgagtaaagggcctgaatccccctccaccatcagcattgaacacagtactaagagagcaggactttctctctcttgttcactgctgtattacatcactagaaaaattattggtacatcaccaacacttcataaatgtatatttaatgaatgagtaacatacaacccacactgtgctaagtatctgacatggcttatcccattcaatcctcttagcaactctattagatagacagtattattatcatccctattttaccataagaaaaattgagaccagctgcagtggctcatgcctgtaatcccagcactttgggatttgtccgaggtgggcagttcacttgagctcaggaattcaagaccagcctagaagaaacccggtctctactaaaaacacaaaaattagctggatgtggtagtgcaggcctgtaattccagctactcagaaggctgagacaggagaatcgcttgaacccaggaagcggaggttgcagtgagccaagatcgcaccactatactccagcctgggtggcagagagacactctgtctcaaaataaataaataaataaaaaagaaaaattgactcacatgatgattaggtcaattgtccaagatcacaactagtaaatatgagagccagcattcaaacccaggcagcttagctcttgaacacactctcctaaccactaagccacactgcttccctagcagtctgagtaagtcaggattcccagcacagaagttctgagacaaagtagatcaatggaggatatatcagccctctggaaaggaggggcctgaaggatttgaatgactagcaaagcagagaggtgtgaatatgttcctgacctgactcggtccacctcactatctccattaaagctggtatgttttattccccatttccccagatccctgccaagtgcctgggtgatttaatgtgctattctatactaaggcttacccagctacactgctccagaatgactttgccaacctctgagaatctgcagcctattggcttttcccttcacttgacaccaatcacatatcattttgtactattgtctagccttacttgtgtaaatgtctgatctctgtaattaaattgtttctcaaatgtgaggcaaaaatctcatgttcaatggtttccatgtttccctcatcagtacttaacccagagcctagtacatgatgggtgatatataaatgtttgctgaggaacatgaaagagttaagtgaattttccagaaaagcacatggcttgctgattgaacaagaccctctggactttcatattcaacttgatttagcttcattacagttttgggaatgaggagatcacagagaagtttccaagaaggaggctagtaatgccagctctgtctgagttttgaaagtgggccgagttctcatttgatggccctcatttcctccatctttcctctatgctctactaaatgctgaggctctgccagtcaggaagaaagacactaggcaaacttacactaaggtgcaatcaaaggcatgaccttcctggggaaaggtactacttaacttacagaaatgaacccactgacagtggaaagtcaatcctatggaacctgggtaaagctacttggctcaggcaggtttttatcaggaccctttcatacacattcccaatataagacctactttgtccatacttagctatcacactgtatgtacaaacccacaaagttatcagctccattcccaagtctcttcagcagccttctcctccctttcttctctctccctctaacccccaacatgagcctctgctaaatttcattttcttccattgctctgacaatctctgtgataagtcatatgtctgtaactgtaactgtcacagtactggagctctgtctttctgggagatagaaacaaaatttgtttacttgggagccatcagggatgtgagcaaacacagactttctgaaggacctttggtttagacgggcaagccattttcagggaggcctttctcccacacttggaattcaaacaactactctttttcactgagtccctcccttatctttccaggatattgggcacaattgacctccatcactcttgggaagataaaccactgccttccttggctttactgggcaagggctttagctccaggctagaagtaagaagctgtctgctctatccttatcccagactcttgtgctcttccccgtcttttagtctatcatctcagacaaaggtcaggggctgggcataaggggctgacagtaacttcaaggatcaactttgatatggagactttcatttttaataagaacaaaatctttaaaaatatgatgacactctatcaggtagaattttcctcaccaaacaggggtgtgtgtgtctatgtatgtcggtgtgtgtgcgcacacatgtgtgtgtgtatgttatatgttactctgtggacttgttgctccagaaatctgaccctcttggcccactacctaatcactgtggcctgtttacttaggggtagatttttgacaaccagggaaatttgtgatttttgttgggtaaatcatctgaaattggtctcagaagtcaaaattcttgagacaacataaggtctaatgcccacctatttctggtctagtatgcttgctacctttgagccactgactgtagaaaccactagaggagtactgttatcagggagagcaaatccaaccgcaattcagagaggagactcgcgtctgtgtatgctcaaaaccagctctaaatcaattgttgtgcacatgagcaacttgtcaaaatgcagatttctgagccccactacatacctacagattcagaatcttggagtttaggtctgaaagcagaattttaacaaatgcaccccaacctgtttctaggtaagaggtccacgtacctctctgtatttgtttcctagggctgccataacaaattaccataaattgggtctcttaaaacaacaaaaatgtcttctctcacaggtcaagaggtcagaagtctgataagaatgtatcagcatggctggtttcttctggagggagaatctgttccatgcctccctgctagtctctggtggttgctgataatcctctgcataccttggcttatagccgcatcactacaatctctgcctctgttgtcagagttctcctctgtatctttcttctgtgtctctgtagttttcttctgtgtctctttacctaaatcttcctctcctttttattatgaagataccagtcatttgatttagtgcccaccctaatccaggatgacctcatcttaacttgattaaatctgcaaagacccttcttccaaataaggtcacattcacaagtaccaagagttaagacttgaatatatcttttgggggacacagttcaacccactatactctctatgagaaatatttgtctaaacaagtggttcttaaacattttcagcagtagagtctttcattaaatgaaaacccactcagatgcaaaacagacccaagcagagtttccctagtttaagtgcaggttgtatttcaaacccacttgttcgttctctctctctctctctctctctctctctctctctcacacacacacacacacacacacacacacacacacacactcttctactcccacacctccttggcctctgaggagtgaacacagcttaaaagccactggcctacaagacagagtgacagactctaattcaccgttaatggtgcaagccagcttgtagctaacagtgtgaccttgggcaagtcacagaatctctctgtagctcaactccaccatctgcagaatgaagctaacaatgcctagccctacctaatccagaaacctattgtgagaaagaaataaggttaagatatgcccaagtcttttgaaaaaaagctttgaaaaatgctacacagaggtcaataactattattttcagctttactccatccatttgacttagcatgtcgtatggtatggagagaccagctggcaaacggtactcctcacaaggcaccaccagtggagtgagaggaagaggctggtaaacaagccaacttagttctaagattacctccttctgcctggccctgatggcaatgctctcccgtctgttgccaggcaatctgcacgacctcaaagtcatccttcctttttcactagagtctaaggatttgagcaacagggaggtagagctgctggcctctatatcaacaacccacccaagtaattttctttcttggtcacttgcgtcaatgcaagcaggtgaaaagaggctaagccaaccttctccccatggcccgcccctctgggctcttccataattactcatttgtctgtggcagatggctcaaaattaaaattggtctcacagatgagctagagagattaaatctcaacaacactgataagtgtttatgttgagattatagaaaatcagcaacaggacacttcatttactcctcctatctgtttttttgtctcagactgagattacacagtgtggagggggacagcgagggcctggagaaaggtgacgggatcacggagaaggaaaataaaatgtctagcctataaatctcaaacatttaatataaaagcagaaattcaaggagaaaattataaaagtcatcctgctatttatagatagcctgcagtggtagaaagaccataggctttgaagtcagacacttattagatgtgtttccttgaacaaataatttaatctctccaaaccccaatttcttcatctgtaactaggaatgataatgaagtctatttcatagtattacagtgagaatcaaatgaaataatacatgcatattactcagaagagtccatgatatctagtaagtactcaataaatggtagctagtactactcctactcctactagttgaagccatgctgctcaaatcacctgctgactaatgtcatttattcattaaaaaaatgtattaagcacccactagcacatagtggttaataattcagactgaacgaccttgggaaggtcatttaccttgtttaagcatcagtttccttacatgacaaataggtttaatgatatgatatcatgataattctattatttgctttgattcccattccaaagtcaaacttctaggtgaaaacaatggattttgtcaatcaaatcaagaaaataaatcgtttagtttaaattgagagaaaaggacagaatgactgcatggcatcatactggccaaagtgataaactgagttacctactctcatgtatctgtgctaactttcagtaaacatagcttacttcattcacagaatggaattgtagggagtttcaagatcctgtggtctgaagtgaccacacttcaaggtcactcagctgagcctgaactgacacaaatacctcctgccccccaagctactctttctaccaccccactttgcctttgaggaatcatcagaaatgctaccatttacaatggagctgcaaataaataaagcagctacaagtagtgtctatctagaacaattcattgatgacagagtttcagcaaatgattaactctatttagttctgttcaactttctaagtatttttgactactaatcatatgcctcacaatcaaattgaaatatccagttagtgctttcaagaaatgtatactcagagtgacatcatcaagagatatggctgatgagaggtacctaacattcatcccctccacaaaaagtacgaaaacaacaattaaacaactacacttcaactagagtgtctaagggagaacaccagaatatagcaagggactggtgaattccctgtggagcagggaaactcagaatggcagtgtagagagggaagtgaagcaccctgcctccatgaccctgtctctcttgctgagactggctcagagacagcatgggcttctcatcatggggaaaatataaacagaagatccccagcagccctcattactgccattgacacctgcagtccttgctacagcagagtcccacagtcctcacagacactgagcccagtttagggagctgcctggagtccgtgtggctgcattgttccagaggaggagcccacatggtgcaccatccctcacagcactatcttgagactagagccactgctagaatgcatcttgctctgggggccagtagccactgtatctccccctctctgacgccccactgtcattccatcatactcacacaagtggctgcaatgccacaccccagttgcttggagcctagaccaagtagaacagctgtgactttgacacccaagcctatgcagtgccctgcatttcaaggaacaagcgaccctgcacagtggagaagccacctccacgactggtggaaatgccacactttgcacatccctgacctaaccagcagcatcattatcagcaaagccacaccaccacaatacccacagcctagggcactgaagcacttgcagacactgttgatattgattatagctgaagaaattaaacagagactaccttactgtgcttatacagaagcaaagccaaagcacccgaccaaatcaacaccctaagacacatcttcaggaaaaagtctttccctactgttaaaaatcacacaagatctataaatttaggaaacaagactatttattttacaggttagagcctgcaaggtggtcatatcacaggctgggaagaataacctccagaaaagaccagagacaggcacattgaaggaacggttggagtaggaacttcatgctgaatggattagctaaacatatatagttaacaggttataggaggtgatgtgaatatatatgaaggtggtcctgtcatgtgcatattggcaaaacatgcaagcaacatacaacccatgttcattttagggtggagacttaacatttaaatgtattacagttaggtcctatatgtcaaaaggtgaagcggggacatcaagacactcaagtgtgcagcctctgtaaacccaccaggaccagtccatagttggtgcccttttgatcaggaaaagttactgaaatcagtcttttgtccaatcaaaggatgagtggctgggggccagttagcatacattgaaactgaatttgctttaacattgcttatctcaagcccagtgcttgtttagctgctagagaaaaagaataacctcatgacagacaaaacgtagtttattcttttttttttttttttttttagacgtagtcccactgtgtcacccaggctggagtgcagtggtatgatctctgctcactgcaagctccacctcctgggttcacgccattctcctgcctcagcctccctagtggctgagactacaggggcctgccaccacacccggctaatttttttgtagttttagtagagacagggtttcaccatgttagccaggatggtctctatctcctgacctggtgatccgcccacctcagcctcccaaagtgttgggattacaggcgtgagccaccgcgcctggccggaatatattttttgctttacgtgtcagggtgcgtgacttcatgcttgccagacatggccttaggttttgtttataatttggtacaaagagtccagatcatcccactgcactccagcctgggcaacagagactccgcatcttctcgaaccacaatggaataaaccagaaataaataacgaggtattctggaaactaaacaaacacatggaaagtaaacaatatgctcctgaaagaatagtgggatgatagctcctatcttgagatacatgaacctatagaaattaagaagaaaatttttaaattttttgaaagaaatgaaaatggaaacaaaacatatcaaaatttataggatacaaggaaggcactactaaaaggaaagtttatagctataagtgcttacatcaaaaaagtagaaaaacttcaaataaatgacctaatgttacatcttaatgaactaccaaagcaagagcaaaccaaacacaaaattagtagaagaaataataaagatcagagcagaaataaatgaaattgaaacaaaaaatagaaaaggtcaatgaaatgaaaagttggtttttagaaaagatcaaaatcaacaaacttttagccagactaagaaaaaaagagagaaggcgcaaataaataaaatcagagattaaaaatgagaaactacaactgatgcctcaaaaattaaaagtatcattagagcctactacaagcaactatattcaaataaatggaaagatctagaagaaatgaataaatttctagatgcattcaacttaccaagaatgaaccatgaagaaatccaaaacctaaatagaccaataacaagtaatgagaacaaagctataataaaaagtttcccagcaaagaaagacaagcccaggacctgatggtttcactgctgaattttaccaaacatttgaagaagaactaatcccaatcctactcaaactattctgaaaaatggaggagagaatatttctaattcattctaagtcctgtactaccctgataccgaagccagataaagagccatcaaaaaaagaaaactacaaatcaatattcctgaggaatattgacgcaaaaatcctcaacaaaatactagcaaactgcattcaacaacacatttaaaaggtcacttatcatggccaagtgagacttatcccagagatgcaaggatggtttaacatatacaaatcaatcaatgtgatacataatatcaacagaatgaaagacagaaaccatatgattatttcaattgatgctgaagaaacatttgataaccttcagcatccattcatgataaaatccctaaaactctgcatgtacaaggaacacatttcaacacaataaaagccgcatacaacagaccacagctactatcgtactgaatgatcctttcctttcctctaagatctggaataagacaaggatgcccactttcatgactgctattcaacatagtactagaagttctagctagagctatcagacaagagaaaaaaataaagggcatccagattggaaacaaagaagtcaaattatccttatttgcagatgacatgctatatttggaaaaacctaaagactataaaagagaattttagaccaatatccttgatgaacattgatgcaaaaatcctcagtaaaatactgacaaaccgaatccagcagcacattaaaaagcttatccaccatgatcaagtgggcttcatccctgggatgcaaggctggttcaatacatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatcgcaaaataataagagctatctgtgacaaacctgcagccaatatcatactgaatgggcaaaaactggaagcattccctttgaaaactggcacaagacagggatgccttctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatcgtctcagcccaaaatctccttaagctgataggcaacttcagcaaagtctcgggatacaaaatcaatgtacaaaaatcacaagcattcttatacaccaataacagacaaacagagagccaaatcatgagtgaactcccactcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcgcagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatgggggaaaggattccctatttaataaatggtgctgggaaaactggctagccatatgtagaaagctgaaactggatctcttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctcatatccagaatctacaatgaactccaacaaatttacaagaaaaaaacaaacaactccatcaaaaagtgggcgaaggacatgaacagacacttctcaaaagaagacatttatgcagccaaaaaacacatgaaaaaatgctctccatcactggccatcagagaaatgcaaatcaaaaccacaatgagataccacctcacaccagttagaatggcaatcattaaaaagtcaggaaacaacaggtgctggagaggatgtggagaattaggaacattttacactgttggtgggactgtaaactagttcaacccttgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaagggaacatcacactctggggcctgttgtggggtgtggggagaggggagggatagcattaggagatacacctaatgctaaatgacgagttaatgggtgcagcacaccagcatggcacatgtatacatatataactaacctgcacattgtgcacatgtaccctaaaacttaaagtataataataataaaagaaaaaaaaaagaactgataaacaaattcagtaaagtgcaggatataaaatcaacatcccaaagtcattaacctttctgtatgccaacagcaaacaatctgaaaaataaatcaagaaagcaatctcatttaccataggtacaaatcaaatagctagcaataaacttaaccaaagaagtgaaagacttctacaatttatactataaaacactgaggcaagatactgaagaggacacaaaaaatggaaatatactccatgttcatggattagaagaatcaatattgctaaaatgtacatactgcccaatgcaatctatagattaaatgcaaataccaatggcattcttcagagaaataggaaaaaaatcctaaaatatgtttagaacaacagaagacccaaaatagccaaagccatcctgagcaaaaggagcaaaactggaggaatcacattacctgacttcaaatcacactacagagctatagcaaccaaaacagcatggtactggcataaaaacagacagagaccagtggaacagaatagagaacccagaaataaacccatatatctacaatgaacttattttcaacaaaggtgccaaaaacatacactggggaaaggacagtctcttcaataaatggcactgagataactggatatccacatgcagaagagtgaaagtagacccatatctcttgccatatacaaaaatcaaatcaaaatgaaataaaggcttacatctcagacctcaaactatgaaactaccatgaaaaaacattgggaaaactcttcaagacattggtctgggcaaagatttctccagtaatacccctcaagcacagggaactaaaacaacagtagacaaattggatcacatgacattaaaaagcttctgcatagcaaaggaaacactctacaaagtgaagaggcaacctacagaatgagagaaaatatttgcacactattcatctgacaacagattaataaccagaacatataaggagtttaaacaactctctaggaaaaaaaacgattagtcttcctatcaaataggcaaaagatctacaaagacatttctcaaaagaacacatacaaatggcaaacaggtatatgaaaaggtgctcaacatcattgatcaccggagatatgaaaatcaaaaccacaatgagttatcatctcatcttagttaaaatggcttttatccaaaaggcagtaacaaatgctggtaaggatgtggagaaaagggagcccttgtacactgttggtgggaatgtaaattagtacaaccactatagagaacaggttggagtgtcctcaaaaaactaaaaatagaactaccatatgatccaggattctcactgctaggtatatgtccaaaagaaaggaaatcagtacactgaagaaatatcttcacttccatatttattgcagcattcttcacaatagacaggatttggatgctaactaacttgtcgatcaacagatgaatggataaagataatgtgctgcatatacacaatatagtactattcagccataagaaagaatgaggtcctgtcacttgcaactacctggatagagctggaggacattatgttaagtgaattaagctgggtacagaaagacaaacttctcatgttctcactcatttgggggagctaaaagttgaaacgattgaattcatggagatagagatgagaatgatggttaccagaggctgggaaggatagtagttggggtgggggaagtggatatgcttaatgggtgcaaagatagatagaatgaaaaagagctagtattagcacagcagggtgattacaaacaaaaatattttacggtacattttaaaaataactaaaacggtatattggaatgtctgtaacacaaagaaatgaaaatgctttaggtggtgtataccccatttatcctgatatgattattatgcatggtatgcttgtatcaatgtatctcatgtaccccacaaatatatagacttactatgtacaaataaaattaaaaattaagaaaatcagctcaaaattgtttaagacataaatatgaaacctgaaaccataaaattactcaaaaaaaaaaacagaacaaaacaaaacaaaacaaaaaaacgaaggagaaacactttatggcactggttcgggaaagaattttttggataaaagcttaaaagtacaggcaacaagagcaaaaagacaaatgggattgcattaaactaaaaagcttttccacagagaaggaaataacagagtgaagagacaacctaaagcgtaggagaaaatatttgtaaacgatacatctgacatggggttaattctcagaatatataagaaactcaactcaatagcaaaaaggcaaatgtctgattatacagtgtatacatgtattgaaagatcacactgtaccccataaatatgtacaataatgaatcaattaaaaacaaaatttaaaataataaataaaaataaattattttgggggatgttacaaaaaaagaaatttatagtctcatgagaagaatagttatgcatatgctgaccagtcagatcactcctcttaggcatggctctatgtttcaagggacacaaaagacttaaaacagtgatgcttggctctcagaaagaaaaatataattatttaaacttgatctaacacggaccaagggagttggctgcacacttcacaaggaataaacagtgaaataacctcgaaagcaattcacttaatgaaaacacatgagtgtttttgtttgtttttttgtttctgttttttgccacagcccctctttcttcatggttaccatcaactcagggcttccctcccttaacctcatgcatcagggttatatatagcccttatgcacatacacatgtcccattagaaagtttcctattgtctgtccctgggcagatatgtctcatctgcatatgatgtcatgtcctctcccttcacttcacctgtacagttgtctagtgggcagccattttgtctcattttcaccccagcccgctcaatatttactctgttattgtttttttccaacttatgactcttattgcaagctcaattcaagtgtgaaacatcagtgcaaaattcacagccacctttccatctctcctcagagctattgtatcccagcccaccaaacactattctgtactgatttatttccatatgctaacaacaaacatgagacaataacagtacaaggaaatgtatgctacatcatccaaaatgtgtgaagtagacaatataagaggccacacaggatgccagtagatagggcagttcaagtgaggaacgtttcagaaaataaatagtctttgagctggaacagcagaaagaagatggcacgctggtcagaaggaagtgaatgcacaatgatgtcgggagtggaaatgatggtagcttgttcacagtgggtactggagtgaaaagttggtgatgaaatcagtgcttgtgactcatgttaccctcatgagattagcctcatggaggaaggccctggatatttcactcagcagatccaggacactgggctaggtcggtactaaatctgatcacaaatagctgggttgctgtgctcatctgcccaccctctttttttctttcatcttagttgggatgtgtctatggccattgattgaatggctgtttagttgggaccttggtgaacagtcagcatcatcccagaaggttgttagtagttttctgactggcagtcaggacagagaggactagagtatggtgaaaggaaagggccaggtccactgattacccaggggtctagttgggcagggcttccccttagcaaatattggtgagaagctggccatgttggtctttgacactctcttctttcatctgtcttcttccttagatgacactctttccctccactcctatcaccccatacacataggtccaatgtcggtgtcccatttttaacagctttattgaggtaaaattcatgtattaaaaaactgcatgcatttcatgtatccagtttgatgtgtttggacatatgcatatacccatgcaccaaaatcaaggtgataaacctattcatcacctccaatagcttcctgatacccctttgttttgtctgtgtcccatttttattggttgatattcattgattgacaacaattttgacacccatgataccatgcctaagtagttaccttcttctgtctctgtccattgccttcatctctttttcagaatccttatctttttctcctttaaatattggtgctgcccaggattatttcactcctccctttgcagccaaatatctgtcaaaggcccatgatttattttgtaactttcagctagatatacccacctggatggactccaaacatttaacattctctgtgtctagtaataatattagcaaacacactttgggcatttactttgtgccagtatccatcctaggtatataacatgcattatcttattcgatacccacaaccatcctgtgatgcagaataatgctattatccatatttacaagtggagacatcaaggcacaaagaggttaaataacttgtccaagctcatacatctagtaagcggatgcactgggatttagtacgatttaatgtttgtagccaccatcaactctattattcatataagaattgtggatagaactttggagctaaaaatgatcaacagagctcctctgagcctacccttgtcagcaaatcagccttgtactcaaaccaccaagtagatagtatctctcttcttcgcaatgtgcctgcacagggaaggaagggtttcaatgtccactgagagatccagagtttagaatagtctgagctttgtctacccaagcaaaatgaagatacgtcatatttacttaagcaattttctccctctaccccctaatttcttaactccaaatataagatgtgaaattattcaatcacaagggtcctaggtcaccaccacccttctccacattcatttgtttatcttgaagttgtaaaaataatgcatgttagctataagaattataacaacataaaagcatgtaaaggaaatcatcccctatttcccactctcaaaataacgccctagaagtcattactatgaacaaattatgtgtgtcctaggtattttctctacatagtaaaacagaaacacacacaaatacacaaagacttttttttttaacaaatgttctacaaacctgttctttttaacagtacattatggatgtcttgccaaagctagacacaacactgatgaagtgacatttgcactgcatctgctgcttggcctggctgtcatctccccctgccttcctccctgtcctcctcctcctttttggtaaccttgagagcctgatgactttccaagcacaggccagtgaaccatggactttacctctaagcatgtgattggccacttccagggtgattggggccctatccctcatcctccattggcatgcatgcctgccgagagcaccaggtgattttccagggcaatggcttccagtggggctacatgagtcttgatctgggctaccgtctccaaaccttcttgagggtgtgcagatcctgggcatgaataaatagctgcaggctagctaccaaattgcagctaccactgccactgccctgaagatggagacaagaagagccaaggaatatgtcctcatcacctgctgtagccacattgctgctcagaaaagcattgttttttattattttttttaaagacatattctccctgtgttgcccaggctggagttcagcggtgcaatttcggctcactgcaaccccagcctcccgggttcaagctattctcgtgcctcagcctccaaagtcgctgggattacaggcctgcaccaccacgcccagctaatttttctaattattattatactttaagttctgggatacttgtgcagaatgtgcaagtttgttacataggtatacacataccatggtggtttgctgcacccatcaaccatctctacttaaaatacaaaaatcagcttttctcaagaagggctaatttttgtattttaagtagagacggggtttcttcatgttggccaggctggtctcaagctcctggcctcaagtgatccacccgcctcagccttccaaagtgctgggattacagtcatgagctaccgcacctggccaggaaagcatacttaataaagaattatatactagagaaatcagcctgagagtgttgagtagtgtttgatgaggaagaaggaaatgtggccacccaatttcaaaaccacaatctcaacactggagataaatggagtggcatatcaccacatgtttgagcagaggcagaatggctactgggcaggagtgttactgtatctgttaggaggctggactatgtcatctccaaggtctcttctaactctgtgattttgcagtgtatatatcaactatgatttatgatatgatgaacaaagtctgaaagtggaattctcatattgacttcatccctcaactgttgggtagctggagacaaatactcaatctctctatagcttaacgtcttatcactgaataacaaaggaataatgctaaataatcccacagggatgctgtgagaaaatgagcaatattttgaaattcttctaaaagtacctgataaacgcacattaaataggtgctgtgcctgacatataattggcttagtagagaggcaagaatacaaagccccagtaaatataaaaaccacagtggagttataattccacaggcaggaatgtcactgacacatttctagcataaaacatctggagttgtgagggataactgtttagctgtggtccacttgatcatggaatcgtcaggattaaatgaaatatagtggcaatctagtccattcttctgtcactgcaatcaatccaagctgtattaatctctagcctcagaaagagttaaacatgccaatgctaatttgatggaacacaaccttggcacggtatgaaagaagtcccaaagcaattctgtggaagagtcagttgcccagaattctcaaatgtatgtctggggcctccagggagtctcaagtatatgaatgaggccacagatgaggaagagttggctgggagctagggctcctccttgcatacctattcactgttgctgcccttttctaacaaaagacaagcaatccctgcatcggtggagccctgcaagagctgagtgcactatttccttctccacttgcaacttttcatccatctttgagattcttatcccctattaactaaatatggaggagaaaactaagcagtagtaaatttaatttagaaccccagtcctttttaaggcctcttttgggttatccctggcatgtgttcctgaaaaggtgctgcagagtgaaagactgctttgaagctctgaggtgtctggctatatgtgtttcagatagatggacatgttttgcaagtgattgaaaattcatcattatgtgtaaactgtctttgctttctcaagtttcagatgtggggcatgtctgacttcagggaaataagaacaagacagccgatgtttccctaattcattcttgatcagcacctagcttatttttctctagggagacagcagcccacacccctagcctaagagcatacagtgagaaagctaggcaagagacagcagccgtagagctagaagcccaaagcagccctcccttctcccaactacaacaaagctcctgctcctttcttttaacacttggtccgctgtgacaacagcgaaaggtatactgcttgagactgcactattgacaatgcagctgccagttcaaagcaataaaattggaagtaatatcagagagagagaaattatgggatagggacattgttcttgagtgttttttttctctcaaaatgtaatagagggaaacatgtgagtaaaggcagtacattataaaaatattagaaaacatttgcttgtcacagattatgtttggaaagaacttgcttgcagttgaatgatgttaacatgatgagcataagttcaatcacaaaatgacttcagctacttttcctggtaaccacaagttatatattttttaaatgacttctgttttattagtgacccagtaatttaatcctggccattgtgtactgaataatcaattgtttatcatgatggggcacagtcatggccatgaaacagagacttttgaatcctgtttttctgctaaagaaggaataaatattcttgaaatgtgtcacattaagatgtctgtgctagatgaacttaggcattttgatgttattcaggcccaggcgtgttttctcaatggcttcccaaccctaatcaattcttgctacagagtgaggggctcctgggtgcatggttgtttcttagagaagccattcagaaatctcaaatggggagttcaagcagaaagatcctgaatacaaaattgccccagggtgcttccagtagtaccagctaacaaaactgtttcccaccttggggataatagttaaaaaaaaaaaaaaaagtttcccatcattaatagtagtcattgtaggtttgcctcatgtttgcctagaatatccataacttacggaatttttattctgatgataatcaagggcctgtggtgttgccatgagatacatgtccactgacttctttttagtgtagctaagagtaatagcaccatgccatggagaggcagtctccataatgacctgcccagttccctgtcagagtagcccttcagtcctccacagccccggatgaagacacttcattcccatggattgactcttctatccattactaagagatgacttttctagtccataatctgagattcatcctgtttctagccatagagactcttagaactagggcaatagctcagcagtgcagcatcaaatcacacaagatgctggtcccttctgaatcttgtattttggtagctatgcctgagcccttgccttattgtcatgtgaccaagactgttttatgatctacttcaatggttccaaaatgcaagtgattttgccccccagggggacattttggcattgtccccaagggggacattttggcaatgtctagagatgtccttggcttttacacttggtgacaaggtgctattgttatcaagggggtaaggccagggatgctgccaaacaccctacaatgaacaggatggctccccacaatgaaaaatcatctgggccaacatgtcaagaatgctgaggttgagaaaccctggactaattccaataatggagtccctgtcacatatccttcccagtatccccattcatgtttctagacctcacaatactaatcacctaatcaccttcctcctagaccactgcctacatttacattatactgacgcagtgttctgcccacatactgagaaccctctcttttatctactgtcagcataactgggctgcttctgatgccaccaggaatccatcatcccacctgaccaccttgagtctgtatagcatgcttgtttaacaacccaagctttggatccagcctacttgaatcaaagtcctggctcctccatttaatagctgtgtaaccttagacaaattaccttacctttttgagcctcagcttccttatccatgaaatatgaatagtggcaactcctacctcataaaggagataatacatgtcaagagctcagcaaacttcctagcatatttgtaagtgtttggtaaatgttaatcactgctcgttgctaagacatttgtggattgattcagccggcctcttgtacagtgattatcaagcttctagagcagcattatccagcagaactttctgccatgagggaactgttttgtatctatgctgccccgtaaggtagtcatatggctatggagtagttgaaatgtagacagtgtgactgaggaactttattttttaaatatttttaaaattttaattgtcagacatggctagggatgttatcataatgcacaatgcacttttagagtttttcaaactcaacatcccaccaaaaataaaattccaacaaactctcctgggaaagggaggggcattcttactctctccttccagacattgagaaccattgtcctagtgaggcactgtactgatgggagtatgttataatcctcaggtgggttgggaaataagaaggagctaagactggcatgactaattctagctagccctgcctccccctgctccactgagccactgtcaaaaaagcctcatgcccagaacccaaccagggccatagtgctcccaggagacatttggcaatgtccagagatatttttggctatcaattctggggtagaagggagagctgttactgtcatctagtggatacagacaaaggatgctgctaaacatcctaccgtgcacggaacagtcccccacaacaaattattatctggcccaaaatatcagtcacaccaagaatgagaaaatgccctagagagatccctaaacaatcccacacaagggagcatcactatgtgcttaaaagtctccaaaggtaaggggtctctaacctccctgggaattcggttcaatgtttccactaccttcagtttactcccttcaaattacctggaaggaaattgttcccctccatattaggagtagatattaaaaaccaacaattcttcaatttgggaaaatgcagacaaaggagagaaacttctaaaatgatgatagctgcagagagggagaactgggtttggctcaccaattgttaggatatcagaaagaaaagagtttttgaaacctgccagaattttactataagcaacagaccatgattcccacagtatacaataaaacaacttgtccttattaccccccaaaagataatacagtgtaaaagggtaaagatgttctcaaaaggggttggatttagaaatgtttgcggcttctaaaactataacagtctacttataggagccagaaatattaggaccacacttctttgaaatcgatagcatataacgaattcctgatctcttccaacaccaccttctgtgcctcagacacagaaatctgggctgaaaggcccatggagctgagccagtcattggactagatcttatatttctgggtcacctgaacttctccatgctgcagtttaggtacatcttttcctgtgtcgtcgtcaaggaaaaaaattgaaagctactgtgttcactccagaaaactaaactggataggtaattcaaatcataaacccatatttcttctcctatatctgagcttggagaaactgaactgtcctacataattgtcccttactttctcctgtgctttgtctaactacatgataaatgcctctatgtgacagcaatcagcaaggctgaaaatgcaaaatttaaccctgcagatgcttttccactatcagaggtttgaaagatagtaaaggaccctttaatgtttatttcctgaaaagatcaaggatagccacaggaagaggaattaactcctgctgctctggaggactatgcttacatttagggcaactgccaacaggtcagcaacagtattctacctctggagaccagcgtcagctgcctggcctgcctcaggtgtggataactgagagaaagaatgtgagactcaataattgtttaatgaatgtgacaaaatctcttctttcaacccttatcctccaattgtatcatgtaaccttacagtcagatggctacatatgaacaaagcaaccaaacaaacagcatttgacaggtatacggagcatggaatgaaaatcatggtggggaaagggaatgcttttgatgttatgtaacatgaattttgcttctagatttctgatctggtttcctttttacctcttttttttttttaaaggcctctccttaccgtgaggctactttcaggcctttttctttattcaggcgcagcccacactgcttttgtgagtgaaggtcagaactgcccttttgtaacttttcttttgcactcttagacccaactgagttcatttttgtcacccaaggtctcaactcctcttctttattcattctgattttgttttgctggcaaatgtgctcttatcaatatcagtacccattagaaaaaatataaaataagaagtgtttatttatattgagtcctataatatacttactagtaatctggttaccctggccctccaatgatactgtctctatatctgggttctcagccctgtccagaaacctttatcatgatatccaatctcacactagtcatgtgataagcagtgatgtggaaaactctaaatcagcttgtcaccatcctctttccaggacagcaatctacaagagaaatttaatttaaaaatcacacattgatttatacaaagtgaaccaagaactattatggctgtcctagaaagctatttgtatcaagctccacagtagggccacctacaaagctaactggacaccctggtagagtacggcttccttcctctgtgcaatgctagggacgcgttgattagacctttgcttcttacatttttcccatctcaataataacccacatctgctgattgactcattttttgattcatcacatcattttcacaatttcctggaaaacgtcagatctcaactgcatgcaaaatgccttcagggagggctgtctctccaaaggccggccactctgtattcccttcctaccttggagccttttaccttttttggttttttgtttgtttgtttgtttctaatatccatcccagggtggaccttacttttggaatcagtggttcccatcactcattagaacccatattttatgaagaaaatatatggaatgcttcattaaactgtgacaaaaatgcctttccaggttttatcaaactaaaactcacaaattacaaactttcataacctatggaattagtcatgaattttttttctcatagatttagctcctatcttttgaaaacttcagggcctctatgtgatgaaaactcaagaatagttttgtgggctgccaaacgttaaacaatgttatgtaatgtttgtctggtttaaggtagaacattaggttaattaacatccaacaaaacctgcaatatgtacttaagatatgtctgtatattcagtgttgtgatgtgattttaacatttgtttattgatataataaatcaaattgttggccttttgctggttaggggtggagctgtatagtggttaacagtacgggaggctttggtaccaaactgcctggggtcaagctctgggctctctacgtcctagctatgtgacctgggccaagacacttagcttctctatgactgagttcctcagatataaaatgggagtaattattatgcctatagcatagagctatagtgaggactaaataaaatactccagcattgtgcttgtgcctggcatatggaaagtgctcaacctccagtagccattagtattacttttatccctgctgcttaggctaatcctggctattgttttatatatataattgatctgtatgtatcaatattgacatttttaaaggccagtgggttctgtgacattatccccaagtaaatgttgtccatttcagtcttccaatctaaattatatacaccttggccttgaaagctgagatcatccagcaaatcctaactctgatgcttctgtttttaccagattctgagaaacagatacttttccatctcatgccaatggttgctccaaagtaacacatacatcaccactactagctaactaacctgatagataggcagagcaggaagctggtaatgtgaactgattagatgctggtgtttttcacttctgagtaatacagagaaatgaaatttcatttccacacgttccttggactgctgaacactgattttatctggcatgttaggatggagggaggagaacacagaaggtgaaaaaagagggattacaatttcactaaatccaggcataagacaggaggttcattttcaacatgatgctatcagaccagctgtgtgaggaagtgccagttggagaggttgggtctgtgagcagacaacattgtgtgtatgaatgaggcggctcctgataagggtctggccattaattacaaatgggggatttaatttcagaagcctgtgataaactccaccaagggtaacgatagggttcagaaaaactccaattagcagattgtgtccagtgatgaggttaatggaaatgaatgtatcatttgagcccttggtgaataaccttgtaaaagctttagccatttctgacagtggggaaaaaggagtatgatctatcctctaggctgtcctctggcaatagaatttagctgaaaatacagagaagctgactgtagctcaatctattcgctgcattgcaagtgttttatgtgatgagctctgagctgagtggctctgtcctatgctcattcatccagaaggatccttgaacaggatcctagcttttctacaaggaatccttggacagatccagtagcaaactcattatggcctgaatgaaaagtcccagggaaaggcaagacagtgtaacttctttagtggccatgtccttagcccacatcattgcaaattttaaaattcaatcgagttggttgatgtaccaggtttctttagaagtacagttatagataatataagccaaatctaaattcttggcctattgatttccttccctcttcctcacctccccctatctttatttttccttttaaaaaacatgattttaaacagaaagtccaagatctttcagtatgattttggagtttaaagagaaggcgaaatttgataataaataatcaaattgaatttttcacctgacctcaatctgaacacaaaatggctgttaaaagataatttcaaaaaaaaaaaatgttaaatcgtaatcttcatacaaatttaaagtaaacatgacaaagattttattcaactcattaattaatgagggaaccagtaggtaggccaagagtctgcaaactatggccttcagtccaaatctggcctgtcaactgtttttataaataaaatttattggagcacagccatacccattcacttacacttatggctgctttcattttacaatgaaaatgaaagtttcatttcattgtaatgaaacgacattgtaatgtaatttgttgtatggtccacagagtatcaattactgtctggctttttacagaagaagtttgctctcccatgatacaggctattggaaacatagaaataaactcacaaatggatacaaagtagtctatatccacaaggcaataatcaattatattccacccaataagaaatagttgcattacaatttatagagttttaaattaagtcaaagagaatcaaaggcatggataatccagaaaatatactagacaggacctctagtttatgttttttcatgatccaaagtctttcacaatttttcttaatagctactaggagaaaccttatgtacagagccaccagtagtagcagaatccactctatctgaaagtggagtaggaatcaagctgtacagtggattgtgaggcctgagaaagaccttcaccaaacttaagtccctaccagcctagtcctccttgaaattctcattttttttggctaatgccaaggtgttctttctaggtgccaccagttaaaatgtaaataccccccgctcaggacagctccagatattgttatcaatattagtaacttgtatggattttttttttcaaagaatagcagaccagtcacctaaagggacccagaagtccagggacctggatgggaaactgatacaatttagtaaacctaacctaaaatataagaacaatccataaaaggcagtactgattaagcctgcacaggaggcttgcaagacagcactgggttaacttgtattaagttaggtagaacattaaaaagtacacaaaatagaattgaaggggggtgctcttacggtttccatatgtcacagttttgcccaggtgaagactaaaccattactgtgctggggagtttgcttttgattaagatacattttttttgttgttttgttgagacagagtctcgctctgtcacccaggctggagtgtagtggtgcgatcttcactcactgcaacctccatctcccgggttcaagtgattctcctgcctcagcctcccgagtagatgggattacaggtgcgcaccaccatgtccagctaatttttgtatttttagtagagatggggtttcaccatgttggccaggctggtctcgaactcctgacctcaagtgatctgcccacctaggcctcccaaagtgctgggactacaggcctgagccacagcacctggccacttttgtaatacatttgttgttataatgataggaaccatgtttgttgagaacctagtatgttctaaaacaaacttatcaaacctgcgacctgcaggccacatgtggcccaagacagctttgaatgtggcccaacacaaattcataaactttcttaaaacattatgagatttttttgggtgatttttttgtagctcatcagttatcattagtgttagtgtattttatgtgtggcccaaggcaattcttcttctttcaatgtgggccagggaagccaaaagattggacaactctgttctaaaccctatgtagaaaatacacacacaatctcatttaatccttataattttgcccagctgctgtcattttcccattgtataggcaagggaattgagatacaaaaaggctagtaaatgacaaagccaagcaagatattcttaaattgcactgtgaaagtgtgtctggaattcattccttctggtgagttcatggtctcactgacttcaataatggagccgtggagctttgcgttgagtgttacagctctaaaagatggcacagacctaaagagtgagcagcagcataatttattgtgaagaagtgaaagaacaaagcttccacagcatggaaggggacccgagcgggttgccgctgctggctggggtggccagcttttattcccttatttgtccccacctatgtcctgctgattggtccattttacagactgctgattggtccattttacaaacctctagctagctacagagttccgattggtgcatttttacagagcactgattggtggattttacaaacctcttataagatagaaaagttctccaagtccccactagacccaggaagtacagctggcttcacctctcagaagccctcctcaaaatagtgtggacacagtcactcctctttccatctcctgatcatctgctgatttagtcgctatccaaagtactctgattatcttggcccctagatcacagctgtcctcttcagcccaatacgtgtcatcactctggacaacttcagcacccacccatgtggacaatgcagccagcatcctgacccatcagctccttgacctccccactccactgacctccacattcactctacttcagcccactgtgcccatgaccaacccacagctggtcaccattcagcactgctccactgtggacatcatatctactagcaccctactctctgtccacagtctcccatcctcccagtttgcctactctgtcttttcacttcaaagagacctcaagtccctcaatgtctccatttcctcccagacttttagcccttacctatctgatctggtcttcaagtgcaatcacctgaactacttcatcctcaacttcttctcacgtctggcaaaaccacaatcctgaatctatccaaaacctgaattttccatccccacatctggactgtcaaagctgctagagagaaaaaaaaaagccacattcttctgtgcatcactgccattataaatttacagctgctaatttacccaagacttcaggactgctaggccatccttttactttcctttgtcttcctctttctttccccttagcaaatcttccatacattgaactctccccacacaccctgccaacttctcctccctcactcaaagcatctgatctcacctcccatttcaatgagaaaactgcatttttagatgggaaatacttcagcttccagccctcttcaataacaaactactaacacctccattcaactcaccttttttcctccagtctctgaggataaggcatccttattccagactaagatcaacctccacctcaccccaacctttgctctggacctcatctctcctcatctcttcaggcaccctgatctacccacaagccccctctttcccttgtctacagcctcttccctcctccccgggtcctcccccaatctaatcaaggtgctcaagatgcagcctcatctcttcacagccacatttcattaaagaggcttgggatattaggccagaaactcagacaagggtgaagccttgttttaaaagctagggcacaggtgcagaagaagctgcaattcagaaactaacagaacaagaatgtcccattgcaaaagcctcaacagtaggaatttggaatgatggaacctgaggcaggcctcctgagtgcttcttatttcaggccttggttgccctggaaactggggctggacagagtccttggagtagataggtggagccacttgtgaggaaacaagggcaggcagaggctgatcctgtccactcttggtttcaactactattgctggctgaaggctctcacatctatattttcagccctgacttctccttcaagattcatgctggagttatacaatttcctgctgctttcccagtagggacttcaaagttaacaagcacaaaactgaacttttaaaaaccttaaacctgctcctgtatgcactatctcaattagtgacactactgttcaaccaggcattggaatatggagactcaatacccttgatttcttctccctgccttccctgacacatccaatgaatgccttaaatttgttattttttatctatctctagaatcactatctaatttaagatccttgcatctattcacctgaactgatgatatcttttaattagtcttattctgaaacacatggtggtgtgcttggagctggcttgcaccagctggcgagagcgggttatctgctcctcttcccaactccatgttccaggatgtcatattggtagcatgaaactggccacagtgggagtatttacaccacaaaaactggcaaacacacaaaacaggatattttttcctcccctgtggagagctggttgttaaacatttatgagcatgattaccactgcccatttcccacactgtggccaagctaatcaactatgccactctcctgattaaaaccctcagtggttccccgtggtcaacagataacatataaattccttagcatggcatatgaggccttttatcatttggcccttgcctaaatatccaatttcttctcccatctctttttagtctcacaacttatgtgctagcacgaaggtcacaaactggttcactggagccaaatttgtttcacatatgtattttgcttggcctgcacactgtctttaaaatttttgagccaacgtttataactttaagagcttctacccccaaatccatgtttccggcttcttttcaaaaatttataacactgctcctcacttgtgtttatgacaatttacaggagctgagtagtagctgccccctttgagagggtctctgcagtttaccagtttctatcattcactcgcccaaattatgcgtatacacctacacctggtcctgatttctgttacctgtttggcctgcattttagatagattattatcagaatcttctaaccctcattatagaactttctcttcctttactttggctgtcctgatgatagtccgtggtctctgcacagcctgggaaggaataaaaacagcaagatgatgaaggaggacaaagcagaaggggtagaaggaataaaaagaaacccgtagtctatggatcagtccccactttgaagcaatagaattgtgaaaaatacaggcagaaatgtcccaagtttgtgagacctcgtagtagttccctgcagagctaatcatctaacccttcttggagtcttgggatgtctgccttctcagctggacatgggaaggagaggtccaaggaaattagctcatattgacccaaattgtgggagtcaggtttataaacaatagagtcaatttctcttttcttttctttacttttttattggagacagggtatcactctgttgcccaggctggatggagtgcagtggcatgatcacagctcactgcagcctcgacctcccaggctcaagcaatcctcccatcttaacctccctactagctgggactacaggtgcttgccatcacacctagctaatataatgtttttgtttgtttgtttgtttgttttttagagacagagtctcactatgttgcccaggctggtcttgaactcctgggctcagatgatcctctcacctcagcctcccaaagtgttgggattacaggcatgagccaccacgcctggcccaagagagtcaattccttaatgtgaaaacaggaaatttaatttatttttgctgagtgcctgctgtgtgtctagcactgtgctagatgccataggggaaacaagagcagaccaggacaactctgccttcaaagagctcataaccttatcaaggaggcaaaaagtacgtgtgtgaagtaatttgagaataatgtaagacagcatcagaaaagtgattttcttgcatgtaaccttgtgcccacagtatttgagcgggcagcaagagataagctcaaagttaagaggaggagctattgaagaagccagaacttgcaatggcccctgagtggcagagaaatggggcgagagaccattccacacaggggatccacaaggatatacacacagaaagcaacctgtgagtgacaacactgataggaggagaaaaagcagtctgggcgggagggcaaggttggtcactgtagaccagttttctttttaaaaggtttcctctctggtgttaggtactcaggaagccgaatggagaataataaagttccttgttagacaatataatcgagtagtttcagaaagcatttcatattctaggcatagacaacaacaaccttttggctctatcatacaagtggggctaaacactattcacgggtactgctgtgtgtattggacaggactggcagcactgccttagaagaaaagaaaggaaaagagtaagaaaagtagaaagaataaggaagtggcggggagagagagagagagagagaaagagagcgaggaaagaggaatagcatggtaggaagcagacccatacccataatcgaacccagggaatcctgtgctacaggttagcctctcttcccttctgctcaacacttttagaccctgacagagatgaggaatgcctctgcctggagaaagggcagatttctcatctgagctcgcttcttcctgggcagactgtgacaaatttctcacttccccatctctcccaactctaggctttatgctgatagtgtttatgttcatttccaggcccactcagacctacttcttccttagcctgaaagcttatgttaatttctgagattactctttcctgtgtccaatttactttatgagccagttgctcacttcctgctgtcttgtttgtagctgctccctctaaatgtttaacagtgtttactcgctgctccatcctagccattaatgaccattatgcagtcatctttcaactattcagaggctgatgcaagcactcagtgaaggaaacaggtttcttgcaaactcctcctcctccacctttctcctactgtatgttttctggccacttccctgtttgagaatcctgcgtgcaaggtgggagggaggcaatgatgttgaaaaacagttaactcatccctttgtcagttcgccagtaactgtgggttgttgttttattttttaaagaagttttgagagtaaaaagaacctattgattaaaacacgatttgtctctctgcttacatttacagagataaaaaaatctaaaacaaaacaaaaatcccatgatttgtctattcgatgagactcccaattatccatggtctgtcctacccagttaaaatgaacatttggaacttttttttcctaaagtgtaataaaaatcaatatttcccaattttctggaatcctagacatgttttgaatactcggctccacctcttaaagcctctgttgcctctgttgactattccagccctccccttctctagctctagatcctaccacacttaaactcttctgtgagtctagcaagctgcctcagtttccctactggactgagaaaagactgggtcccaaaagagactttttttttttttttttgagactgagtcttgctctgttgcccaggctggagtgcagtggcgtgatctcggctcactgccagctctgcctcctgggttcatgccattctcctgcctcagcctcccacgtagctgggactacaggcgcccgccaccatgcccggctaattttttgtatttttagtagagacggggtttcaccgtgttagccaggatggtctctatctcttgacctcatgatccgctcgcctcggcctcccaaagtgctgggattacaggcgtgagccactgtgcctggcaagagacattttaaagtcgaaagattttttaattcattgatcaggttctgcacactcacccggaagtgctcctgaatacccaaagaagcccccatctttcacctatagctgctatttacactaaacattacatcatggacatagcagttttatcaatggtactgttgctatcagtatcccctccccaagccgagaagtcttcattttcagagtacttcttcctgaccctaacgaattatctttaccttcctgggacctacaggaagttggacgaaccctgtctggccttgggctttggtcccctgaagttatatatatagtctctactgctcatttggaactgagcagataatactatgtactgtcaccagttttatgaaagtttgctctacccaagtaattctccaggaggtcagaaaaaatgtcctttacttctctgtattctccagtatgtctcagacagaaatgggcatgttgtcattgcataattgacaatttgactctagagcttggctctagagtcttgcttgggtttgaatcctggctctgctgactaaaaactttgtaaccttaggtgtgttctttaatctccctctgtctcagcttcttcatatgggaagaatatttacctcacaaggttgttgtggagattaaatgagtaaagacatgtaatgtgcttagaatagtgcctggcacacaataagcatcccacaaacattagctataaggaaggaggtttaggaggtcaaaagaattgaaacaagaatggagactctaattcctgaatcgccagcattttataggccctatgcttctctctccaaactttaatcctgcccttctattcttctcatttcttgtacctaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagaggtaagctgagctcatgtctgctttcagggaagcttaaagcctccaaagtctggagcagcagagcaagaatcagcatttttctaccatttagccccctaacaaacaaatggttgggcaggcctcacagctaggcccatttatccgaggcacagacaacctttttgtattttctttatggccagataagtaaccatctgattctttggtggaaaagcattcatgcatttaacaaatgcttactgagcactgtttggagtgtttgcgatacagaagacagacaccgaccctgctttcatggagcttacaagctggtggtggatatagagtaaatgatcactttaatgaatacataattacctactaagatatgtactctgaaagaacagtgctctgtgagagcacataacaaaggatcctatcctatatactggggacatagtgggcagtgattacaggagggtcgctgcctggatgctggtaattgttggcacaactgaatccctggcagccccttagcgagaaggctaaaaaacacatttgaaagatgaagtcatactcaaggtttgtaggtcaatgaaaggctgaagcaggatctgctatggtatgacctccaaaatgttaggttccacgtctttgagggaggtcagttcaagcaggtcacaggtgaggctttgatttccagttagggaagatttacaatcaaacaggtgtagttctatgccaacttatcagacagtttgggagagcctcctaacaaggctaacttagccctttaaggaagcagcatgataccacggaaaaagcagggactatggagccagagcaactgaggatagaattttaacccactagctgtatgacctaaagaaactcactcctattttcagggcattagttttctcatttataaaatagagatgaaaatagtttcttcacttcataggggattgtgggaaataagaaaagctaacattcagtgcatggcaccagaagtgctttgatgtccatttccatctcttttccatgctacctggagtcaaagcagctgaggggtgcctgccagctgaagggcaactggcagtgccattccttcatggatcaggctctgaggcaaacgtcattgtgtgtttatctggtccctttttctcaggcaaaaataaaactaccacgccttagaaatgaggcaaaaaacaaataccagggcaacctggaatgggataaaaaatgaaaaagagcaacatggagatcgaaagggctatactggaggaagtggtaaatggttaggcccacccatgagtccccttattttatttttgccatttacctgctttaagttatttcaataagcctggtgttgtgctcacctccctggagaagtgtaaagataaaataaaataggtaatatacttacgcacagcgaaataccgagcatacagtagcagtcaataactattagctgggcggggtgtggtggctcacgcctgtaatcccagcactttgggaggccaaggctggcagatcatctgaggtcaagagttcgagaccagcctggccaacatggtgaaacccagtctctactaaaaatacaaaaattagctgggcgtggtggcaggtgcatgtaatcccagctactccagaggctgagacacgagaatcgcttgaacctgggaggcagaggttgcaataagtcgagatcatgccatggcactccagcctgggcgatagagtgagactgtgtatcaaaaaaaaatttactattagcggctataattattcatttttatttttacacatggaggactcgtggtatatggtctaattctgtgcagtaaaatggcaggtaatagatatagtaaaggcccatccttctcttatccctccctctctcccacagccctgctgttgatgtgaagtatcagttatcgtgttaagcagtctgccgtatctacactttgatatatgtatatatttccattaaagatgtatattattgtttcagtgttttttcactttacataaattgttataatactgtgagaaaaaaaatcacagatatttgtagaacatgaattgcttccaagtgacagaatggttaatgggaataaaatagtttttaaaaaatagataattgcagaatacaactaaagtttacagtcctcaccccactgaatatgagatcaactttacaattttaggccccccgttctctttaaaattgagaatgcatttatttgcaaacaatttcactgcaatatttcatcaatttttgtgttggtaggtcaccttctgttgtatggcttgactccacttgctcatatgatcttcatttgccagttttagttaccgttgcatttgacaaccaatgtgatgactttctcactctcatggggatctgcttgtcatatgatcacttttggattctacattaactgccctccaatcctcattaaccttctcattattttttcctctttcttttagtccttttgctgtccagaaattttgtcccttgtgttctttattccataatttcttatcattgtttttacacaatatctttatgctactatattttcgtatctttctcaactctcatcccactaatctgaatgtgccacagggttttatttcttcttgttctcttgattaagcatcagagattccaacattgtttccagggtccattcctgtgtacattgaagtggactttttattgtggtaagatatacctaatataaaatttcacattttaaccacctgtaagtttacagttcagtggaattaagtacattcacatcgtgcatccatcgtcactaggatgcatttttgaagatgcacaagttttggagtgtctattttactttcaatagtgaacttatctaagcatagtttcatatttcacaaggacacacttaaaaaattaattaattaattaatttatttatttatttatttatttttgagacggaggctctctctgtcacccaggctggagtgccgtggcacaatctcagcttactgcaacctccgactcctgggttcaatcgattctcctgcctcagcctccatagtagttgggactacaggcgtgcaccaccacacccagaaaatttttgtttttttttttgtttttttttttaattaattaattaatttatttatttatttttagtagagacggggtttcgccatgctggccaggccggtcttgaactcctgacctcaagtgatctgcctacctgggcccctcaaagtgctgggattacaggcgtaagccaccacacccagcctatttttattatttttggagacaaggtctcactatgttgcctaggctggtttcaaactcctggcctcaaactcctggcctcaggtgatcttcccatctcagcctcccaaagcactgggattacagatgtgagccaccatgcccagccagctaaattatgtttaatccataacactggcaaagtagcacctcttaactattcaatattatggatattcagcagtaatttcaaaagtaagtaatcaaagtaatttcaaaagtaaatcactttttgaaaagtaattcaaaaagcactctatttatgcaaagatcaacaattttaggcctggtgctattcactgatatttgtgaatcaaataaatgaaaaccatggtatttagtagactgaattatttcaatcaggtcacatcaaactctagctccaggtatacagccgggatagtgagtgactgtcaacttcaatgtcaatagtgataaagaatataattccaaagagccaccgaaactcaaatatggcctaaagtttagcctcatagccagagacttcagaatcatttggagatttatatttatatattttgctccaaattttccaagataaattatcttagcaatggccatacatcaattttaacataattagtttctcttcaaactaagccacgatgattagaaaggcaggcttgagaaatcatatatatcttaaagtttacactccaaaggcattgcttcaggaatgtaaaacataatttatactcatcaaactctataaatcccttctgaattgtgacttcatttctagaaaaaaaaactgtaatccttcctaatctgtgaattagagttttttaaaaatatgtggtttcattgagtctcaaatgcatacaacctctaatttctctctattcaattcacatgtctggtttaaggctgaataatcccaccttcttaaacaaatcagcaatgtcctttttggggttgtgtttttgtgattttaactttagcatataaatttagctcaatgatgtgagctactgaggttccaacaattcaagtgtctgtgagaacttcattctcaaaagtccttgatttgaggaatcagactgataagtctgttcagtaaatatccaaaatctggtcttaaaaaaaaatgaaacactcacacagtgcttagggccacaagcataaaaaagtcatgattttgatctttattttatcacattatataatacacttgatttttgcagtataaactcttctcatgtaggattggatgaaactaggcaaaccaatctttcctttcgatgcaaataaatgaatgaaacctaactttatgcttccattattattattattattatttatttttatttttatttttgagacagagtttcactatgtcacccaggctggaatgcagtggtgccatctcggctcactgcaacctccgtctcccaggttcaagcaatcttcccacctcagcctccttagtagctggaactacaggcatgcaccaccacgcctggctaatttttgtatttttagtagagacaggttttaccatgttggccagctggtctcaaactcctgacctcaggtgatccacctgcctgggcctcccaaagtgcttggattatagggatgagccaccgcgccagtcctatgctcgcattatgtttatggcaagttaactcagcttttccatgttagacaaaatttctcaaattctttgaaggcatatagtttatgtgtgctaactcatcaagaaaaaaacatattaacatcttaagtgggtcacaccccaggatctagtggaacacatttaccctgagggttacatatcaggagccccaaaccaagatggaaaggacattttcttttttttttttttttcaaatgaccttcatacccgaaagaagcctgtaggggaatggacaagaattatttcccaggaacagaattattcaaagagaaacagcctctagatgataatgaaataactgagctaaaagagaaaagttgtcttttccacttgattccatgcttaataacagttggactgtgaggttctgtcttcaaggataggtaggattacttcctcaatgtctgtaatgaggaataggacagagcagaagcattacttctccactctctagtgccatacctgatgacaacttgctaaatcttttaaagtgtgctgtgattccaactggggaaaaaaatgaagaaatacccagtacaaatggaatttttctcgatgagtcgaggtttgtgggggagaagcatcaagaactctggcacctgggataaggaccaagataagccaattcacatcttaagtttcaaatagacaacatgtctttttaaaacttgagattaaaagctgtatttcacacagaacattttttttcttcataaaatgtgctgcaacagagctgatttccaaagctggaagttgggggtttgcctacattaaaaacttcgaagttatagtttcaagaaaggcgtgttcccccaagtttaagtaagaataaggttactagaatgaccagtatttccagaatctgtcataatacagaggtatgtgtatttacacgcgttcaacaacagattttgttaatgacaccttttttttgtttttttttttttttaaacagagtttcgctttgttgcccgggatggagtgcagtggcatgatcttggctcactgcaacctccacctcccaggttcaagctattctcatgcctcagcctcctgagtagctgggattacaggtgcctaccaccgtgccggctgatttttttgtattttagtagagatggggtttcaccatgttgcccaggctggtctggaactccagagcttaggcaatccgcctgtcttggcctcccaaagtgctaggattataggcgtgagccaccgcgcccggcctgttaatgacatctttgattagaggaatctgaaacactaaagttatgtttcataactgtggcccccttgtccaccttatatgaatatttgtggtaaacttaaaattatctttgagatgccttcagtatttttctttctttctttttttttttttttttgagacagagactcgctctgtcgcccaggctggagtgcagtggcacgatcttggctcactgcaagctacgcctcccaggttcacgccattctcctgcctcagcctcctgagtagctgggactacaggcgcccgccaccacgcccagctaatttttttgtatttttagtagagacggggtttcatcgtgttagccaggatggtctccatctcctgacctcgtgatccacttgccttggcctcccaaagtgctgggattacaggcgtgagccaccgcgtccggccgccttcagcatttttctagggtctttaagatgaaattgtgaccaggtataagacttcagtgattttccttatcttgtaaaatgcagttccaaccttcataagtataatggcagtcacctccaaggattatttattaccctgaagagatgtgatattggaaactgacagttttatttatcaatacaagtaattcacaaataactaacttcaggaactagaagtcattttttctttctttagggattttctgttggttggttggttggttggttggttggttagttggtttgtgaactttctgagggttaaatagacagaagaaaaccagttttaaatatgggctggagggagtaggatctctgaaaaaatataagcagtattcccaagaggtatcactaagtacatctagtctattaaggtaagactgtcaatacaaaaacacaatagctttcatgtaaaaaaaaaatcataaaaatcaagttggatcacaatgggttaataacgttcagagttacataaccccctcaggaacaaaatcttagccttaaatggaatataattatttcctgaagggctttttcatattgttttttcctcattattattcctactagaactcaagtagactccccaaaagaattcaatttggttaaaaaaaaaaaaaatcagctccaaagaatgaaacaatagctgattccaaactctaactttggcatgaagtagaataagaaagctcttatctcttagaaaacaggtgtaaaactattggataattatttcatatcaaatagactttcaggtattgtcatacaaactttttgcagatgggtgaattttctttttaagttctggggtacatttgcaggatgtgcaggtttgttacataggtaaacgtgccttggtggtttgctgcactgatcaacccatcacctaggtattaagtccagcatccattagctgggaatccattcttgatgctctctctccccaccccagcccccaacaggccccagcgtgtgttgctcccctccctgtgtccatgtgttctcatagttcagctcccacttatacgagggaacatgtggcttctggttttctgttcctgcgttagtttgctgagggtaatagcttccaactccatccatgtccctgtaaaggacatgatcttgttcctttttatggctgcatagtattccatggtgtatatgtaccacatttcctttatccagtctatcattgatgggcatttgggttgattccatgtctttgctattgtgaatagtgctgcaatgaacatacgcatgcacatttttcagatattcctgaaaagtcgtgatttcatatattctgtctcaatgccagatatgtcatgccaaaggctttgaaaactattatttcatttgttccttattatcactgaaggtaagcagaaaatttattaataaccctcattttgcaaatgagaaaggactatgtttagagatttgcttaagatcatctgacaaagccagaagtataacttcagaatcctggtacaacattctctcttattatgctctgctaccttacgttgagtgaagttcttgtgggcccatttggtagcctccaaattcaccaccaggtaatttaagatgaccacacgtttttttgatttgtgaatgaaagtttattagttaaaatctcttgaaagaaaacaataaaatggtttagatcaatagctaatacagattgtaaacaatcataagataataactagcagtaatcatcacacataagaatttatataggcacaactccccacatattttaacccaaacaaatagggatgaaaacttgtactacctaatctaatgccatctaccagcctatcttccttgattttcacacctttaagcttgtctcagaatgatgagcccctctcttttctgccatgctatataataattggctttaacactggtcttaagaagatacagaaaagggctaatttgcataaaggatcagccactcactccattctcctggaggagatgcaggatttcaatcagcgatatccagtcagtggactaaactagttaataattctccatctaattgagctttcagatacatgacttatgtcaatcgcctaccagctgtttatagcaacatcttagggttggctaatttgcagaagacaaaaacagggctttgttcataaacctgtttagaaactaactccatatcatggctttccatcataaaccgtcgcataactgttgacaatttattaatttgcttctctctcctgaaaacaccgtccccactagttcttgttcctaaatattttcttatttcctaaatatttcttttcactattaactctaattctgctccatagagcaaacatacttaatacaacaatccattccttggagcgggggttatatcttaacaatccttaagcacataaaattacagaatcaaagcaaacactggaatatatcttatctagttcctgaggtaccattacagtacaatctgttcaggtgacccaggaaaacaagggtccagccagctccacatattatggggttgtagcatcttcctgctttgatgcctaaggactatatctagtccatagatatttagtccaatatggtgagtgtttgtctttccattggtgaatagtccttgtagggctttgcttagcccttctattacttctctctttgattatttggtatagtgtgccttttccatttggggaataatagtgcaaagtagctacaatgtggtcagaatttgcaagaacagtcctgcactggaactcttggtcccagctttttcagttttctccttggcaacagtcatttgaaaacctttcttcacttttattatctggtagatagtactcttttaaaattacctcccttagtctgctatagcattttttgtcggacacatgctttcttaaaggataagtaaggagttatatcctttcaaataaaagtatcccaacactgtcttgttaatgtgaatgtattcatttactgtaatgctaccctgggggatattccccttttcatttgcattcattggagagcagtgaaattagtcccaagatgtgatagagttcgtcagttctccactccataattaggcaaggaatttcttttctttactattgtttgctcccatcatcagaaattctagcatgagagtaagtacaggtaaagggagacctacatggcaaaagacagaactttctgaataacaacaaagatgaaaaaagaccagcttttgctagaagtaaatcaaatctcacttgttatatgggttattagtaatgaaaatgtgcagaactatgagaaaacacatattgctaatatacagaaaataagaatatattaaaacagagaaatgatcagttttcacatccctggggacgggggcagaaattgggtcttagtcacctgttaagtcatcatttataccagagactgtatcttcatataagttatccatgtctaacatagcctgatctatatcaaatattaggtcttcatcctctcttggtgtaagtattgagtctaagtctgagagatcagggagatcaggtagcgaaggctcctcgggaagaggtgcatctgcttcagtctcttctgctctaccattttcttctacataaggaacttcttgtacttgtagaatgaattgtaaaagctcatcagctattcttattaactgggctacacaagcaacaagtccatcaatgagtacatgaattaacacagaatccatgctgcagtgctcttctaaatagataaaatatcactaaaagctctagcaaatggactcttggtgacaatggatagtataaggggctaacaatggttctgtggttggtttaggccagaaattaggatgttgatatgattatgatggtgatcaagtaaagaatgagaacagtagaacaatataactttttgatgatgttggtaaaccgcgcacagaatttatgtatggtactcttgtttgtactaatggtgaactgctgttataatgaccatcaggcggactgtcacagccaagagaaaacagcaaagcagacctaataataaaaaagagagatataaagattagtatctttgagcctttatccatcctacaggctatggctactggttacccctatcaagaattgctgttaaggttgaaacgatatgtctaactatagcccctcctttgttgctggccttgtgaggctctactacttctctttcctttgaaaacctcatggtctttatctcttgttaagagatttgggagaaaagtgagtataggtagtttgtctgtctttcttgagcatctcttttgaggaaggatacactcacgcagggtctgtcaattattagcacctttgcctcattgccatttatatctgggtgctgctgaattctttctgtgtttctaggaatccattcattaaagtttccagatgccctgcagcctggggagtttatggtaaatgaaagtcctatattctccatattttgccaaactttggagaatttcagttataaaactagttccttgataatttcctattactgccccacttccatatctagcagctagttcttccaactttatctaaagccatggttgtactattttcatctgcgtgtctagtgggctttgcaaacccactttctgagtaagtatatatttgtgtaaggcaatattatttgtttgaaaatctagatattggctcaatataatctacctgctacatttgtctggtttaccactccccaccacacttaaaatgaatctgctgaggatgcaagaagtttttaatattttgatatcactcatatttcttactcacttgtttatttgattcacaggttttctaactctttcttctctgctaacctggcacatacatgcccatatgccctgaggtttcacaagcccatcctacaaccttaaattgaactgaaaagggagctgagttgaaacttaaagtccccgaagcttcagggtctacattagttttgggggcctagattatctcccctctcattccaaatagattattctgcttttctgttctaatgagctgacacatgtctttataagaatttctaaattctttcaccaatttattttcatatctcccttcaccagattgtttttcctgcaatagtccaggtctatatggctgatcagtgtagctatatacctttgaccagtttttttcttgggtatatctacatgttaaatttctggctattaattctgtaaattgggctaacttcctttctccagtcccagtcaggcttttcctagttgaaagtcttaggaagtagtcatctatataactcctttaggattctaccaagtctattattgcccagttttcagcagttctgaccagagtggggcccagcaagccacaggcttcactttcagctgactataatccttgaatatttattggagtacagaaaatcatcagccagatggtctgtgatttgcacatacagcttgctggtcttcacagggccttttttgacccactcagttgtatagtatctccacttagcctaagtcctatcagatcactacattttttttttgtccaaaatcctaccagtacacatggggtttgtcctgatgataagggtcacaacgataatgaccagaaggcacgattttgttggaggcaattttccatatggaatataggagaacgggtactagaggcagagcagtttgttttattaattcaaaggatctgtttgtttgatttaagagaaaaacgtctcatgtaagaaaatatggagagaaatcaaggaaaggaatttggcatttatttagaacatgcatcagctcatcagaaggaaaacacagaagaaagatgtgtgttaaatattgtaagagagcaccatcacatttttcaaaggaagcaataactactagatggtatatacagcccaaaggcacaagaagatgacaggaacacactcacacaaaacctatttaacttctgacttcccattcacccagttttttttctcagcttctctatcttcctctgggactcttttattcctcctcttgatcaatatgcttccatttattcacttatgtgtttcattctatttcacaccctctctatctccatctactcttaaccttttccatcatcttttcttgtctctctctcctaaaactggaaaaaaattggaataaattatatttgattcatcaaatttttattgtatttattgagttgtacattacacaacctaaacataaaaagcagagaggtagaacattccatattttgctctcttataagagaaatgtagttacttattactttatgtggcccatgagtttttttgtggggcgggggactcagtcacttttgatgggaaaaaaaattagtgaccttgccttaactttcttgacccttgtattagctttttttttattttttattctcaatctcagaatttagcaactagtgggtgaggagagggcaaggagaaacttgaagaaactgctaagtattccaataataagaaagagtaagagtgtggcatcagcttatgccagttatggtaatttccaaagcaaccaactctggacaccttaactagcctaaaggggtcttttggatagtttatgcctagccttaactcactttaagggactttttattagctatatcctctgcctgggatccctttctccttggtgggggaggagtggggaatgatttcgtgtcattctgatatctactttaatattatctcctcagatttcttacccctcaacctgggtaaagcccctaatcattcctttcccattacacacaaatttcatttttgcatgatggtatctataactagctcacattttcttgcttaattatttgtttttctgtctctcaccttacccccacatacatatagactaaaatgtaattgtcatgagactaagaaatctgtctgatttgttttctgctatatccccaaagaacagaagagtgcttgccagcatagtatataatcagtaagtgtctttgaaaaaaagaaataatggaaggagggagggaggaacaactttcagctcattcattcagtaaatattatcaagcttcaaccatgcatgtgggaaacaggggatacaaaaatggacaaactcatcaaatcatacagttaataaaatgaacaggcaacccagagactgagagaaaatattcacaaaatatatatctgacaatgaactttcaaccagaatatataaagttcattgtcagatatatgtgtgtgtgtgcgcacacacgcgtgtgtgtctatatatatatatatatatatatataagaacccctacaactcaataataaaaagacaaacaacccaacttaaaaatggccaaaagatctgaacagacaattcaaatgaagagctaataagcacatgaaaacatcctcaacattattagtaatcaaagaaatgcaaattgacatcacactaagataccgcaatatactcagtagattggctaaaattaaagactgacaacatcaaatattgacaaagatgtagaggaaccagaattctcacacacatttatactactggtaggagcataaaatcatattatgtttttggaaaaacatctatcagtttcctataaaactaatcatgcacctatctatatcccagcaattctactcataggtatttacccaaattaagtgaaagttcacaaagtgacttttacaagaatagctatagaagttgtatgcataatcaccaaaaagtagaaagagctcaggtaactatcaagaagattatgaataagcaaactgtggtatattcacacaatgtgatactaataagcaataaaaagaaaggcactactgagagggacaacaacatggaggaataatcaacattatacttaatgaaagaagccagacacaaaagattatatgctgtatgattccatccatatacaattttagaaaatgcaaaataatctatgtagaaagaaatcagaatagtgcttgcatttatgggagtaggaactgattgggaaggggcataaaggaactttctagagtgatggtaatgatcatgtttaggtacggttgtgggttacacaggagaatgcgtgtgtcaaaactcattgaatggtactctaaagatttgtacatttcactatatgtaaattttactcccctcaaaaaagtaaccaagcacaatccccagcctctgaaagcatatgtcagatgcaatgatgtacccataaaaatttttctaataaattgtcacattaatgggagacctattgtgtgtcaaggactgtaaaacccacttttcttatattacaggttgagtatcccttatccaaaatgcttggtaccagaagtgttttggatttcagattttgaagtatttaaatatacataatgagatatcttaggaatgggacccaagtctaaacatgaaattcatttatgtttcataaacaccttatacacatagcctgaatgtaattttatagaatatgtttaataatgttgtgcactaaacaaagtttgtgtacgctaaaccatcagaaagcaaaggtgtcatgttggtgctcaaaacgttttggattttgaagcatttagtatttcaaatgttgagattagagatactcaacctgtagtacatttaatcctcacaataaaatcagcctatgaagttataggtggaaaaactgaggattagagagattcagtaatttgcccatgatcacataagtaaagatgcagagctggatgtcagcccaggtcggacttctaaagtcctgtgctagagggcacaaatttaggtgactacaggagcaaatttgccttattcagggccagagctgacatctcattctcctaagcaggaatagaactgagaatgttaatgtcatttgctatccctagaaactggctgaattccaagttgaatgtgacttaggcagatcagtcccctaggaaatccccaatatctgtgactgggaggttcagggatatatccattacctatctttccactgacctactgaattggcccaaatgttcataaactacttacctgtgatagagctgagagggatgcggatatcaaggctcggcctattaaacaatttgcagactttgtttccaaacaggatgtgaacgctcctgcaacaacaaaaaaaaccacacccgcccccaccaaaaaaaaaaaagataaattgcgaaatcgataggtttaaggataagcaaggacgagattaaagagccctttctaagtgaactgacaatcaggggcttttttcctttcctgtggcatttgctaattctgggcactgttgaagatgaagcttggctgtaaggcagaaggactctcctgaggaaaggagaaatgagcataactttgggccattgggagacactaaaataatgggctggaaacttgagaagcccaaaatgcagggctagtttttcttacctgaagtcacctgagttctgggctggtgtctgggtaggaaaagcacaggaaaatctcctgcagtctcctggtacttcagagacaaattctccctctagaggggaactgccccaaacaggccaccggtctccaccttaaaaggttacctagattttgaagttagagggacaaagggaaaactaatgagtcaaaaagatcaaaaccactcccaaagggcaatttggacaaagtgattctaaaatgcataagaataaataaaggctagtaatagtgaaacatcttcaggaagaacaaattgaaggacatatgctaccagatatcaaggctagttacagagctagagaaattaagacagcgtagtactggctcaaggacagacaaataaatcaatggaaccatgacccttacctcataccagataccaaaataatactaataatgatttgaaatgaatcataggcctaaaaatgaaagtcaaaacaacaaagcttctagatcacaccaccagagaaactcttcatgaccttaggtaggcaaatatttcccagaggacaaaaaacattaaccatgaaagaaaagattaattaattataccttaagaggataaaaagccaaccacagactgggataaaatattcacaatatatatctaacaaaggacttctatccactacattcatacattttttaaactacaaatcaatacgaaaaacataatcaatctaatttttaaaaaatataaaagaattgaactggcacttcatagaggagaatatccgaatggctcacaagcatataaataggtgttcatcactattgctcatcagggaagtgcaaattaaaaccacaatgagatatgcaaaacccaccagaagagctaaaatgaaaaagactgacaataccaagcactgaaaacatggaacaactggaactctcatagattgctggtgaaattgttaactggtaaaactaccttggaaaactatttggcagtatctactaaaaccaatcatacctctatcacatgaccctggaatgctactcctaagtatataaccaaagagcgtacaaatatccaccaagatacaggcacaagaatgttgaaatcaaccagatgcataaaattagctaccatatcactacatttacatgaaatccaagaacaggcacacaaatctacgggaacaaagtggttacctctgggtagggggttattgactgggaagggatatgaggaagccttctggggtgctggtaatgttctatatcttgatataatcacatatgttaaaaaataaaagcattgatatgcacccttaaaatttgcgcaatttactatatgcatgccatacctcaaaaaaaatagttttattttttaaattttaggcctacatcctataaaaactaatgaggacagcaagacagtgataagagtcttaccaggattcagcaagccagtcatcaaagttaatgaaaatggaatgaaatatgaatgtgcagggcagtgtccctttggcctgtgtggctctctacttcatggcagtgctaaggcaagagaccctgatagctaggccgagtttttaattgatacaagatgagataacctatatcttacaagtagctcataaagacccctgaggcagaggccatactatccatctggtaactgagatctttgaccccattgaatttttattaacctctcttgggactttttttgtctgcacaactaatcaaaagtcaccatttttcttttagctgaaagtcctacctggcaattttgcaatgctcctaactggaaaactggcaataagtgtctaacagtaggatggaaaaggagcaaagaaatccaaatcctctgggtctatctttatagttgataagcttctttgtattaggtaaggtaaattagttcatatccaaggagaacagaggcagttatgtgggaaagattaaaatgcacctttggtgagggtgggtgccagattcctatttacaaacaggaaaatttttttccatagtgttcccttctccggtgctgcagtaccatttggatacatgcattcaatatagcttgttttaaaaaacacctacagacatataacttctcgttaccctcttcaccccttgaggaaacatcaagagaactttatccacaaagggcaaatgttcacaattttgacataacagaagcatctctatgggaatacaatgaataaaaaagagtatttacactttaaactctttttgaaaaagctacaaacttttgcctttaaaaaaataactgtgtgcaatacagcatttgcctgttataggatctgacatttaaaaatccccatgaagcatctttaatttatcaagaaagaaaggaaagaattgtgcagctgaggagctaaacatggccccttcttgaaaatatatgaaaaattcaaaactaaaactaaaaaaagggggagtaggaaatgtccttatggtcaatttaaaccaaattctactgaatttctttcctcctccaaatttgttcattgctgcagagaaaaatcacagactggcttacccttcagaaaaacaacttagtagaaaaatacaactacttttgaaaatacatcttggttattttcctagacagatacagtgtttcctcaaaacactgttcaaacatgagaatagacactcaatcttaacctggtaggaccctacacaggcttgtccttgaggcttggctgctatgagaggctcccaggcccttagagagtctggaaagagatgtaatacttctagaaagatttttttggttttcaaatattacagcgcagatgacagggtctacaataagggaaataaaaacagaacttggaggtaacaggaaaaggggttctatttccaagtctttcttcagctttctgagagggaaaaaaagttgtggttgtttgtttgtatatgctttttgggagagatataaaatgatactagtggttataagaataggatctggtatccgaaaaaaaaaaaaaaaaccctatatttgaatttcaacttcaccacttactaactagaaggttgctaagctactctgtgtcagtttcctcatctgtaagatgaagataatgacagttatgagaattacattagttagttagcacaacgaatttaaaatggtgtctggtatataattagcacctaataaatgctagctgatataattgcactggagaaattccaggatctaggaaatagtatgtggtacatcatgactagtgaatagctgcccatggaagacaggagaagagatggctgcaggcattacaaaaattggaaggacatgccagagacacaattcatctcatagttagaaccaatattagatgatgactttgagcttgggtaaaaatgtgagggaacaggactgtcttgaagctgtagttcacaaatgaccctttcaggagacctaagaacaatcaaagactgtagggaatccttgaggattagcaaatcctcctagtctaacttcctctgaagcacttccttattctggctttgagctctggtggggctgcagctcacatgcaccactcctggcctggcgaaagctaactatattgtgggctacacattggctatgcctccaacacactgccagttgcacagagaatgccctccacctcgtattgtgacaatgattctttcaaagcattaaatctttagaaacatccacttggaaagtaattggcaaggtcattgagacaagataataaaggtccattatcctatatctagcatgacttcacccaaaccaacccaaagtttcaagtattcctttgtgaatcatttggataagaaggagagcattatgcaaacatcttcgtatactttttacttcataccatcctagcatggatttagtccctaacttcaggaatatatctcagaaatttgataagagaaagactaagcaccagttgtggcctcctctatgtttctgtggcaaatgccagcttgccaagaaagaacaggttagtttattttaccacatggaaagatgatcaccgattacagattgcttccctctgcctgcaaatgtgcttaatgcctgtccaccaaaggaaaggcccttctgtttttaatgatttcaaaataacattccatagcatcccttggtaactcattcaaatattttatagtttccttcttctggtaattatatcctcaaatatgttcacatacattaacttataataatcctgtgtagcggccaagcgcggtggctcactcctgtaatcccagtaccttgggaggccaaggcaggcagatcacgagatcaggagttcaagacgagcctggccaacatagtgaaatcccgtctctacaaaactacaaaactacaaaaaattagctgggcgttgtggtgggtgcctgtaatctcagctactctggaggctgaggcaggagaatcgcttgaacccgggaggcggaggttgcagtgagctgagatcgcaccattgcactccagcctgggcgacagtgtgagactccatctcaaaaataaaaaaataaaataaacaaaataatcctgtgtagcaaggattatacctattttacaattgaggatatgaagaaccaaagagggtaactgactcgtcaagattgcacagctggttagtagcagagcaagaataagaacctgatttcttggctcctattaaaaagtcaaaaaataacagatgctagtgaggttgcagagaaaaagaaatgcttatatattgttagtatgagtgtaaatcagttcagccattgtggaagacagtgtggcaattcctcaaagacctaaagacagaaataccatttgacccaggcatcccattactaggtatatacccaaaggaatataaatccttctatcataaagatacatgcacacattatgttcattgcagcactattcacaatagcaaagacatggaatcaacctaaatgcccatcaatggtagattggataaagaaaatgtggtacacatacaccatggagtactatgcagccataaaaaacaagatcatatcctttgcagggacatggattgagctggaggtcattatccttagcaaactaacagggaacagaaaactgaatacctcacgttcttacttatatgtgggagctaaatggtgaaaacacatggacacataaaggagaacaacacacactggggcctatcagagggtcgagggtgggaggagggaaaggatcaggagaaacaactaatgggtactaggcttaatacctaagtgataaaataatctgtaaaacaaacccaccatgacatgggtttacctatgtaacaaacctgcacttgtacccttgaacttaaaataaaagttaaaattttttatttaattttaaaaagaacctgattcttcggattcttggccttcttcagactcctggtctgactaatgatgctctgggaacctccacatcactagcagaataagaaccagtgttaagatatcagcaagaacacaatgtttgtctcttggtgtacaggaggattggttccaggaccttccacagatactaaaacccgtggatgtttaagtccctgatatgaaatggtttagtatttgcatataacctatgcacatcctccctcatataccttaaagcctgggtatccagttttttggcttcccagggccacactggaagaattgtcttgggccacaaataaaatacactaacactaatgacagctgatgagctaaagaaaactgtgaaaaaaatctaataacattttaagaaagtttatgaatttgtgttgggccgtattcaaagctgtcctgggccacaggttggacaagcttgctttaaaccatccctggataacttatgataccttacacaatgtaaatactatgtaaatagtttgttttacaatattggtttagggaataatgacaagaataaaaagtctgtacatgttcagtacagatgcaatattttaaaaatatttttgatccacagttggttgactccatggatgcagaacccacaatacagagggctgactgtatagccatgatagtttgcttaccaagtggatcaaaggccaaaagtccccttgaggacaaccatttcattattgtcatccctacatactatcgttcccagagtgttcctacagtagaaagccctactaaaaagaaaagatacaaaaagcctagctgaacattaaaatcaccttaagatcatatgctgatccatgaaaataaaaaataagacaagagtatgtggtttgctgctttctaacttctctatttttacctctgagatagatacactcagaataaattgaagaaaatgaggcagaaaaaaatttcctaatatcctaaaaaaaatgctttacccttggccatgaacttcctttccccttgaggatttcatacctctacctcccaaagtttctaagggagccaagggttagcattttaaacatgggtaaagagtgaatcccattgctttatatgcttgacactcagaaaagcacatcagggttacaacacagtcctctggcatgagccctcccaatactaaaccagcatgctgttcaagtgaaaagataaatggagttttccttataggatttcttacaagatttcttttttaatattagctagagccaggggaatctgaaggcaggctcactcaatgggaacaaaatttctctctcatctcttatgactgatattaccaaggttaaatacatatgtcctgaaacacacttttaattatggccactccaccttactacccttgttaaagtcaccaatgacttctgcattgctaaatccaattatcagctctccgtctcatcttacttgtcctataagcagcctttaacatggccaatcactccccaagtcctcttcttcttcatctatagtcacactcttggtgacctcatatgggctgcaaataacacctataggcagatgactcccaaatttatttagccagcttaggcctttctccaaaatctcatacttgtttatctactttcattacattgattcctgtaaaattcaacacagtacattcaaaactaaatccttggtactctctccaaaacctactcccttacagcctcccatctcagtagatggtaattctatccttctaactactcaggccaaaaaatccacagtcaatccgccaggatatcctgttggctctgccactaaaacatatccacaatctgatcacttgtcattgtgagacaccatcacactatcatctacatctcaccttgattattttgacagcctcctgacaggagtctctttgccttgcctcactacagtctcttttcttttcttttctttcttttttttttttttttttttttttttgagatagagtctcgctctgtcacccaggctagagtacagtggcatgatctcagctcaccacaacctccacctcccacgttcaagccattctcctgcctcagcctcccaagtagctgggattacaggcacctgccaccatgcctggctaattttttttttcttttctttcttttttttttttttggtagagacggggtttcaccatgttggccaggctggtctcgaactcctgacctcgtgatccgcccgcctcggcctcccaaagttctgggattacaggcatgagccaccgcgcccagctacagtctctttttcaacaggaccgacagtgatccctttaaaatggaagtcagatcatgtcactcctccatttaaaaccctctgataactgcatttcctttagcataaaacccaaatccttatagtggtttatatggccctgcataatataatctgcaacttcgttttctatttttctctctcctgctctgttctagctgctctggtctgtcattcctcaaattcaccaagcacacttcctctttaggttctttatactggctattctgcctggaatggtcttgactcaaatatcaaaagagctaaatccctcaccttcttcaatctctttgcttctatcttgccttctcaatgagtatttcacttaccacctttgtaaattttaacctccccctcccaacttggcagtcctgagtcttccttattccgctctaactttttaatttttcttagaaacgtatcactttctacacatattgtatagcttacttatttattatgatgatcatttattttctggttttcctctctagaatgtaagctccatgaaggcagggatctctgttttgtctaagtgcaagaacagtgtctagcacatagaagatattcagtaaatatttgttgactaataatttgtaaggactaataattccttacatttttatagcgttttatgtttctagtgctttcacatggtatcccatttaatcatcttaattactatatgaggtgggtagggtaacacagaatttatctccatttcacatttaggaaaattaaaatccagagtagtaaaatgatctacccaagagctattctacatagctggaatgtggtaaaaccagaaacctagttttgtaccctttttctgtagcctccaatattatactgcaaagcctgtagtccttgaggaaagaccttccagattctttgttaggaaggggacatgccctgcttgtgccactaacccagtgccttgaagcttaatgtgtttcaccagcaaatgcgaagtcaatcaaagacctgagcttatgtggggaatcaccttgtgaatatgagagaaaatgattcccaaatggcactctctccaagaaagaaagaaagcaacatttgaatatcccatctacttagtggaataaattatttgtttcttcctaactagctctgccttcctctggcattacccactaaaccaaacagttctccaaagcaatgtaatagcataaagggagatgtgagagtccaaaaaggcatctgcaacataacatatatcccagtggcctctttcactgtgccaccatctaagccactaactgcccatgttgaaagctttgccccattgccactggcacatgcaaagagtggagactgtccctttaaatgtaccaccaaacaggaagctggtatttacttggcaggggaagaacaagatactttcatgcttggcatactgctaccattggcatctaacccagaagctgctgcattctgcaggggtggcaactattttgtcctcaggataacatagtggaagatgcagctatatttacatacaggctttttaatagagatgcctgtcacccctggtaagctcacaggaggcgacagaaatggcacagtcagaaaaaggcaagccaagtcctcggtaccttctggcaattgaatccacagtaccagagagggaggccttgatctctttctttggcctccagaatgtcattataccaggggtatatccagaaaccctctgaagtattactgaatagaccaggtttgtcttcagtgcccttgtcagaactgtcttttccaagatcacgccaaatcgagtggttgaggcttgaccctactaagtcaactctgctgcaaggctcaacaaatatcccataatgaaacagcatgcaacaattcaataaataaacctcaggctgaaaaaaaagaagtgtcaatgcaagcataatctaccaaacacttaacagattttagataatacatggatgcaaacatcactgaaacatgaagaaacatacaacaaccttggctacatgggtatgtactgaagtatctgacactgaggaagtaggccggatggaagaaaaaacattattttattttattgacagagtttcactcttgtcgcccaggctggagtgcaatggcatgatcttggctcactgcaacctccacctccggggttcaagcaattctcctgcctcagcctcctgagtagctgggattacaggcgcccaccaccatgcccaactattttttatatttttagtagagacagggtgtcaccatgttggccaggcttttctcgaacccctgacctgaggtgatccacccgtcttggcctcccaaagtgctgggattacaggtgtgagccaccatgcctggcagaaaaaaaacattatttttaaggggaatattggctttggaggcagagaaacctaggttcaagtctaaaagttttcttgccttagttcacttaagctcaatatgactcactttcctgatcagaaataaggatgatgacaataagcaagtattaattttgtgatgtagacaatgtttaattatggggagatgccctattgatttagtttgtaaaaaagtgtggcttttgagtttaaacatagatttaaactgcacttctgatactaattgtatggcattgcagaaggtacttattctctctaaacctgagtttattcatttatattttgaggatgatgttgacacctatctcaagtggatgccataataatcaaacaagataatgttatgaatgtgttttataagccatgaactccaagacaaagaaaagttttctttttttttaaaaaaaaaaaaaccctttgattagagtggccaaccaatctgattttccaggaataaggggttttccaagacccagagttttcaatgctaaatatagaaaatcttaggaaaactaggatgagttgggcactctagtcttgaccaacctttaattaggccaatgtcctcactagaccttaactgggatgactaggtcctaactagatttaggccctggctctgccttaactagactcttactaggacttaactaagcttagtcctttctagacctaactgggttaaataggccttaaacaggcccaggcccttgctacacattaaattagaaatgaataggccttctctagacttaggtcctggcaatgccttatctagactgattagatattaactaggcatagtccctggctaagctaactgggctgtggctaggacttaactaggcataagcctggctccaccttcactgagttgactaggctttaacaaggcttaaggcctgcatttgccttaactagactctgactaagctttaactaggctttggccctggataggccttaactgggctggccagatcttaactaggatgactaggccctaagtaggctcaaactctggctagaacttaactaaagtctgaccacagcttttctaggcttagaccttgactaggccttaactgggtccaggttataccttaactaaactctatgtctcctctagacttatgccctagataggccttaaccatgctttgtctaggacttaagtaggcttatccactggataggctataactggactaattaagccttaactaatattggcccttgctagtctttaactgggctgacgaggccttaattgtgttaactagctcttaactagtctcaggtctttgctctactttaactagactctgactaggccttatctaaacttaggttatgactagaccttacccaggcttagtccttggctaggcttcaactggcttctgactaaaccttaactgggctttggccctggttaggccttaactaggatggctaggtttaaactgggctcaggccattgctacactttaactatattttgatgaggccttaaccaagatggctagcctttaattaggcttgggccctgggtatacctttaaaagactctgtttacgccttaataagctagggcctggcactaccttaactagtttctgattaaatacttaagtagatttaggcctaaactgggctctgactaggcccctaactagctctgactaaatataaactaggcttaggacatgaatagtccttaaaaatactctgataataccttaaccaagtcagttagcttttaattaggcttacactgtggctgtaccttaataaaactctagccaggccttaaataaatgtaagccctggctataccttaactagtttctgcctaatacttaactagacttaagccttacctaggctctgacttcaccttaattaggcttaagccctgactaggccttaactgggctctaacaaagtctaatctagtgttaggtaatggctaggccataactgggctttgactcacacttaactaggctgaagccctgcctataccttgattaggcttcattacatcttaactaggcttaggtcctggccaagtcttaactaagttctgattaggactaaactatatttatgaccttgctaggacttaagtagactaggactacaacataattaggcatagaccctggctagggcttaacctggctctgactagacctaaattaggcttaggccctggctagggctgaactggcttctgactagacctaacctaagtttaggcattggttatgctttaacaatacaccgatgaggtcttaagcaagctagctagcttttaactaggcttagtccttggctatactttatcaaaattcggacaggctcttaactatgtttaggccctggctaggctttaactggcttaactagacctgaattaggcttaggctctagctaggtcttaactgggctaactaggccttaactaggctaaggctttgactcagtcttaactaagttctgactaggactaaactatacttatgatcttgctaggacttaagtagactgggactggaacttaactaggtttagactctggctagggcttaactgggctgactaggcattaactaggcattggccctgaataggtcccagttgggctgactagaacttaactaggctctgactagaccgaaattaggcttaggccttgcctagggctgaattgggttataactggaccaaaactagacttgggcaacaactatgctttaacaatatcctaatgaggtattaaccaagctaactagatttaactgtgcaatctagaccggaagtaggcttaggctgtgactaggtctttttttttttttttttttgagacagagtcttgctctgtttcccaggctggagtgcaatggcatgatcttggctcactgcaacctccgcctcccaggttcaagcgattctcctgcctcagcctcctgagtagctgggattacaggagcatgccatcatgcctggctaatttttttatttttggtagagacggggtttcaccatgctagtcaggctggtcttgaactcctaacctcaggtgactctcctgccttggcctcccaaagtgctgggattacaggcatgagccacagcgcccagccggctctgactaggtcttaactgggccgactaggacttaactagacttagactctgtctccacctaactgatatctgagtaggccttaggtgggcttagcccctggtgagattgtaaccaagctgccttggcattaattgggctgagcaagccttaactaggctttggtcttggccaagttcatggctagagcttaactatgcttaagcctcaggtaagccttatctaagctgaggtgctggctaggccttaaccagaccttggccttggccttgtcttgattaagctgtcatcagaccttggctaaattgcagctactctttcgtaaggatcacctcaataatatactacctctagccctcagctcctccagtttgtatctgccattacctcagttatcctgcagtttcaggccgtactctgggtcataaagaagtcagagacaagacccctaccttaccatactgcaacaggaaacagactgcttgtaggctctttgcagccagaggtacttacagtataaaacaggaagcaacccctgaattgacactcccaagaaaccagggggatactcttttatataacactccacccagaattatatttttatttcagccaatgagaatggtctgtaaaacttcttccaggacactgacattttgtaataagtttgtaacaaacttaaaacataacatagcattcctgagtacagtacagcagcaggtgactttacggcttttgcccataatgtgcaattggcagtttagaagagagatcttcttacctaccttaccacactgcaacaggaaacagactgcttgtaggctctttgcagccagaagtatttataggataaaacgggaagcaacccctgaattgacaccctcaagaaaccagggaacactcttgtatgtaacaccctacccagaagtatatttctatctcggccaatcaaaatggtctgtacaactgcttccaggacaccagcattttgtaacaagtttgtaacaaacttagaacatagcattcctcagtaggggaggagactctactgcttttgcccttaatgagcaattggcagtttacttaccttaaccacactgcgacaggaaacagactgcttatagtccctttgcaaccagatgtatttatagtataaaacagcaagcaaaccctgaattgacacccccaagaaaccaggggatactcatgtatgtaacactccacctgggagtatatttttatttctgccaatcagaatggtctgtgcaacttcttctaggacaccgacatttggtaacaaatttgtaacaaactgaaaacatagcgggccaggcccagtggctcacgcttgtaatcccaacactttgggaggccgaggcaggtggatcatgagatcaagggattgaaaccatccaggccaacatggtgaaaccccatctctactaaaaatacaagaagttagctgggtgtggtggcgcgtgcctgtagtcccagctactcgggaagctgaggcaggagaatcacttgaacccgggaggtggaggttacagtgagcagagattgtgccactacactccagcctggtgacagggtgagattctgtctcaaaaataaaataaaataaaataaaataaaataaaataaaataaaataaacaaaagaaaatcacaaaacaacagcaacaacaaaaaaacatagcattcctaagtacagtacaggaggtgaatctacaggttttgcccacaatgtgcaattggcattttagaagagagatcaccaatgcactagaattgcagtaacgggagtgtaagcttcaccaagctgaactttgagcatttgtagaacctatgaactctccacagttagttatcagttccattgtgaggaagtagccagtctgatatatgctggcttggcctgctataagatactgaaatacttggttaatgacccaacaacaggatgataaatccagaccagagcataggtagtcattcttgtctattagcttcatggattcctagtgatgaaagactggtaattggttccaaccttggctatattatttagtttgggagcatgtatttgtatatacatacacctcctagtaaaatgcatttgattcattgcacattaggagttcactttggcccaactaatcatttttgtcatctgtaccaagttataagttaaacttacataggcctgtacagtcctattaaccttttcaagtacacagtgacttaggtatcagtcctgcatggactaactgaagtttgtaggtactattcagagcaaagcaggtaagcagctctgttcacaggacagtgcccagacagggcctgtggctgtgggatgtaaccagtctttacattaagctatgtatagcagtatgtcaaaagaactgatctgggcaccagaactagaaagttaacacattcattcattcatcccacaaatatttattaatcacctactgtgtgccagatattatcctgagactgggaatatgatggcaagcacatatagacacaacccttaacctaatggagttctcattctacaaacaaaatcaggagaggatctgcacagccatgagttgaagcctagattaaaacaatctgtatgctacagggcaaggacagatgtgataggcaaagcctacaacgacagaatagctgtaggaaaatagccatgtggttaaaaaaaaaaaagcagcaacaaatgaatataatcttcattttaaaaatatgaaaacagagatttttcctaacatcaccaccaccactaccacgtcattctgagaaagtcatttatattttttggtcttcggttcttccttctataaagtggaatcacttacccatttgagaaaaaaaaaaatgaagaggaacttgactagataagtaaatcctaaatcacactagcacaatggataagagccacaggctttagagttgaacagatgggggcttgaatctcagctcttgtcaccttgtagctatatgcccctggcatgatttaacctgaatgagcctcatatttctttctctgtaaaaagaggatagatactaatcatgcctatctcgggctgtcatggggacaacacctgagaaaagatggaaaatgcttactgcaataaattgccatgctctgttaagaaacaggaagaatgagctatgccttgcacaacctcgattctttttatttggatgcatcactctttagtgtcttaagagtatttagcaggtacttgataaagatgtgctgactggtttattggacttcaccatagggcagtaagaagattcaagggcaatagcaaggaccaaagcctggaaaaggtgagagatcagggattttacttattctcactcctagttcagcttaacccacatccattcattccctgtgaccataacaaataaacatcttcctgggaccacaggccccattgggatgatacataaagtctcaggaagacatttcaagttcaacctgaagaacgagagtcaacgtctcctgagttctctgctctgaatgagcactgaaaccttctctaccttttttttacaaccctctctttttctgatgtctccattctctggccagtctctgaggaggctaccagcagagttacaatctcatatttgaaagatgctttgaaaagaataagtattattaactattagttgcactgtatgaacaaattcataaatacttcccttattgttgcagaaacattacacaccgctgctgtaactagacctctttctagcttaactttgatattccggatcataagggaagtatgttggcattgtttcagtacttgctgtttaagtgcaagtatggagccattcactcactccagggagaagcaaagaaaagaatgcctttaagggtctcaaaattgaaaacaaataaccaagaaggttacacatgtctttctgtaggctgtgaactgggtaatagtgtttctcactcaaggaagaatttggattgcccctgctgaaggacaaagggataaacagactaggcccagatcacctaaagcagttgttctcatgactgatttccctctccaccacccctccacccacccatctgcccatcaggagcatttggcaatgtctggagaggcttttggttgtcacgattgaggggaggtgccattgtcaattagtgggtagaggctggggaaatactaaacaccctacagtacacagaacagtctccaagaataaagaattatacagctcccaaagccaatagtgttcaagttaagaaaatctgacctgaagaatctttccatcctaacaaccagcaaatatttctgaaggtctttcttgtgggcactgtggtttactaaataatccatagtctctgccctaaggaagcttagagtctaacagggagatcagccaatcacactgaagcaatcaggaaataatgcagtatatcacttatcacttagttttttttttctttttctttttctacagtgtggtctagcctctgggtattataggagcatttttaaattttattttatttttaattgacataattgtatttatttatgggatacaatgtgatattttgatatatgcttacattatagaagggggagaacagcaggcatatgaagttcaggaaaacttccaagaagagttggatcttgagctgatgtttgaaggaggctactactctttcccttctcctcactgctggcagaaagatgaatctaagcttgctgcccatacttctttacttcccactctctatcagtatcttgtattctgatttcaggactccatagaaaattatttttcttaatcaccagaacctatcatctatcctcaaatattaatctacatcaaccctcatcttttaaaaatttcgctctttattgacttctatgacatcatcattgtgttctggtccacttttgacctctcgtggctcagcctcaggtttctttttacagccaacctacataggtaggtgtgccaccacctccagcctgctgcctttttctctctcaccgtttcctcttaattattttattcattcatttatgtcccttctcattccacaaaggatttgcagtagttacaatctcatgctatgcatttttccttaattattataccaactcctatggttttacccatcatctctatataggcaactccccaagctgtgcctctgactctgactctgatgtccttcctacacaccacactacctgcctgatcacctgctgaacaccatccatacatacctcaaatccaacatatcctaaacttgaggtttacccaggacctagttttagcactgaaagttccgtgtcctcggaattccctcaaccccaagcaaaccagaacactaagtcaccacaactaaaatgaactcaacagtgtctgttccaaacccattcttcctcatgagctcctaattcctctccatcattttgtagcagagatatcctccttctgcataaacttcaactcctctttgccttccacctactcatgcaactgattgctagatattgtcaattttatctccaaaatatcttctttaacgtcacttcctttcaacttccactgctctaattcaggtctttattacctctaacctatacaattacagtagactcaatcagtccacctgcctccagccatgctatcaccctactcccatcccttttgccaattcatcttccaaactgcaaagattgatcattctgaaacacaaatgtgatcatccatagatagtatttttctaatcaatattgaagttttacagaatgaactccgagaacagcattaaactcaggctcccaggcatttgagcatgatgactacacaatatgacacctaagaaatgttgttatgaatgactaaaatacacggagtattaatatgagctctaagtgaaagggaaaatcaaaacaaaacaaaaaccaccaccatacccttgagaagccaggaactgagtttgtcggttccagttttgcatcttttcatttcttcagagaagtatatgataaccacagttaaggaaagtaaatattgccagggaattctgggtggtagagactcattaaagccttgatattcatatgaaacagaatcatctggaagtcatattaaacagaaactaaacttgagagagaattcactggttccctcagggcattaggtcttaactgatctgtggccctactccctaattacctctgctgcaagagccataggctttccatctcagactggcaaggaaaaagagaatttacataaacgatgtttatatcagtgacaggaaatatgtatcccacttgaataaggggtacggcgtgcccaatatagattatgaaaaatgaaaaactgccaggagaagaaggcaagtgctttccctagaggagagagagctcatcctttcctctctcaggaaaacttacctatcctctgtcttctctcatagacttgcaagtggtaaattgtttatgaagcaactcaccttaggagtcaggggttgaccttcacagagatattagaaaaagatggctaccagaaacatcagagctgtaatccaaaggcttacctctctaatggtaggaattttcatcacatggtaggtaacctcctcttccgtctacataattaagagatagctcccacctcttcagaaacctcttccaactatggtcctgcagtttttgtttgccacatttgtcttttctagtttttttttttttctccctagcttaataggacattgaaacattgttgtgtttcatttatctcccaaagaccttgcctctgaaattcattatcctttcattttaggtacttcccagtcagaaacacacatgcacacacacacacaccacaaacaaaaacacatcccttctttgtttaatagcactaacaccctccctctccctcaacctgggagatgtgaacagccatggttgctaccctaaaggagttgaggatctaatcagaggcatcaaccaagcccaactaagaacaaagaagtatatctgacagtcattatttttttctacagttgctgcaggaactaggagaatggggaggtcagcataaactgcaatctttaagaaaacatcacattaatcaaagaatggaatcagagtccattgaagtgcaacacaagggaaggattttgaagacaccaaaaaaaaaaaaaaaaaaaaagaaagaaaaaagaaaaacatcacagaactggggactttcttcctgggccctacacatacacacttcattgtggtcatatatggttctggcttaaagcttttaatggcttatactagagtgaatcccctgctgtcagtccccctccaggccaaaaccaccctgttcactgccctgtcctgctaatcctcatacttctacctctggccctaaacttcagtcttttcttcaacaactcaaggcactagaaatgtcatcaagaataagaaacagacaaatacaggtatttggtatttaagtgaacattcactatgtgccaggcacacagccacattctatctgttctcattactactccaagtaatttaactaccatttttaagagtttactatgtgccaggcaaccagaactgtgctaagaacctttcatgaatagtagctcatttaatcctcatagctaccctatcagcagtattattattctcattttacagaggaggatacagaggcacagagaagtaaaagaacttgtccaaaggcatactattaataaatggcaaagccagagtcggacctcatgtctgtcttactccaatgcctacataccagagactatgtagtattatggttacagcagggcccagaactctttctatagagggcccatagcaaatattttagacactgttgaccttatggtctctgttgtaattactcaactctgcataaaagcaaccacaggtaatacataaacaaatgaatgtggctgtattcctataaaacttcatttacaaaagcaggcaatgggctagatttagcccagaggctatagtttgatcacctcaagttagagcactagtggtgtactcagatagacctgggttcaaaacctggctctcaccacttactagacaaaacatttagtctctctgtgtctcagtttcttcagcggtagaacagcaacaataccaccctcatagagtcatcatgaggattaaggattaaaggcatgtctggcacatagtcaacttctcagacagtcattttattaaaagcccaccacatgctggtccctagaaggaaggagaaaggacatggattagaataattacaactctctttaaaatcaagctaccagggcccctacggtcttgatactccacagaaataattactctctcgggattccagctaatttgattctcccttcagctacatgaactgtgttctcttgtgagtttagtttcctgttgcagtcattagcaagaaagtctcttgacttcattatagcttttgtcaggcactgggaaccctatcatggtagaacaggaatctgattttgttattatctgttaggtgttcccttcaggaatgagattctcaccactgaagtcatgcctgtgtcccaagtacttggcatggggcctggcacagagtaggtgctcagtgaatgttgctggcttaattgagctggctacatttggggtggtcttacctggaaacagatggaaaatgacttcttaaaagccatccgagcattgaggatccttcctttctctaccagagaaagacagaatgtgtggtgagggcaagaaaggtgtaggagtgtggtggatggttgcaggggcagggaagaacaggacacactgttcctggttacattaagcacacaggagccaagatgcattcatgtctttaggccatgttcctgaataatcacctggtaaaagccattttgagcaagttttttttttgcttttttatttcaaattttttttatttatttatttggagacgaaattttgctcttgttgcccaggctgcagcgcaatggtgcgatctcggctcactgcaacctccgcctcctgggttcaagcaattctcctgtctcagcctccctagtagctgggattacaggcactcaccaccacacccagctaatgttttgtatttttagtagagacggggtttcactatgttggccaggctgctctcaaactcctgacctcaggtaatccacccgcgttagcctcccaaagtgctgggattacagacatgagccatcacacccagcttcaaattttattaaagggcacacgtgtaggtttgttacatgggtaaattgctcagtgctgaggctaggggtctcaatgatcccatcacccaggcagtaaacataatacccaacaggtggtccttcagcctaagcccccatttctcccctatctagtgattcccagtgtctattgttcccatctttacattaatgtgtattcgatgtttagctcccactcataagtgagaacatgtggtatttggttttctgttcctgcgttagtttgcttaggaattacctccagctccatccatgttgctgcagaggacatttcattcatctttatggcaaagtattttatggtgtctatgtatcacattttctttatccaatccactgctgatgggcacttgggttgattccatgtctttgctattgtgaacagcactgcaattaatatgcaggtataggtatctttttgatagaatgaattattttcctttgggtatacacccagtagtgggattgcttggtcaaatggtagctctattttatgttctttaagaaatctccaaactgctttccacagtggctgaactaatttgtattcccaccaatagtgtgtgtcttcacttctctccacagcctcaccaacatctgttgctttttgactttttaataatcgccattctgactggtatgagatggtatttcattgtggctttgatttgcatttctctgatgattagtgatgttgagcatttttttttcatatgtttattggccacttgtatgttttcttttgagaagtgtctgttcatgtcctctgaatgtaagctttttgctttgaatcaaaaccatgcttaggcaatcttccatctcagctttgaaaaataccctaagatacctcaacttgtcagtcagccctgaaaaagccatacctcctgcaatcctgacttgccaatctttctcaatgaaaaattctctcttttatctaccaagttgtctccaaccctctaaaatgtgtcttgtataacaattcagtttgttcactctggaatttgttagacttatttgtaggatctgactatacaatgaggaccatactgactgcaattggatgtatttctccaacacgttattcctcccctacctcaccatccctaccgcctactaccaccactatcagtctcctttccagaattctaagccagtaattggcatgacagaacataccctcaaaacattcagaggaacaaataatggaaacagtgctgatgcatgcaaactctgtctaggcatgaactaggtattctagttcattctgtgttgctaataaaaaatagctgagactgggttatttataaagaatagaggtttatttagctcacagttctgcaggctgagaagttcaagggcatggccctggtttctggagagggcatttgtgctgtgtcacaacatggcagagaaggtcaaagtcaaagcagacaggtgtgaggaaaggaaagcctgaggggcatcctggccttatcacaactcactttcaaggaaacaaatccatccctgcgagaactaatacagtcttacaggaatgagaactcactcctgcaagaacagccattcataagggattacaccctcatgacccaaacacctttcactaggccctacctcccaataccaccacactggggatcaaattcaaaattagttttagtggggacaaacaaaccatgcccaaaccatagcacatagagtgtgtcaaatcacatatacagtcacttcaagactacatatccagaagtgacaattctacatctcgtaagtcataatgatgaaaagaactaacatttattgagtgctttcttgtttagttcctatagtaatccatcatgaaaaataataacactggcttcctagttgccaggcatttaattaactctcttaatcctcataatgacctcatgccatgagttactattgtaatcctcattttgccgatgaggaaactgagggctggagaggttaagtaacttgcccaaggtaatccagccagggagtggtggggctggaatgtgaaccccaggtcagtctgtctgactgcagagaccaatctcctaaccctaccacactaccttattagaaacatctttgagcatgcagcccacattatcctgttatgataaaaaaaaaaatgcatgaaaatgcctgcttccatctatttggtgttgagaatgtttcaaagcactttcccatccctgatgcatttgatcttcacaacagtcctgtgaggaagacaggcataggcaacaccaccattacatagataaagaccaaacacaaaagcttgccccaagtcccactccacaaatgagagaccaagccagagtcagagttcaatgtacagtatacattttcaaaatgtgttctttggtatagctagggattaagtctcctccacctccttcattctgatttcatcctgaagatttgaaaggaagtgggcagcccacagcaggtcattaaaccctccagccaagctttcctataaatgtaaaaactacttgagtatacctcactttgtcttccacataccccaacccttcaggatctgcagtacctgaccacatcctgtgtcttgaaagaaaaaaaatgagggaccttgacccttaaaaactggacacactgaaggtatgaacatatctcattgtggatttctcactttaaaaacatttattggacaattacaggtccaaaattccaaaacccacctggcaggtgagcaatactcacctggcaggggagatatcatgatcaccaagcccaccaagttctgaaaaccaaagtttttaaaaataaattccctatcaaacctctcatatggcagcaaaacctgacatgcactgatgggaggcaatttatggtgtttatttatcccattgcatctaagcatgcccaggtttcactgctgaaaatttattgtgtttgattatagtagggttgccagataaaacataggacatagttaaatttaaatttcagataaataatgaataatgtttttgtataagcatgtcccaaaattataaggggcatttagttatactaaaacatttttgctgtttagctgaaattcaaatttaattgggcatcctgtatttttatttgctaaattttggaactctaattatgggtgctgcctgaaacctcactgggagtgttatctaatatatggcatagacagcatattactgttctaaaatctgacaaatttagaattccaaaacaaatctgtccccaagagttttgtaaaagggattgtggaccactggacctatagcatcctcccagcactgggcttggtacttcatggggactcagctcccaaagagcaacaacctctcaaagaattatcccatcacaatgccttgcctcttgagctttcattagatttcccctctgctgtctttcataggtcattagcatgctttctgctttgatatatttattcttcaaggtatttcccctctagtgtcctgatttaaactagtaggactgcaacccacagctgacctaaccacactttctatgatttcttacttggctttagtgagtttccagcctctcctgttcaattgctctgacatgctatgtcactttcttccttcctggtaagaagctttccaacacagactcccctttacttccagaactctcctctgtagtaggcagtgagctcctaccaccctctgctgccatctcatggctaggataagccattgcattagtcttaattctgttgcactagttctttttagagtccatcaccgccaacacagaattataacatctgccaggaaaccccattgggctaattctgactgctgtatgcacttgcaaatggaaaattatactttaaaaaaatatgcgttctaaaacagttttcaacctcctccttcaacctagcctcaccttcctccatttagttctaagtagtgaggcttagccctagtttgaaatgaaagatagggcttccagttgactgattttgtgagtctgcacctgtgttgccattgatattggcagcccagcttgggaactaagtctgctagctaattgcaacaacagagccagcttagaacaaaatgtctcagtaatccttgggtaagaacatatcttctttttaaaaaataaaactagccatggattagtgatctgagtgattaaatattaaactgtgctagacagagagtacatgtaaaaggtaggggctatttccaatcattatctggacctaaacttttgtcaaaacctatttcttgatctcaaatgtctgctgcagtggtttacaaaaaaaaaaaaaaaatgctgcactgcttaatgaaagtatgactcagcaagctcactacaatggtgagggaagaaaggtgcttgaacatttcttcctcttcgggaacttttgcattgccactgatttccccttttgggcgtttttctcctcttcagagcccagcttgattggcaactaaaaacaaaactcattctcttgagggtcattcctgtagaggcgggtttttaaacacatccttaacacacaaccggactatcttctgaagaactgaaatctaacacagtacacattgggcccatttctatgtgcagccattcactgaagggagtaggatgcagttcttaaaagatcagtagactttttcaaacctcccagaaaggcccttacctcagatcttactatagccagtaactgctgtttcttcctgatcctcaccttctcctctggtataggggacgactcattctcacccttcaaattttcttttcctctaaatggactaaaggaagaagtgtttacagctgtaagtctcccagctcaaagtcagctgatttcttttaggaaacatgggaacataactcattgccaattactttagagaaccacagacctatactgctttataaacctctgaatattaaacatgtgtcaaggtgacttttctttcagtctcacctattgcacttttttgtacacacctaaaaacttaaaataatctgaaaataaccagttaggtgacttaactgtgaaactgacttgtttttatcctaatgcttttcttgctgatagctttcccagcagggaacagggtggactgagcagggtaacaaagatatttctcctctgaccattgtccattcctaatggagccactggaagcttactgctgtggcttttctctacctcacagcctggcttatttctcaaaagcccatccccacgaccagatcctctgcttctatgaggggactttcccttttttttcattgcctcctcaaggagtggtgactcaattaattatcagggaggtctatctgtacctcattattcttaaatgagcacttaagtacaatgtttgacatccagtagtcactcaaatgttagatgttgttattattactatttaacctctctgagcctcagttttctcatctgtaaaatggatgtaataatagtacaaacttcctaggtttgttaatacatataaactgcttttaaaagtatccaaaacttagaaggttctgtgtacattttatctatgactattaaaacttctattagagaaataatttaaggacatatagactgcaaggtgaaaagagaaacgtgtgtgtgggtttggggatgctacggcggggaagagttgtgtgtggattatgtgtttgaaatatgttttagcggccgaagagaaatgcccactaggcgttaaacattcaggtgtaaattttagcagggacggaatgaagaattttttcactttaacaaaaacagtaaatgcctgcaaagacctttgggggtaagaaatgacatatatagaagtgttcctccacttcctaagcttaccgtctactaagaaggctgagtcactgattctacatagaagtacatgtaacacaaggtaggctctgagaggtaccacagggaaaaagcaaagtggtatgagctcaaggagagaggtcacacctctggctgaagcaatcagggagggcttccagaaggaagtgattttctgatttcattattcaccgcagccttttcttaggactctagtgcctgctgattttttccatctctgaatgctctaagatcccaaagtgtggtgcctcatgacaaagcagtgagcttttcctaaagctaaatagatccagattgaatgactgtcctttattctgtcctttcttttataaaatggtggtaacaggagatcaaaggggtgtgggcttttctcatgtccttacttggcaaaacaatctcctgatttggagaggagtggccttaatcagtctgtgagagccaaccatctgggaacctgacatgtttaccatctgtaccatttatgtgggcgtctgaacacaaacattattgtcctgttacttgtttcgcatgagttaggctagtatcccttcaaaagagctcctgcaggccagaatcatggctggtctctcttgcgatgaccctctcccacaggccacacggagctgggcacagagcaggtactccaaaatacttgttgaaaggcctaaactgaatcacattaatcttgcacttcccttgcagtaagcaagtcaaattctattctgccttgagttaagcatgtgaatcaggcattaaatcctattgatcctttagacagctgtagaaacaaaagtcacatacagtagactggtgaggggctgggaagataattctcttcactgaatgaaaaaattcagaactctgctgcagtgaaatcaaagctattttgctagttttctggcagaggggtggtctctttccagtagaacctgacatttttcctatcaagaaatattcctaggaggggccaagagccattgggcccctccattgacaacacagctttatgtcaaagaaagccagggcttttccaaaagttgtgtgcagtaaggaaaaaatacaataatgttcagcccttgtctgggagtattgcagaactgaagcactgaagagggaaaacaatcaacaactgcagtgaggatcctagctcatttgtgaagaaaagatttagacagattaaacagggggattccatacagatctggcctggggcgggccccatcacttctgggctttgctagccttcaggccccttaactggctaatatgatatacccactttaagctgttaaggtagttgatagttttgtatattaccacttcctacaaacatgaatatagtttcaatgctttaatccaaagaaataaattatgtgggcatttcaatcactggccgcaaggccaatggggaagatactgggaaatttagctttctgcatgcctctgatcataccatccatggattgtcagagagtgcagtgtttgaaagcttggtctatggaatcaaccaagctagttccccagtcctggctccaccatttaccaagaaatgtgaccttgggctctgtcctatcagctgtaaaatgatataattctatatctgccattagcgttgctgtgagatgatgcatataaaaaatccagcacagttgctggcacattataagagctcaatctttgatatgtaatcttccaatgttaagagtagttcctagttgcaactcccaggagacttgtgttagctactggactcctttcacacactaaggaaggaagaatttggaaagagagtattccaccaagatttatccagcacagagctatttattcaatcactcattcatcaaatatctattcagcattcatcttgtaccaggcattttgcaaaatgttgggaatataataaagaataagacaagctcccagtccttgaccaacactcagtcttatagcttttaagaagctggccgggcacggtggctcactcctgtaatcccagcactttgggaggccaaggtgggcagatcacgagggcaagagatcaagaccatcctggccaacatggtgaaaccctgtctctactaaaaatacaaaaaattagccaggcgtggtggtgtgcgcctgtagtcccagctactcaggaggctgaggcaggagaattgcttgaacctgggaggctgaggttgcagtgaacagatatcacaccactgcactctagcctggcgacagaatgagactccgtcaaaaaaaaaaaaaaagaagctgctagaggccgggcacagtgactcatgccagtaatctcagcactttgggagatctaggtgaatggattgcttgagcccaggagttcaagaccaggctggggggggtaacatggcaaaactccctctctactaaaaacacaaaaattacctgggtgtggtggcacgcacctgtaatcccagctactcgggaagctgaggcatgagaattgcttgagccagggaggcggagattgcagtgagctagggaggtggagattgcagtgagctgagatcatgccagtacactccagacagagcggtactctgtctcaaaaagagaaaaaaaagaagaagctgctatattccttaaactttttaagcccctgaggaagggaattcgttgggcaaggactatcatttgcactaacccacacacaaatagaacaacataacttcccatgaaaagttaaaaagttacaagggaaagcacttccagaatggcagagttctgaaaatctacccttccacaaaagctacaagacgttgaaaatttttttaaattaactttcacaattccggaaattaagcaaaagtttacaacgatcagaggagcatttactcaagtaaaacagccaagttttcgaagaaaagcaagttttgtggtattttaatttgcccaattcccatcttcctttccccagctcaacagcagctttgaaaaccaacagccttggaaccatggtagctgtaaaaagcagcagcctggcacccactgaaggggagcaaactgggtttggagcaccccaaatagacccatccccagagaactgtcattatctgtcagtcaacttcgttaagaagcccaattcccaggactggtcttcatgtgatctgactcagtaccaatagttcttttcctgggggcatttgtttaaaaaaatcagcaacagttgtttaatatgaaggctgcctgaggcagtagataacaattgggtcaaataataggctaaagaaaaagcaatctaaatccagcaacatagaaaacgaattagacactatgggccaggtgtggtggctcacgcctgtaatcccagcactttgggaggtggaggcctgcggatcaggaggtcaggagatcgagaccatcctggctaacatggtgaaaccccatctctactaaaaatacaaaaaaaaatagccgggtgtggtggcaggcacctgtactcccagctactcgggaggctgaggcaggagaatggcgtgaacctgggaggcggagcttgcagtgagctgagatcgcgccactgcactccagcctgggcaacagagcaagactccatctcaaaaaaaataataaaaaagaattaaacactatgactgagtagaatttatcccaggaatatgagggtgattcaacataacaaaaatcagttaatgtaatacattacattaatgaaaggaaagacaaaaccatgcatgatcatttcatttgacacagaagaagcatttttcaaaattcaacaaacttacatgataaaaacacatggaaaactgtgaattgaagagaatttcttcagcctgataaaggccatctattaaaaacccatagctgacatcacacttaataggaaacttgaaagcttttcttctaacatcaggaaaaagacagggatgtccactgacagcacttctattcatcatcatactgaagattctagccaggtcaattaggtaagaaaaagaaataataggcttccagtttggaaaggaagaattaaaattgtctctattcactgatgacatggaccttgtacagagaaaatcctaaggtatcaacaacaaaaattattagggctgataaatgagttgggcaaggttgcaagataacatacaaaatcaatcatgttttgttcaacaaaaattatggaaggccattgttttggactgagctcccatactaggccccaacagaccagaccaaaccaaaatggaatcacctgctaaatgccatataatcaaactaaaactttaagaaagcaggtacatccccaaacagaccagtttttcctgaaaataggagattctactccacctgagtccatgtaatatggaagatgcctctgttttaacccttgccaaaaaaagtaacctgatgttaaccgattttttttcccctatgttctctttcctttttcccaccttacaaaacccactgttctgctattgcctagtagaatggaatgtctcattctattttgtagaatggaggcttccctgattcatacatcatgaaaaaagccaattagatctataactaaatttgttgagattttgtcttttgacagtttctatacactagcaatgaacaatccaaaaatgaaattaagaaaacaattccatttacagtagcattaaaaacaattaaatacttaggaataaattgaacaaaagaagtgtaagacttgtacactgaaaaaaaccagaaaacactgttcaaagaaactaaagaagatctacgtaagtggaaagatattccatgttcgtggactagagacttcatattgttaaaatggtaacattctccaaatttttcttacctttatggttaattgactttcaacaagggtgtcaaaacaatataatggggaaatagtagtgttttcaaaaaatagtgccgggacaaatggatatccacatgcaaacgaatgcaattgggcctctacctcacaaaatatgcaaacggattaaatacctaaatataaaagctaaagctatcaaactctgagaagaaaacaatggtgtgagtctttgtgaccttggattgggcaatgatttcttagatatgacaacagtaagtctgtcagattagtatctatgtagcttcagtcaaatctaaccatggattccagttattatactatataaccctataaaatacatagaagtattattactttgcctttataacaaaacccaagagtctgtttcaatttataatttcagcatttaagcgaagagattttagttcccaaagttggggaaaataaaaaaacaataagggaagaaagaatcaggccttggtgccatatatttttctcttgaggttgtaaggcagagtatccttctttccagaacactttattatatttcacttacagacctaattttctgtgtcaaagtataattcccatgccgaagctctaacctaaaaatgcaaaaaaagttgtcttcattgtacaaacatatccatcactttaacgagataataagggaacaaaatttaggattcaagctaagtaagaatactgtttcaatgaacatgtccctaaaataaaccagcattagcagttaatttatgcatctagaaaatctcagttcccaccagtaaaaatatcctcagtggctagtgcaccttgaaaaaaaatctggcgtactaaataaataatgttcatgtgggagccaggagctgggtaagccttgcctttagactactctgtgactataaaaataaagccagcacttttggaactaataaggcttcacttgtcagtatcataaagagtattgctcaactaaactttgctcccaccggttcagtagttacttatttctacctaagtactcatcttccgattttacccaggtatttaaaatcgaaagaaaaaagcattatatttcagcgctactttgcccaaattacaaaataagtcattatttttagtgtcaagtcacaaaaaaaaattaacaggttttacattaaagttaaaagttgctaaaagttaccattataacgtgtaattaaaactgctaaacatgaatttgcatgcaaggtgtataaaaacactaaaaattgtttttcttaaaaattataagaaggcataaaaatgtacattttgcttaaaaataaaaaattgtcttaaaattaaataaaataaagtggatggtttaagcaaattataaagacactataaaaactaatcctgcaaataaaactctgtgtaaacacattaactaaactcaaaagaatattatatgtcttttctgtaaattaaacactaaaataaaagcaccacaaagttttcttaaaatgctaatctactcttaagcaaaacttgtcaagggttataacaggtatgtaaaaatcttacttcatggtcaaactggttaaaattaaacagaattatctataaggtttcattaaaattaaggttaacattaatagcaaactaacacaagggtaaaatttaactttctctcttaaacacaattttcatgtaattgaaaaggctaataaatggtttttggttttccagattgttatctcattttggcaaaacaaaacaaaacaaacaaacagaaaaacaacttatgataatctaaagttctatttcataatatcaagggttttaaattttaaacatatttaacagccttctcaaaatcaaactttactttcaaggttgtttttcctaaccactggcttttgggtgctgcacaggacccctgaaccatccaaaaaagaggtaaacaggattatttggcaacataaaattgcgaaaataatgtctaatacattatattttagggaatattattaacatatgttccaaaactgtatggaatgtctaaggttcttatgtctgaatatgtgctattaatcacaattaaagttgttatgttgggttattgtaagccacaaaaataaccaaatttctttgtcaattgtgtttctaactgtatccaaactggacattttgttatttacagacaattgttattttgttttaattctcttcaaaacattgtttatattcaagctttggaactttaacaaatgctctcaaatgtaggttactcataacaacaacaaaacgtacagaactcataaaaagctaaaatgtttataaacataaagcaaaacaaaggttaataaaatagaataaactaataaaaaaaccaatttttaccttttacttagaacactgctaatctttatctcatttttcagagtcaagaaaacttgtcttaagctagctacagctttaacaactaagtaaagtatactcctgtgaatagaatttaaagcgtgtttgtttctctctgcctagttcctctagaatttaaaaactggctataagtaggccaggcgtagtggctcacgcctgtaatcccagcactttgggaggccgaggtgggcggatcacgaggtcaggagattcagaccatcctggctaacacggtgaaaccccgtctctactaaaatacaaaaaaattagccggtcgtggtggcgggcgcctgtagccccagctactcgggaggccgaggcaggagaatggcgtaaacccaggaggcggagcttgcagtgagctgagatctcgcccctgcactccagcctgggcgacagagcgagactccgtctcaaaaaacaaacaaacaaacaaaaaaactagttgtaggtattcttaaattacaacgatatagttgtttgcatcaatgcaataagaatctattttcttttctaacagaacacaattaaaaaaaaaaactggttactttaccaaggcttttactgcaatggtgtgctctcctttaaggaatcaaacttgacttacggaacgaataaaacccttggaaactggcctcatattttgtgtacatagtccctgtacaggatttctgatctgtagtaagtaaagaatgtcactttctgacaggccaggaaccccaagttatcttaaaaccttaataagaaatgaattcacccaactcataggtatttaatggtacaaatacatggctgggcttggctttaacaagtcttatctcaaattccttctatataacagagttccatcaaagccgatttaaaaggcctgtgtggcaaataattattcttggtgcattgtatacaaataattaagccaaatataataaagcagaccactgctaccataatttgtcttttaataaaaataggaaactgaaaagtaaaaattatgtttcaaaaactatagcacacctgttgttaaattctagtcttgcctaatgtttttcaacttgtattatcttctacagtttaaattatatccattaccaaaatcgacccctggatacatcacactcaagtcaaagcctaaagagctgagaaagcaacctctaacatcccttctggggctaacaatgaaaacgtcctaacaatgaaaaaaaaaatttaagctggaaatcataaaagccaacagaatcatggccatttcgcagacaactatccaaaaacatctacaaacggtgttgctcctgcagtcaatccaagaccaaaaaactttctgctccccccatcagcaggaagtagccagaaagaacacgtcgccccttgtccttttataactgtagggtctggaatgacagagcaggaccaccatcatctcagacaaacaccgccactttaagttccagctgcctttccagcttcatgcatttcaaggaaatcacttcttttctaactacaagcagccaaaaaagagcagacagtaaaacacagataagaaggctggggcacagaggaaggcaggggaaagtctcttgggtaactgccaaacttcaccctcatacaatgggctccagtaaaacagtggcccttaataagcacattcctttcccttcaggtacactaagatagggaagccaaaagcagactcgagggatattcctgcagctgcacaaagatgtaggggaacagacacacaactctccctcccagataagcacaacaaagagacacagaagcagtccaagcctctgataactctcccaccctgaatccttaaaaactcttagtctgtaagagattgctacttctgacctaactcaatcagacgtccctcccaggttggaagtaaacctgttgactgtcgagccgaccttcttgtttctcctctttccttaattcttacaacaacaacaaaaactacaaattggacttcattaaaataaaaacctactgctccaggctctggacagttcgggtttttgtgcaatgaggcatctagtgggtacgcactctgcagtttttcctgtaattcttctttctgaggcgttcttagaatcgactagagattgattaaataatctgtcaaatgtgaacttcactatgcaagcagaatcaggattgtgctttcaaagctcacaaatgtgtttagattagatactacatggtggcttaataaaaatttcctttatcatattctaattgcagtttgttctgccagaatccacaccaccctacactacttctgtcagatataaaaatagaagataaaaacctgtccaactttaaaattgcccagcttgagccaaattgaaaatcagagcagaggcattgaagataaaggttggatgttatatccaccattaaaagaagcttcacttctgcatttgtgccttagcagaaagtgatttctggggttggagtttctgggaatacataaggggaagtcacatgaggtcatcaagaccattgctgaagagctccaaatgtctgtttggttcaggctgatgcagtagcataggacagagtttggcaaactacaatttgctgcctgtttgtgtgaataaagttttattggcacacagctaagcccattcatgtacatattgtctatggctgagtttgcactgcaacagctgagttgggtagctacaacagtgacagtgtggcctgcaaagccacactatgtggccctttacagaaaaatctgctaatccctgccacataacatcagtatttgatgtcaatccggatatctccatttagatgtctcacagacaaatctaatttgacagtcttaaaaaggcatgcacttccataaacctatttcatcttcagtgttccctctgtcagttaatggcactatcatcaccaattcacctgaatgagaagcctccctcccctttacctcccacaccccatccattactccattccccatccatcagcacatcctgccaattctacctcctcactgcatttcaaatctgaccgcatctctccatttccactgccatttccttagtctaagtcaccatcattttgttcaagattgacaacagttttctaactaatctttctgcctctagttttgactgccctctgcttctaatccatcctccacccagtaaccagaaggatcttttcaacatctaaatctaattttcttacatgcataataatatatgtagctaagatttaatgagcccttactatgtgccaggcatagttctaagcacttcgtatgtagtaactgatcttaatcctcacaccaaccctacaaggtggatattattatctccattctttagaggaagacattaaaaaacagagtagaacttgttcagttgcacagttagtaaacaacagagccagttgcaactgctttattatactactttacatacgcacacacacacacacttcttatggcttctcattgctcttaaaatggttcatcctatggtttttttttttttttttggagatggagtctcgctctgctgcccagcctggagtgcagtagtgatgcaatctcggctcactgcaacctccaccttctgccctcaagtgattctcctgccccaccctcctgagtagctgagattacaggcgcacaccaccatgcccagctaatttttgtattcttagtagaaacgggatttcatcatgttggccaggctgacctcaaactcctgacctcaagtgatctgcccgcctcggcctctattattattattattattattattattattattatttgagacagggctcactctgttacccaggctggagtgcagtggcactatctctgctcactgcagcctctgcctcctgggttcaagcgattctcttgcttcagccacccaagtagctgggattaaggtacacgccaacacgccccacaatttttgtatttttagtagagacgggtttcaccatgttggcaagattggtcttgaattcctggcgtcaagcaatctccccgccttggcctctcaaagctccaggactacaggcatgagccaccgtgcccagctgagtccatactatttttaatggccaaagaccatcgtcttgatcttctctaacccctgtttacctctccagcctggtctcttgccattcacagacttgcaatttaagctgcagccaccctgactgctgtagccctccacatacaaggcaggctctttttcacctctatgccttagccatgcgatcctctctgctctggcggtttactctcttttcttttcctctcccacacctagccaactgttgcacatcttttaatgctccagtcaggtatcacctactccaggaagccttcgctaagcaatccagatttgtccctcccttgtgttcccattatgccatgttcatatcgttttcggtgtccttactatacaattgtataactctccttttgtgcttctgtttccctcagtagactgagctcccagcagttcttctactgcaaaggtcttgctttactctgacttttctgtattttcttggacttcatcatcccagcctttggcataggctactgtggcaaaaaaaagagtagaaagggactataggatattgtctttttgtgtatgaatgcgtggaagggaagtgtgaggacataatggagatcatgaacatgtttggaggaaatgacatcacaggatgaaaacattttagagcttatttttggtagtttcataccagtaatcttctttaggacaggctagactccaaaatatataatggctcaaacacaacagaaatttctccgtgacgtaacagtccaaaacaggtattcttattcagcaggctagttctgctaacatggttattgagggacaggggctgacagaagcccctagatcacaccaggttatcacatcccagtcagtcagaaaaggaaaagaacatggaggagcacacataggaaacttctataggccagacctggtagtgccacacagcatttcccacagtgagaagttagtcatgtggccacacctcactgtaagggagcctgggtaatgtagtccagctgtgtgctcaaggagaagaagaatggttgtgctgggaaactagtgaccttcacagataaactaacagtaaagttaggcaagtttacctttggtgttgggtaaatgatgaaagaggtttatttcctttgtactagtaagctaaatggtgcagctctgtttaacctgtcccatgggaagctggggtagtcaaatgtaggcagtatttaaaatcatagttgacagttgagctccctgttgagtcacttaccaggaagtagcagctggataatgatttgcaatgctgatgattccttaattattaatcactgacactttgtagattgcctttgagtaaaatcccagctgggttagtatacaatatcgtaatgccagccccaaaatattttttccttttgcatgtctagactagagacggagttaaatagatggcacagtagcaacctgattcattacaagctaaccaagaggtgctcaaaacaaaatcaagaaaaataaaaacaaaatataacagagaactcattttcatttcaaaccctagctacaggcatgggcttattccctgccagtttgtgtttgcccaaacagagtgcacattgatgatgacctcacgtagactaagggaatgagcggatgtgaatcaatttgaaatgaaatatctccatgattctctgctaaaaggcatgtaagttcccaggagagtttgtaaaacagctacccaggctctactctctcctccatccacaccccagagtctcatttagtcagtctgtggaaggacctggggatttagattttttaatgttccctggatgattctgatgtaaaaccaggtttgaggaagcacaactctgacaaggtgggagggacaataggaaggtatgccaaagcatgaaccagacagagtgattttgttttaatatattaaaaaataatgaacactaaggaaaatctagtttcatagtttgacatgaagagccgtctccggggttagatgcattcacaggcacctagaaaacaggcctcttctggggattggccatgtaactccttgccagagctgactgtaaactaggaaaggtattatgacagtagactttctcctggacattccagatgcctaacttgttttcttcttttcccagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtaagtcaaagggaccaggacctatggccagactgcctgatggtcctgtttaaataaactactagaacaggcagtcagactagctctgaactagggcacccccaccccacccccatgcagtgtggtagtcctttgttgagagtctcagaaatgtagttccttctgtcccgggcactggtccatggtgagattggcagtacacctagggcttgcttttgctaacttaatatcttcaaggacagagaagctgtctgtcagttagtctagagacaaagccaagtatcagtcaggacaggcctcaagtaaggtaagcagagcaagtgctgatcagtctattcaaagcaccttttcccataaccaaggggcacatgaatctgctcatttctcatggctactccacacgacccagttcttgttcagggtctacatcctatttggacactgacttcacaaccaagggggaaacctgggaaattcacacatcatggtaaaagcagccctaccagtagtctccaggcataattagattgcactggactcttcaacacatggccatcttctaagtccttgctactcaaactgtggtccccaaaccagcaatatcagtaccacctgggagattatttgacacaaagaacctcaggtgccacccgggatctgaattttaacatgatcctcaggtaattcacatgtactttaaagtctgagaaagtgcagccctagaccacagccacagcttttactattttctttattccaaggcagaagaaacatctatgtcatcaggtaaaattttacaaaacttctacatgatgagagaaaaaaggaaaaaaaaatgagttataaattattttgggccccattgcctagctttagccccaacatctggtaatttgatccatgatcagcttgctcacctcaaaacacattgagaagttctctttcctgaacccagtggaaactaaggactatgggataatactgatctaattaatttattgatgaaattattcccattccaaaatggaaaggaagtagaatcaggcacccaaaattgcaacagcattccagtaactatagtaaaaatgctaagagtagtacccagaaaagtataacatatgggcattttcaggaaaagcctaccaggtttggcaagttcaaaactgggaggtggagtaggaaagcaagtgattattgtctctcaaggcttcactccactgagaccccaattcattccttaatttcatccttattcacctggaggggggaatccttctatgatgagcagggctgaccctatgtagaaataaactgttttcctccattcttcaggtttcatttggggtgagattaaggaaatgtgggatggtggatttactgaatacatccatgactggtggaacctgatggattttgcaatgaactccctctacctggcaactatttccctgaagattgtggcctatgtcaaggtaaattggaatgtctgccatatttcctacacagcgattttggctacattaagcttttgcactgagagcataaagagttttgagaaaaagtgatgatgatgatggctcaatccatgtgggaaattaccatataaacagacattctttcagtggtttgtaagcagtgtccacctaagcaaagaaagtggaaaatggaacaatttgcaaatgaatcattagcttctgagactttcagggtaaaagagtcttcagctttcggtgtttaaatgctctctacgatatccgtgccaacacaatggcccagtgatgcttgcatggggccagggcagaaaattcactgaattcactatctccaaaagcttctcttaatccttgtcacttcattaaaaaggactactttatatacgtctaatattattctctctgtgacacaatcattagtaattcttcctccctgtggagtcatacagaacaagactgtttcttcctaacagtgcttctgatatgatgccatctctccctaaccctctgagttgtctcttctcaaagctaaacattcccatttatctcaactgttcttcatataatgacaagtagcagaatcccagaaacttgactacaggtggcacagacttttaatagccccttcctttctcatcacttccaccaccagaataatcactcgagcagttataaatccagcatttttagtatcacccaacctgtgcttctctaccaattcagataatgtacacacacacacacacacacacacacacacacacaccaccttaatacttttcccacacaacattcagctcgaattatcctgaaaatagcttcatgtttgacatcttactttgggtaatcagaggctctgagttcaggtctggtgcttattaaataatgggattgctgtcctccttgtagcctgagttaaacttctccatgagaaaaggctgacaattcagtctccaagattgtatagtcagtcatgctttttggcactaaattccacattaaggacttttagaatggaaatatggctgtcccccaaatctccaacaacttagtttatttttgtatccctaatatgcatattgcataaattttaagaccttgggagttatgtagagcatgcatattgaatgcagtcatgaaacatttttgaaaagagcccaagagtaggccctatacatgtggtgatcatttaacacatacttacaacttccttaagagaaaaagctggtgaggaaaatgtttgaatccctggttaatgtgcctgggtgaaatccatgtcattctggcactctgctgactaagtaacactgtaaagtaaagggaaaagttcttcctttggaaatggtatttatacactggagggaccttacattatcaatctagaaattggtgggttttgtttaaacaggaaagcttagaataaatgatgaagaaaaggattaacatttggggatgtgaaaaacgtatctgtagattctcaacattagctaatcacataacctgtccaactttactggagaggcttccaaagagttagatacttctccatcacaaagtataaggataaatctgctctattaagctgggtaaatgccccttaactggcaaacactttattcaaaggagacctttgccaagaagttggagtccttcccaaaaaagaatttataaagcaagacaggccacatgcaaaatttggatttgtaatgagaatttataaatggggataatcaggtctacccatccacagaagtccaggctggatgaccttccccaagcaggctgagccaacttctatgacacaaagccataagaactgcgacataggctccttgaaatgttttcaatcaccattgtactgaagcagtacagaagcaccaaggaatgagctgtttttaaagatcctttattttattagagtgcaaaattagtcaacaatatctattccacttcacatgatctaaagcaagtaccaaaaggtacacaccaaagtactcaaaaggaacaaatatatataagattgaccctcattgcccccagatgattctacaaatggagtataaccattctttgcttttctaggatagtaccacctagatctattccaccactgcttcgcttccatgtgtgccaagtaaatctggactatgctacccactgagttatggcctttccttcagtcagtgcttagctaaagacataataacacccccctcaaattcttattactattgagtccccacattaggctgttcctcttcatattttgctttagggtttataaaatgcaatttacatcctttgaaaggcaaggaggccaattttctaactgcattccatttcaaaggatgtaagaaaaatcatttgcctccaacaacaactaactcaagagtcaggagatctgaatttaattcccaatctgatactcatgagcagggttaccatgggcaatccctctacctttctgagctgtagattctgcctctgataaataagcagtaggttaaactagatcagtggtgctcaaccttttaaaaaattttttcccatggtaccacatctttaagcaaaaactcacacagtaatccaatatataaaaagcccaaaggactgagtttggcttgaagaatgagtcttctaagtctccactttggctcccacagtagctatgagatgcctccattgaacccccaggctctaaggaacacagtttaaaacgactgtgttagatcaggggtcagcaaactatggtctgtgggccaaacctggccttctgccatgtccttgtggttgtatattgtctagggctccattaggattacaaaggaagcattgggtagttgtgatgggaaccatagagcccacaaagccaaaaatatgtactatctgattcttgacagaaagtttgccaacctctatgctagatgagctccatgtttattccctgcacatacatactatatctttctccaaaggtgcaaagtatctatgttcaaagtatagatttgccatgagaatcatgttttacacttctgagtgttccacaaattcagattcaccatcccatgggcaacagacatccctgaggttacagttctggatgaggagagagaaaatcccaaattatgagctatacatgttccagttgttgatttctagttttaaaacataggtctgttttgttatcagcaaagagactatctttcacatatacctcaaacctttaaaggctgatctatcatctgtgctgtgatatcaactatcatataagtaacatttaatagaaatagtgctagactgagtgtctggagacccgtggataacttcttgctggctctgccaccgacttgctgtgtgatctttagcaagtcactctgcctatctggacttcctccatttgtaaaacaggcataaccattcctacccctcacagtaatgcagtgcatgtttgttgggggaggaaaaatgtagaaatataagatttggccaagagtacgtaaaactgattggccgcctaaaagtctatccgaagcagaagcacaaatgtggcacagtttctccaagctcctctgacagagaagaatattggatacacacaagtgattttaaacgcaccagtttcctcagttgttggaactgaagcacattttagaaatgctaacaatataatttggcccccaatgcaacattttctcaggaaagttgtttacatttagtcctgagaaattgtgatatttaaatgtgagctcaaggcaatatgcttcaaattaaattccaggcaaaatctacttctgtcctgggaaggtaataagtaattccttgtatttccataacatctccacttatggagtacacagacttttgcatatggatacagaatcacaaacatgtgcagtgggtaggaggcattatcctcattttgtggtgaaattaaaagatacaggcagttttaagtgacaatgcccaaattggagctcagatctcacaatgaagtcatctttctacaaggctactcctaatatgccgggggctggaaacctgggatgggtaaccaacccaataaatattggttcttcccctccttcaagcccctggttcttcatgtgtgctaaaggaacattctaacttacagagttgtcaaatgaactgtaaaatacaaccatacaccactgtatggggcagtactaaattcattacctgaaaggttgacatgccatttgcagtaatgtagaatacattacagcctgctaaaaattcagcagaaagctccagtgaatggctccctaaggatcctccatcagccccaaactgcagtcagcaagggagtgagaatgaacactgcataccgagaaggctgcgtctactccttgtctttcagtaacagcacgttgtccatggtgctcagagcccagtgagggattgaggaagtacatttggcttgaaatctttaggaagcagggtgatttttccccactatcttgggcatactagtgcctctgtttcagtgacactccccaacaatctgttaaacccacagttagaaaatgtctgttgataagccacaggtggttgctgcagatgattgatctaaaatttattcttctatgtgtacatcccaggtatagacgtggatgggagtgggaggaagagagttgttagcagcacatgttaattgggtggggcaagaaagacaaatagtgtcatgcatggggcctgttgcataatgaatgcttgatgcatattttggtggctttgtttgggtatggaagcaaggaaaaaagggaaagttttataaatgttcactgtacccctcatcttgtgcacttgttgtttctttcagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgtaagacgatcccctttcctttatttatttatttttttttttgccattttttccgccttctccatttttgtcctgttttcagcctacagcttcatcactgccacttgactgtgaaggcagtgctcactgtggatccacccgaagggtcagaggtggaggaatgttcttctcttgctacagggtactaggggatgaagtgaagttaggtgaggtaggaaagaaacaagcacacacatgagatcccaggaagtcatctaaagagttggttctgaactatgttggtagcattacatatttttaaaagaattaattggggtgaggtagataattcctcactcgaaatgtggcaccaaggtaatgaaacagcaaagctattcctctgaacgagtggctaccaaagctaactttactattgtgaatcaaggaaggatgcaaacatatcttaatgcacccccattcataggtgtaatctcgagaggggacaggctgaaggtaggactagaatccactctcctgttacattaatttaaggtttcaggtgggccaagtgtcacccagcactaattggaaatgtctcaggacacaagagataactcatgattctgtccacgagtccactgcctctgaacacatggaactcctgtgcctttgcttagtactgtcaagacctactttttgggggaccttcaagccttcagaacggcttttattttctgataaatcaatgccaggggaaatagacaagagaaaacaaataagtacatgtcaggctgttaggagctgtcctgggctgaccctgaactcagtgttctacatcttgtccatctccacccctacttcgggagagtgcaactcatcactggatattcatagcaatgaccccaagatcatacaagattcttagtcattaaactaagatacaattttttccttataacgccataaaccaacacagttcagtggacttggacattctagaaatgtgctccataacaaaggccagagaaaaaaaggactgttgcagtgatagagaaaaaaacaaaacaaaacaaaacaaaacagtgctatctagctgattcttgttatttgtctctagcagcatttcctaaaatggattctcacaaaccacagctcagtggcatgttaatagacaggagaatggaatctatgattaaacctcctgcactaggccatgctccttgtctctcttcctgaaactcagggctaaatcttgggtgtggaaaccagattaatgtgcaaggagaaggggtccaaaatgggttgacaaagagatagtgctattttggttaagccaaccaggagtgtataacagcagcttatcagctcgctagtgcctgttgactaggaatggcttcctctcctgcattactctagagacagaactcacagcaacctgttttcaacataaagagcaattgtgtagtggcctgagcaccaggagactgcatttgttcccatcaaagtgttcaacagaattagatacatgaatgagaggtgcctttcaggaggtcaggtccttgccaattatgctttcatgtgtactctgctgaggaaatttatgaaatgcctccttgcaagtttgtaatgattattaacacccctgttgccaactgacattttgctcctatcacttgcctagcagggacaattgaaaagaatgggcacctgtcatacataaaattatatcttggggtgtgaagaagcattgtcatggtggggccaaatcagcagtaatgttacctcaactttccctctatcagttgatgttttttcctccgtagaaggttgactcatatttatgttttcttttaaaggcctcaactcagggattcagtcattcattcattcatttattgagatggagtcttgctctgtcacccagactggagtacagtggcgtgatcccagctcactgcaacctctctctcccaggttcaagcgattcttgtgcctcagcctcctgagtagctgggattataggtgcccaccaccatgcctggctagtttttatatttttagtagagatggggttttgccatgttgcccaggctggtctcgaactcctgacctcaggtgatccacccgtctcagcctcccaaagtgctgggattacaggtctgagccactgcacccggcctcaggcatttatcatacctgttaaaatacacgttactcagccagggagatagaaagattctgcttttagagaaggggatagtttgtttatgtatctggtggaaagtttggtacctgcttattgttatccttttccttctgattctccagagatgccattgcttttcttccacataaaaaaagaaaaaaacaggccagtcgcggtgacccacacctataatcccagcactttgggaggccaaggtgggcagatcacctgaggtcaggagttcaagaccagcctggccaacatggagaaaccctgtttctactaaaaatacacaattagccgggtgtggtggcacatgcctgtaatcccagctacttgggaggctgaggcaggagaatcgcttgaacccaggaggcagaggttgcagtgagccgagatcacgccattgcactccactccagcctgggcaacaagagcaaaactccgtctccaaaaaaaaaaaaaaaagaaagaaagaaagaaaaaagagaaaaacaatcttctcctcaggcatacaatttaagggaaactcattgtccttgctgacaaccacatgacagtacagctgggggtttgagtttggtattgcatactgggaatacgtggccttcacctgctgtcaagagaagcaattagaaagacattatcattctgaagacaaaggacttgtgagagaaaaagaagctaatttgatccagccctcatctcctgatgcctcctgaatatacctggctgtttcacaggcccctcaaatacaggatgtccacaactaaattccttattccttttctccgtatcttcacttccaacctatatcccctttaattcctcatctcattaaatgacactaaccagattcctaggagtcatatgggactcttacaccttccctcatgaaacacatcatcaagtgtgtcactcagccctatcagttctacttccgaagtatcccttgaatacctctctctctttctctctctgtctctctctcattctctctctctcacatacacacacacacacacacacacacacacacacacacacacacacactcatcccactgtcttggttcaggcctaaatcatttctcccaaggactgtggcaacagactcttgactggtctctctgcctccaatctggtcttctctccaaacactctcctacttgctgtgcggaagtttctttctaaatacctgttgcatcctggctcccactggcttcatgcctgccagaatatctgaatcttctccataaaatcctgcccctttaccataacacacagggccttggtaatctgactcttgcctctccagtcttttactgctctcctcctttgtcaacattttgctgttctccaactacaggaaagtgtctcagcccttcagacctttgtacatcgcatgccattacctctgaatggaatacccatcctcacctagccagcctggcaaactcatacccatctttccaactgctgccaaagggctacctgctctaaagcctttcttatccactctaaccccactctcagctgcaggcttcttctagaatgcatgtttcccatggcattctaaacacatctccattatgttacataaactgttgtatttcagacatctgtgcctctctctcccaccagactgagactcccatcttagtaagctttgcatctgccatagaggggcctaagatataaaggtgctcaacatggctactgaacaattgagtgaaaagacaaagatgacgtccaaaagcaatcctatctttttaagctttttatttggagataattgtagttacattgtaatcggaagaaataatagagaaagaaatctgtaaatccttcacccatttttcccaggcataacatcttgcatagctgtagtacattatcacaaccaggaaatcaacactgataaaatccagtggcctcattcagatttcaccagttttatgtgcaagccatttgcagcaacatacatgggcctaagagtaatcttgtctttaattatagataatctacttctgcttctgcccaccctgcccccccaggatgactggagtatctggccaactctgtcactctactgatccactttgagcttgctttcagcaaaaacccttggcctttctcctacctctctcatcctgtacttgggcacttggcccaagagcaaagctctacattgatccctatatatttcatcttattagttccagccccttgctccaaggtgttgaagtctttctgagtctttatcctgtcatccagtttattagctttccctctagtcttgtgtcatctgaagatctaagaagcatgccatcgatttccatccaaagcgttgaaaaaactgtcaggcaggcttggtatttgctgggtggaatattgggcagctattaaaatgatacacatgaagactctgtatatacataaaaaagtttctaaacccaaaatgtgtaaatttttaaaaattacagaaagtgggctgggcgctgtggctcatgcctgtaatcccagcactttgggaggctaaaccgggcagatcacttgaggtcaggagttcgaggccagcctggccaacatgaggaaaccccgtctctactaaaaatacaaaaatcagccaggtgtggtggtgggcacctgtaatcccagctacttgggaggctggggcaggagaatcgcttgaacccgggagccagagactgcagtgagccaagatggctccatttcactccagcctgggcaacagagcgagactccatctaaaatatacatatatatatatatacatatatatataaaatatatatatatacacacatacatatatacacacacacatagatagatagatagatagatagatagatagatagatagatagatagagctatagatagatcaatagatcaatcccaggctgggcgtggtgtctcatgcctgtaatctcaacaccttgggaggccgaggcaggtggatcacctaaggtaaggagtttgagaccagcctggccaacatggcgaaatcccgtctctattaaaaatacaaaaattagccaggcatggtggcatgaacctgtaatcccagctactcaggaggctggggcaggagaatcacttgaacccgggaagtggagattgcagtgagctgagattgtgccattgcactccagcctgggcatcgcatggagactctgtctcaagaacaaacaaacaaacaccagagattgtataaactatgattgcaactatgtacaattagacattcaaatgaataataatctataaagacaaaggaatgtaaaataacaaggtggaacgtttaataataataatgaaaataatcaatatttactgcgtgctaggaacaggcactattacaaatcagcttttcgtgaattaactcatgtaatcctcactgccatgctatcaggtagacagtgttgttattatccattttacagatagggaaactagagtacaacgcagttaatcaggctgtcccgagttgcatagatggtaagtagcaaagacaggatttcaatctaggcatacaagctccagtctgtacttttacctagggatacaggtgtaagactggttttgtaaaggtacgtaagatttgttgtatacagctgcaataatcatgaacacacgaaaagcgaaaaaggacagagccatgacctagcaggccactgtgacctccttcaaggctattaccattcatttgcagctacttctacttaatcagtggtgatttctccacccatcattcagccaatattttcctatcttgttaacatggatacacacgtagttcccatcaaacactcttctttttgttctggtcaggtcataaaggttcttattggttatctctggcttttcctcctaattccagtccatatccttcctgatgctattatcacaggatgctgctactcgtttgtacttttcttggttatgtgtttctcctgtcatcttttatagactccttcaataaacatttcttcaacaattcctatgtaccaggcaatgaggataccaaggaagatggaatccttatctttaagaagttcatagtctaatggggaacgcaaatgaacaattagaatagctgctattattaatgcttaccatatgcaaagtactttaaagtgctgagcactttacatgcagtatcttaggtgatacagttataaggctatgtgtgtgggcttcagagtcaaaagagctgggtacaaactctacctctgatactgcctgcctgtgtgaccactctgtgcctcagtatctcatctgaaaaatagaagaacaatagtctctactttatagacgtatagccaaatataatatagtcaacccttcatatctatgtcttttgcatccatggattcaatcatccgtggatcaaaaatattttttaaaaaatgaatggttgcatctgtactgaatatgtacagactttttttcctgtcattattctctaaataatacaatatagcatttacatgctataaatataaatatagccatttacatggcattctcattgtattagctatcataagtaatctagagatgatataaagtatatggaatgggccaggcatggtggttcatgcctgtaattccaacactttgggaggctgaagcaggaggatcacttgaggctaggagttcaagacaagcatgggcaatatagcaagacacctgtctctccaaaaattgttcttttgtttttgtttttgtttttgtttgagacggagtctcgctctgtcacccaggctgcagtgcagtggcacgatctcggctcactgcaagctccacctcccgggttcacaccattctcctgcctcaacctcccgagtagctgggactacaggcgcccgccaccatgcccggctaattttttgtatttttagtagagatggggtttcaccgtgttagccaggatggtctcgatctcctgacctcgtgatccacccaacttggcctcccaaagtgctgggattgtaggtgtgagccaccgcattttgaaaaaaattagctgggtgtggtgatgcatgcctatagtcctacctactcaggagactgaggcaggagggtcacttgagcccaggagttcaaaactgcagcgagcaataattgtgccaccacactccagcctggacaacagagtgagatattttctctaaaaataaataaataaataaatataaaaataaaaatgaaaaagtatatgggaggatatgtgcttacgttatacataaacactatgccattttatataaggaacttgagcacccatggatttgggtatctgtaggaggtcctggaaccaaccctttgcagatatcgagggacaactgtatatgcaaagcacttagcacaatgcttggcatatagtaagagcacaataaatgttagcaattagtatttatcttaccaagaatcatttttgagatgaggaaaacttgaagttgaaagaggctatgtaactttcccaatgtcatttaataaatggcggggtctaaagttctcgcttaggcactctcctctattgcctctacagtgtgatttgtgcatttatggaacaaggcttgggtgctatgggagcaaaaaagaggagcatctaacccagccttgtaggaaaggagttggggcaggcttctagaggaggtggggcttcaactgagcctcaaaggtcaaacaagaattagacagaaaaggagaaaggaaagaagtagaagctagaggttggggcaaggtgagggtatcctatccagagacaggagcttgtcaaaggcatagtggaatgagaaatagcaggtccagggaactgtggaatgggtaagggtgataccaaagggtcacctgtgttgggattacagcttttgctccatttaggctatcaacatacaacttgggaaatataggatgatgtccctgctttctcccaacaagcctttaacttcgagttcaccctctagttcttctttgttggtctgaattaggtccagagaagtaaatcctctccatactctttctactttttgaaagggtaattcctcatctcaaagatgagactttcggcaaatattcagaggactgagttcccatctctgttctactttacccctcttagctttgtgatctatttgtggatggctcccaacatgtgcaagttctcccttaaccacctgttatggatttgtcttctgtgcatttaatatcaagttttcttgaatctttgtatcttcagtctatgcctcttcttgagctagcaagttccatatgtttgtttactctctgctaaataaaaatggactagttgcttttttctaaaataatccctctttaaaattgaaaagatagtcctttgttattaagattccatggtttgtcaacaagtctttccatccctgtgatgactttattatagacccagcaccaagtagtacacccccaccaccaccagtggtggccctttccctgtgtattaaaccgagtctagaagccacagaacctccagcagatgtctcaccagaatattcttttccacctcacatgacagtccctcattttacctgggcatgcttttcagcaggccagcttctcctgatgaccggaccacactgtaatattttgaggaacatgttgaggacattctcactaccaaccaccaaaacggaggaatgatctttcctatccctccccattttcccctgttgtacaattttatccataacgtttccctgactagaatatcagcagagttgaaggcagatttatttatttatttatgcatgcattctttgtttgtttattatttatttatttactcatatgtagagagagacagggtctagccctgtcacccaggctggagtgcagtggcatgatcatagctcaccgcagcctcaaattcctgggctcaagcaatcctcccacctcagcctcccacgtagctgagactacaggcacatgccaccatacctggctttttttttttttttttttgataacggggctttgttatgttgctcaggctggtctcaaactcgtgggttcaagtaatccttccaatattgcctcccaaagctctgggattataggcatgagccaccatgcctggctgagcgaagattttaaatgctcagacttttacttttagggaacgtttgtatctgtcagtggaacaactagcaataaactctatcctcaagcataagccattgcaattttaattgttgtaggggtagaggtgaaggtaacatctattcaggagaagcaaccaattaactaagactctaccaacatattgattacatatttgccctagtttgtggccttattgtctgtcaggaaatcaacaaacacttactgaatgcattctgtgttcaaggtcattcagcttccagggactctggttcctcagaatgacattcctactcactgcagctgctctttaaaattctgaactacaatctgccctggcttctgttacctagcagctgtgctagctgcttgtgctatttactgctggcctcctgcctgcctgatttctggtatctaataggcatcatcaggtgttgactgtgccctcctagcaggggccagattacttagccccatgtcttcctcatttttcaaccctctgcctggttctgcgatgcattgtattgcctggccctggctggtagagtctcctgaaaatttagatcctgtgataggtctgacttgccatattgtctggttcttgtgccctggcccctgaactccagactctcatcttacttttgattctcaactgcttcaccagctggcatttactttcaccaaacaaaaagcaaatttattccttttaggctagctctctagcagcgtgatgctgaaaagatcatggaatttatctatgataatcagagaagagccacttagcaagttgagaagggccatgtgcacattgcccaggcagccctgaaaagggcccttgagagtcaggccagtggagagcacagccttaaacaaaataaactagccctttttgtgcagcctactgactgcaaaattgtcaatgggattggaatcttctccactttaatctaatgataacagtaatagtaatagttttcatatattcattcatttcttcaataaatgtcatttagtccctattatgtgccagctacctagcagctatgtctctgcctccatagagcttacattatagtagagagggacggaaaataaccatttaaaccaaaaattacctaatataattttatgaagcttcaagtgctacaaagaaaattaaacaagacaataggatagagaaaaactgatggagctacattaggtagagcaaccaagaaaagcctctctgaagaagtgacatttgagctgagaccttgatgataagaaggcagctgtgtaaagatcagggggcagagcactttcagacagagggactccttaaagtacctctcacccacctctaaaatgaaccgaagaacaaatccctaagactctcaaaatacattgtgctcattaagaacgacacattttgagcacactgaaaaatgcatccattcttaaagtagcatttcttatgttctgcatggtttccataggcttgggcaatggctaatctctgccacccacgaactggctgcattttattgctgtattcagatttctgaatataaagcaaaagaaaccctagacaccaaaaggatatcattgcagttacatgtttggatgtgaagtctaagagaggaaataataatttgagaagccatcaatatagtggttttggaagggcagacagacctagatttgagatctggctcaaaacatactagtaaggtgtccttgggcaagtcattcagtctctgaatctctgtttcgtcatcagtaacaataaaattttacaaggatcataatgataatgtatgtatgtaaaagtacctaacatgcttataagttctcaataatagttgagttctcaaaagcctcaataacagttggttaatatatcattaacaattatctgtataaagtgttaatttgagaatcctcaagctcctccatgcagtttagagttatctgggtcctgtgagagccacaaaagaagtatcagaaatggtaatttgttctcatgttcactcagccagcaaatgccagaactgagatcctaacccagtgcaatctaacccaagcaccattctcctgcctcagcctcccgagtagctgggactacaggcgcccgccaccatgcccggctaattttttgtatttttagtagagacggggtttcaccgtattagccaggatggtctcgatctcctgaccttgtgatccacccgcctcggcctcccaaagtgctgggattacaagcgtgagccaccactcctggcctcaagcaccatattcttaaccactgcatgtattgcctctgcataattagaatggtaaaaaaataacatggtctgaagacaaaagacaaagtttggtagaggaaatagctcttgaaataagccttgaaaaattttaggctatgcatacactgagaagagggaatggtatttcaggtagaaaagcaaagcataagacatagaagtggaaacaaacaaacaaatggacatggatggtcagtctgtgttagggaagagcccaaaatatgtgagatcaccagtttatctgtcacagatctggcagccccttcgttaagcagatcaccttacattttctctctcttttcttgctcttcttaaagaattaactaacctgctctttgatctcttttaggctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgtgagtagctttgctttacaagcgtgcttactttggtttcaggttggggcaacatcggcatagagttcattagaagctcaatgaaagagttcgtctgcctcaattaatttacattagctttcctagttgttagactgaattatttctttccaatgcaattcaggttggactcttagtctatagactcttcatcatctaagttattcgagtgaataagattttctagctacttattgaaaatatttctaaatttcagaatcaattttcttgcctcagtggaaaactcagggtttgagcacaatttggctacaacgtgtcacctcactcatctccagggttaattcagctgatctggttctctaggcaagagagccctatctccctattcactacaaacatctccctctgaaaactaagaatcccattgacaaggatggtcttctgagagagagacagagaggggagggggctacgttttttcctattttaaaaaatagagatgggctcctgatatgttgcccaggctggtctgaaactcctggcctcaagtgatcctcccacctcagcctccctaagtgctgggattacaggcatcagccactgcacccagccagtggctattttttaatcaagtatatataagtaactgcactccattgcaaggcactcctaagtacagtccattgctgaatttttttgcaccatcatgttaccatttagatcagcagtgtttattaccctagactagaaatagtgaaagtgtaggatacaggatcaatttagtccctgccctggttttttatgtcaaagtagatatctaaccttagcttattttattttaatctgcatataattcctagaaattgagttttggcaaaggagtcctcattacctgaggtctgatttagttgggcattagtaaatttggatgtgtagttcttactataatgctagattaccccctctggatcagtctgttgctcaaagtttttgctgtagcagagaaagtacaaaataaataaacccacgtcttgttttcctttctagatgctatttctcagatttggtttgccactgaggagttatttagcctatagaaaagaagctcaaattacttgttacatatacatagatatatatatgtatgtatatgtgtatgtgcatatatatatatgcacacacacacacacatacccatacatgcacattgtccatgtcttaaatgttattgttaatagtgaacgtctgtgatccatttccactaaggacagaaccaaaaaggaatggagtaggaggcttttgagttacctatttgggagaaattcctaactataaatggcaatgaaataaatatattctcacaggtgggtctatagaatttctgttattggagagtttaaaaaattaggatataaaattgtctgctaggatagtttagatattaggtatctaggtggtagagaagggagaggagtgtagtggaaaaaaagatttgaagttaataaaccagggactctaatcatggttctgtggtttataactgcatgtctttagtaacttacttttccctcttgagcctcaatgtcatcatccaaaagtgagggtattgaaatcaatggtttttaatatccttgctagctctgacatcctatgtgtccgggtgcctacagattaacaagataggctcacaaggtcctttctagctctgaaattctgtttttctgttgcatttgaaattcaatatagttcagttccattcactcattccccctcattcaaacaactaggccaagaactctaaaatgatttatgttcactcctagtctatctctataagggggcaggggcaggcatggaatctcaggaattgacttttccatcccctctgcttggcattctatccttcacccctgccaaagatggcaatattcatgcaaaggcatttgtaattttctcactgggtgtctgatagctgatttttccttgtgacagtagaaaagggagagattttcttgtcacctaatgcagggctgtggtccttctcactgagctcagtgacattttctaggaagggcgaaaataatcaactccagctcccatcaccacctgctggtagtaagttttgttttaatgccacctactgctgcacccaaagaaaacacattggcttgggagggagccaacggtagatggcctaaatggagtctataccatctcataaatctgaagtcatggccaaccattctgaataatatctttactgcttttggatcccacgggagtgtgtttttaccatttggaaatggatccagtgggatcatgatattggacaacctgattccaaaaatacctggatctgcttaagtggtaagggccagaaagtagatttaatttcatttgcaacatctctgcttcagtactgaatgtaatttttacaaggtccttgatatagggagaaaggttacagaaagggaaaccactgaagacaaatttctcctattttaaaaggtatcacaggctgattcagtctaggtagggactgagttgtcaacatgcctcactgtgaatctgttttgtgtacattctaggacagtcctcaagaacatcaggtaataccaatcccttgaagggttaagctctttatcaatgttccatgcaggattcagagatgctggtgatgtgaatatatggctctgtagcaatttgtatttccatgtcataggaggctccacctcagtagtgtatagagttattcttaagatacagtgaagcaggaatcactccaggcctgtgctctgtggtcccagcatcagcaggtgaagctggccatattgtatattattgttattgacaattagcagtgatttacttctccttttattcttatatctccctcaatctccttattactctcaatgacactttttaaaatacatctaccttgtcactgctgtccctgatgtataggcacaagctccatcaaccaaagctgccctcagtgccattttaatcagattcatccgttaaaaaatattaggtggaagagataagatcaatcccacaaagttcattaccttaggccctattcctaccccctacccacccacaatggccatctctgttgcctgagattagtcctcccaaaacatagtgctcataatggtctgtgataaagcctcattcagcaagttagtaagaacccttggtttctttggctgctatggagtatttgctttagtgctgaaaataagtaaacagcacttgcttcactgagccacagctgctggatggcttggggagagtccaaatatacataattggttgtctcccttagggtggcagcatttggaggcccagatgatgaatggactcttccactgcagaacacattcatgcaaatgacgacattcttccaaacaaacctggcaacacaagatagcaggcaagactagagagggctgttgcataccatctaagtgccaagaagggcaggtggtctccccacccacccccagtcatctaggaccaacctcagattctcaaagcagagactttcaaagcagagactctcaaagcagcacttcacacacaataccatgattttaactctctatcagcaggactgataaccaactgctatgcactgatatggctactcaactgttaaaatattgaaacacttccataccagttggtaaataggtgccactccagctgttccttctatgacatacccagacctcccgacaatccagcaagtaaagggtaacatttggaacagctgctagaatctaggaccctgctccagcaccaaaactggcctacatttggattgattggttttttaaacagtctgaatatcactatagtaggcaaaaccctaaaatgctccccctagattccccactctaatactcaagactattaatatgaagagataccacacttgtgattgtgttgtattatgtggcaaaagggattctgcagatgtaatgaaggttagtattcagagagattatccaggtaggcctaatctaatcacatgagtcttagaagcactgttttctccaaccggtagcagaagagaatgtcagtgtattagtctgttctcagtctgctatgaagaaatacctgagactcagtcatttataaagaaaagagttttaattgactcacagttccacatggctggggatgcttcattaatcttacaatcatggcagaaggaaaagcacgcaggtcttacatggtggcaggtgagagagagtgagagggaagggggaagagccccttataaaactgtcagatctcatgagaactcactatcatgaaagcagcataggggaactgcccccatgatctaatcaccccccagggaggtccctcccctaatatatgaggattgtaatttggattgtaactcaagatgagattttgggtggggacacagtcaaaccatatcattccatccctggcccctcccaaatctcatgaccttacatttttaaaacacaatcatgcctttccaacagtccctcaaagtcttaactaattccagtattaacccaaaagtctaagtccaaagtttcatctgagacaaggcaagtcccttctgcctaagagcttgtaaaataaaaaacaagttagttactgcctagatacaatgggggtacaggcattgggtaaatacacccattccaaattggagaaattggccaaaacaaaggggctacaggctccatgcaagtcccaaatccactagggcggtcattaaaccttgaagtttcaaaatgatctcctttgactccatgtctcacatccaggttacaatgatgcaagtggtgggctcccattgccttgggcagctccacttctgtggctttgcagggtacagccccccatcctggctgctttcacaggctggtgtcgagtgtctgtggcttcaccaggtacatggtgcaagctgtcagtggatttaccattctggggtctggaggacagtggcctattctcatggctctactaggcagtgccccagtggggactgtgtggggactcccaccccacatttcccttctgcactgccctagcagaggatctccatgagggctctgcccctgcagcacacctctgcctggacattcaggcatttccatgcatcatctgaaatctaggtggaggttcccaaacctcagttcttgtcttctgcccacccacaggaccaacaccacatggaagctgccaagggttggggcttgtaccctctaaagccacagcccaagctgtacctgggcaccttttagccatggctagatcggctggaaaacagggcaccaagtccctaggctgcatacagcaaggtggtccctgggcctagcccaggaaaccatttttccctcctaggcctctgggcccgtgatgggaggggcttctgtgaaggtctctgacatgccctggagacattttccccattatcttagtgattaacattcacctcctcattacttatgcaaatttatccagctggcttgaatttctccccagaaaataggtttttcttttctatcacattttcaggctgcaaattttcccaactttttttttttttttttttttttttgagacagagtctcatactgtcgcccgggccggagtgcagtggtgtgatctcagctcactgcaacctcttcctcctgggttcaaccaattctcctacctcagcctcctgagtagctgggattacaggcacctgccaccacacctggctaatttttgtatttttagtagagatggggtttcactatgttggccaggctggtctcgaatgcctgacctcgtgatccacccaccttggcctcccaaagtgctgggattacaggcatgagccaccatgcccagctcaaacttttatgctctgcttcctactgaatgctttgctgctttgaaatttcttctgctggataccctaaatcatctctctcaagttcaaagttccacagatctctagggcaggggcaaaatgccaccaagtgtctttgctaaagcaaaccaagagtcatttttattccagttcccagtaagttcctcacctcagcctggacttcattgtccatatcactatcagcattttggtcaaagccattcaacacgtctctaggacgttccaaactctcccatattctcctctcttctgagccctccaagtctttaggaagttccaaattttcccacattttccttcttcttctgagccctccaaactgttccaacctctgcccattgcccagttccaaagctgcttccccattctcaggtatctttacagcagtgccccactctcggtatgaatttactatattagtctgttctcacgctgctatgaagaaatacccaagactgggtaatttataaggaaaagaggtttaattgactcacagttctgcatggctgggaggcctcaggaaacttacaatcatggtggaagccacctcttcacagggcagcaggagagagaatgagtgccaacaggggaaataccagatgcttataaaaccatcagatctcatgagaactcattcactataatgagaacagcatggggaaaacaacccccatgattcaattacctcccgctggatccctccctgacacatggggattatggggattataattcaatatgagatttgggtggggacacagccaaaccatatcagtaagtgatctgaagcacaaggaagatttgatgtgcattgctggcttgaagatggagcgagacaagtagtaagaaattcaggcagtgtgcaggagaagaaagggagcccaagctctcactatagaaatgaattctataaacaacataaatgaacttggaagcagattcttctccagagcctccagataagagctcagccacattgacaccttaacttcagccttgtgaaggccagtatgactggagtggagtaaccaagggaggagagggaagtaggagatggagtcagagaggtaatgggagtgagtgacagatcacttagggcctcatggaccgttggaaggatttgggcttctattctaagcatgatagggagccatgggagggttttgagcagaagaggtacatgatctaacttgtattttagtaagagtgctgtgtctgattgggaatagactagagtgggataggggcaaatacagagagaccaattatgagaccattgcactaacccagacaaaagctgatggtggttttggccaggttggtcatgatggcagtgatgagaagtggtcagattctgtatatattttgaactagatcagatgtgaagtgtgagcaaaagacagtagtgaagaatgtcatccaggttttttggtctgagtaactggcagggtggagttgtccattactgagatggggaagagtaggaaaggagcaggcctggtcggggagggaggtgaaacagagatccagagttgacttttagacatgtggaattggagatgcctattagacatccaggtagaggcattgggtggtctacaggtctagaggagaggtccaggctggcaatagagatttgagagttaccagcatacgcatagtatctaaagctatggaactagatgagatcactaaggagtgagtgtggagagaaaagaaaagagatctgaaaatgaagtctggggcactccaatatttagaggctggaaatgtgaggatggattatccaaagagactgagaaagaacagccagagggatgggagaaaaatcaagacaatgtgctatattataatactatattattcccaatatgctaataagtcatatgctagtaagtggtactgtctggatttaaattgaggtagtctaaccccaagacccacacacagaacctctacactatcatgttgacacttaccttgaaggcaagaagcacctgatatgcactttcactacaagggccctaacagaccttctttcctttccttatcttatcacaactctgaactgttcagtctccttgtcctatcagttccagtgataaaagggctcattataatcctgaggggacgaagagcccaatatctgccctaatttcttccaggataagaatcactgatgcttcatcaacatacccattgtctgtgtctcagctcccaagagccatctcttaagaaaacagaacaaaacataaaccctgccacctttcacttccactaaacagtccaaaccatggaagctatagtaagtctaaggaatagtataatctctattcaggtgaaggagttgcttaattcaagctgtaggcatatcatgacattggagcaaagccatttcaaattttaataactgtctcttccctttgggatgccctcaggcaatctacgtatttttctcatctcagcttgtgattttccctgttgccaaaccattgtctggaatctgatcaagggttgctacgtttcactgaggagaaagaaaacattcagaactatggaggacattttaatagtgccctcctcccttgggtaatgtggaatctatgaacacctgctgataatctcatttcagacaacaatttacattttctggtagattctgtaagagatacaagagctaggtgctgtaagttgtataaagggaaagacacaggtgataccattaggaagcttgtagtctagtttagagggaaaagtctgacatgagtaaaacaatagcactattatcacaagaatagtagcagtgattacagacagcattggctcaagagtagtcagactacctggatttgaaacctggatagccatttactgtggttttcggcaacttgacctctttctgcctcatttgacttctctgtaaaatagggaagataactaggcttttcatttgctgcttactctcaggtctattccctgcctgtttcttgtatcaagaaaactacattcctcacaatcctttgccctttggtgtctgagcagattcaaccaatcagatggtaggaggaagggagaagctagactatttcttccccatcccatcctcacttattttggtgcccccagcagcagctgtagctcctctggggctcaactccaaattccgccagccatctcctccctacttggccccagcttttgcagcgactccccgtcttggctcaagctccagccagagtgcactagtcttggatctaagaacactacctcttcctgttgaccctcgaactccaaggataaaaggggcttcctgttgttgctaatctctaagttgtctcactattccctttttaacttgtcagatcttacatcatctgtgtaaccaatccccgcattaaatctagatttgaaagtcctagagtgggccgggtgcagtggctcatgcctgtaatctcagcactttgtgaggctgaggtaggtggatcacttgagaccaggaattcaagtttgagatgagcctggccaacatggtgaaaccccgtctctacaaaaaatacaaaaatgagctgggtatggtggtgcgtacctgtagtcccagctactcgggagactgaggcacaagaatcgctggaacccaggaggtggaggttgcagtgagctgagatcatgccactgcattccagcctgagtgacagagcaagactgtcgaagaaagaaagaaagaaagagagagagagagagagagagagagaaagaaagaagaaagaaagaaagaaagaaagaaagaaagaaagaaagaaagaaagaaagaaagaaagaaagaaagaaaggaaggaaggaaggaaggaaaagaaagaaaagaaagaaagagaaaatgaaagaaagtcctagagtgatttctgttttcctggctgtaccccaaccaacacgtatctgattgaatcattgtgaggtacgtttaggaagtacaaattgaactgagccttgaagaattggtcaaatttggaaagacagaaaattgaggacgtggtatcagatttcatttttggcaaggaaatagcttgcacaccagcggggattggcctagtgtttattaaaggcggtaacactgtaaggattggcttcagtcttctctgcctaccatactttattccccaggaaactatcttttcaacaggcagtgaagtcccccctgccccaacaatgaggagaagcaaaaacagtagtcgcatctttaggaactgcatgacaaagtgcagagcctacctttagaaaaatcatacaaggagatgaggtgtgtttgtgtgtattcccacatcccaactctgggtcctcacattgctgtctacctggctcagcacagaaccctagaccgcctgacctggaaaagccccaggcccctcctctaggcccaaactgagctctttctcattcactaaggcttaaagaagtcagtaaatatgaatgtaagaaataataatatctagcatatagacaagcctttattaaatgccagcactaagtgctttctattactattataactactattaataactaccatttattaagcatttatgtcccaaacactatacacaacactttgtacctattatctcattaaattctcacatcagctttataaggtaggtactgttattgactacattctatgggtaaggaaactgaggcacagagataaaagtgactcgcccaagggtacacatttttttttttttttttttttgagacagggtcttgctctgttacccaggctggaatgcagtggcacaatctcagctctctgaaacctccacttcccatctcatgtaatcctccagcctcagctttccgagtagctgggaccacaggtgcaagccaccatgcccagctcatttttgtattttttgtagagatggcgtttcatcatgttgtgcaggctgatctcgaactcctgagctcaagcgatccgacctccccatcctcccaaagtgctaggattacaggcatgagccaccactccctgccaagggcatactcttaataaggtctgtccgacctgaagtaacaaagatatctcacttcctcttttcctgccagcatctcaagcccccaggccctgatacacaaaccacaccggacccctgcccaacctcagacttccctggcttcatgcttccccctggttgactaacttgctgactgttccctaggtcctaaccagaaggatcctttaaggagcctttcccttggttctggacacaaagcgacttatttcctaagctgagatcccctatctctacccccaacacacgccaactagctctctttttcttctttagtgtgtccagcagacttcacacaaccagtttcttctcaactctgcccctaatacttccagcctccccaaatgagcaagcagacaaccacagccacagggagtaaacgggtcagcactaccaagttcgtttgtatgacaagaattcctcattgaatgaacacatcctgccttgagacatctcagccttgttctttgccagacagctctttgcatgcctaaagcctctcttgacattatactcacaccagtaaatggactatataatatccatcttcagggaaggagggaggagcattgtctctgcaaacgctgcagggggtaccaaaggctgacttttcagacagacctcccccattctgcctgggcctggcctggccctccccctggtggtttgagacagcaacagatttcttggtcattctgcatcaatgcctgctcctggttttgtcagcaagctgtctgagaggctgagagctctttgccacaaaattctcagggtgtactttggcaggtctgtgccaagcagcagtctctgcttccaacagcagcaacattctttgatacttgcttctacctgctaatgattttggtgactgacaaagatgcaagtggaaatgggatgaggacaaatgaaaggatgtagattttcttttcctgtcctaaacggcaaccaaacagggcagatgtgtgagctactcctccggatcccagactcagctgggatgttcatcgggaacatcagtaattgtcatgaagactatcttgggtaactcagagacaagaccaacaatgccagtgacagaaaggttccagtgcccaaaaaaaatacctctccccatctaccggctgatgtcctttactctttcattcattcacttaacaataaattaacaattgaataaatatctattgtatggataaatgaataaacttaataacttaataaacatgtattgaggcactactatgtgccacactacattcttggcagtggagatacagtagggtgataggtgaacaagacagactgggtccttgttctcatggagtctacatggactgtccaatcatggaactacagtttcaaatttcactatttgcattttgtttctttaccttaaggctgcacttaaccttttatgggtcacagattcctttgacaatctgatgaacatgaacaagaaaaaagcatatattagcaaacatacataaagtttagcatctcaaagggtttacaggcatcctctcattatcatccagaaattccttaccttaagatttgtcctcagttataatgcaaatatgctttgagctatgaataggtcgcttaggactcagtgtaaatgagtatgtccaatcccttattaagatcaggttttcccatgtgaccaagcaagtgagagataccataagggaaatgcgcctgaggaatactgaggaggggacaacaacaagaaaaagagattggagacactgaaggaaatgtcaccatcatcacagttttgcaaagaatcaggtcggtgtaatagtccccaagtcaaaggtgcctttggcctctacataaaataacaattacccatggacattcctgagataaaaatgactgtgtttttatttccaaaagtatcagagttgaggttcagaaagtattgctttttgtggtgtttctggaccactgtccacaacactctgaagggttgtgccaaccaaagggtaccccggaacctaaagcaaaagttaaaaaaaaaagaattgatccttgtggaatacttagccttcctacttaaattggtctctgaatgttctctccataggatacaaacatttgtagacaagtcaaatgtccatggcccaaaggtcattgtctgagggtgtggttcttcttggcttctgccttattcccataatccttgttctgggcaccaggaatcatttgactagaaagctaagagatagaaactttatttatttctgagaaacctgaggtttaaaaactaaatgtgagttctgagttattaatattaataaggccctctctcttcctgtggttactggagccttgtgccatagcctggctcaatgtgagaggcagaagggcaaggaggtgtcctttagctgtaacacagaggtcagaatacccagtggagcatcaaagattacaacccactgcattactctcccttttacttgagatctgacagcagaattacgttatctcagctgtcaaggtaaatccgcttttctttaaaagaggaaatagaaaaaaatctaagagtgaaaatgtgggaggggaaagtcattgtatttctctcttttctcacaggattttgctttttcctctgttttgttctgtatcccaatttccccctgggtatttgaacttacagaactcctgggcccataaaattgtgagctaatcacaaagacttgtcaaggaatgtatttatctcaaagcccttcctaataaatgtagtgtatcaggagtttcccagaacataaggaaagaaagtaccgtaggcctcctcattcattaggaaatcaacaccaattattaaagaaggtttggactagtgtgattagaaccaactcaactgacttcatcagagctcccactgccctgaccctaaagattcttgggggtatagagaagtttccattgcccaatggatattctaggaggttataccacagggtttttctcttaataccttatttcatatgtttcatacaggaacattaatcaactcagagatattttatgctgaaatctctccatccttaaccaggatacactttctggcacatagtaggctttcttttaatatttattgaataaatggacaaattaattaattgctaatgtataagacttcccggaatattttaaaatgaggagagagcaactgacaaagctgactaaacctaagtttattgtcttcttgttcaggggttagcaaatgttgtctgtaaagggccagatggtgagtgtcttaggttttgtggactctgtctcaactacccattgtaacacaaaatcggtcataggcagtacataaatgaacgggcatggctatgtgccaataaaaatttacttattgacactgaaatttgaaatttgtataatttcaagtgtcaaaaatattatttttattttttcaatcacttaataatgtaaaaaatcattcttagctcatgggcaatacaaaaccaggtgacagtccaaatttggcctgcaagccatagtttaccccctcctactgtagttgcttcaaaatgtgtctattttcaaactttgaggactaaagctctgtgaagacaagggctctgctttaggttttctctatattcctctggtgcctggtaaaatatggcacatatagaagatactcaataaataccttttcactgattgatagggaaaaggttggggatatctctgatctatagtttgtcgactatgttaaaaaatacatgatgtcaatttatatccattgcaagtgtttagagatcaataaatttctatggcagtgggtaggggtattatctaatggaaagaaaatctacctagatgatggattttataattatagtcaatacagtgctttatactttccaaagcacaatagcatatcatattgtcttattcgatcctcacaagagctctatgaaagtaggcactattatctgaatgttacagatgaggaaacaggcttcccgagtttgagacttgcctggggtttcatgccaggtgtgtttgttcattcattcattctttccataagaacttgtgagtctgctatgtgcaaggaagtaggtgagagggaactcaggtctagtgacccctgaggtgatttttagaagctatctataagatggaagtatggcttgggaagttaaaagttagttcctgataagtgaggtaggaagttagaaaacacacattatgactatctgagtacatgataccagtaagaattccaggtgaggacggacctgcagcttttcccatgtcccaagtgataaggtatacctctatcttcatccaggctcacaaatagaagttctgattggcttagttccagttatttctgaaaactgcaggttaagctcagcaaaaaccaccattcttacattatggttccctcactccccagtggaaagacacaggccaaaagaatgatctgtgcctccttgactcaaggatttacatctctggagttgcccagtaaaggtgacaagcagttcagtgggattcaggagtaccacatctgctagaatggtgctcccaaaattgtgcagtatatgacctgcacagctgaatgcagaatctctaaagggtcacttctgaagcagaaaaagctgcttttttctgcaggaaacataagcaaaagagaaacctgggcagtcaaaggcctggctgagtatatacagggatctgttcttcaaaatccaaggccctgatcaggctctgtttctgtttccacacattttgcaggaaccttcctgatgccggtgcacttcccaaaaagacagtatagctcagtggttaagaacttggcatctagcgtctgccccatccagatttgagttgtagtccaccagtttctagctgtacatctttagacaaattttttcactttggtgagcctgtttcccaatctataaaatggaaacagtaatggaacccatttcatcaagcaattattaagatttactgatatgcttgaaaagtagccgggcacggtggctcacgcctgtaatcccagcactttagtaggctgaggcgggtggatcacctgaggtcaggagttcgagaccagcctgaccaatatggagaaaccccgcctctactaaaaatacaaaaattagctgggcgtggtggtgtgcacctgtaatcccagctacttgggaggctgagggaggagaatcgctagaacctgggaggcggaggttgcagtgagccaagatcgtgctgctgtactccagcctggtgacagagcgagactctgtctaaaaaaaaaaaaaaaaaaagagaaaaagaaaagaaaagtggtaggtaatattgctgatgctaccctcagtttcatatctgcctttgggtcttcaattaatttattctacaaatttgattgtacacctactttgtgccaggctctaggactgatctctaggaatacaatagtgaacaagacaaagtctctaacctcagtgggctttgattctactggggtagcctaagaataggcaaatagagaggaatccattaataattatttatttgcaatgattggtatgagaaaaaatagaataatagagaagtacactttaagttggttgctcagggaaggtctctttgagaaggtaatacttgagctacgaactgatggatgaaaatgagccagctctatgttcctgtttaggaaaaaaataattgaaatatatgaggcaaaattttccccccagttgctgtccttttatccaggcctttaggcttctggccattttaaggaggttcttgcggagtcgagccttgagttgcaattttactggggaaatgatagagggcagaaggagcatttgttcagtgggtattgatgtgcccataccaaagctcagaaaggttggcaggagagtgaagatcagacacaggtgtttgggagcgaggatgaaagaagttcaagctagctggcacttctgatgtgaagtggggtgtggcaggatgctaaagagaggctaatctctccagttattatcccactgaattctatgaggatactcctgtccaggcagtaaccccatagacaggaaatgaagtaagtggtagatgtgcatgaaagcaggagtcagaagacttcgattctggatctgctttatcattgactagatctgtgaccctagagaagtaatttctctctccagaacctcagttgccacatctgtgcaaggtaacaacttcacagggtttcctgccaacttcacagttcacagagtgggtgtaaaaatcagaaaagaggccgggcacggtggctcatgcttgtaataccagcactttgggaggccgaggcgggcagatcacgaggtcaggagttcgagaccagcctggccaacacagtgaaaccccgtctctactaaaaatacaaaaattatctgggtgtggtgatgggcgcctggaatcccagctactgggaggccgaagcaggagaattgcttgaaccttggaggcggaggttgcagtgagccaagacggcaccactgcactccagcctgggtgatagagctagactccatctcaaaaaaaaaaaaaaaaaaaaatcagataagagaaagtatgtgaatgtgctaggaaaaacataaagccaggaagctaggaaagacaaatatgaggtactggctgtctagtgtccctttcccactgataggctgacaggtgaaacacttggcatttaattttctggtccatctgtttgagattggccagaaagcccttatgtagagaagacagtagccccagaaagtccaaaaagagtcccatcccatggtggcaagcaccacttctaaggatgtaaggaggattcttccactatgtgagctcagagggccctgcgaggccattatttcctttgagtaccacctgagatatcacaagaattgtttctgcagtaataaactggagactttaaggaagtaacatgtttatttccaagtctcaactataatatacatattttatattacccagaggcctctatgttgctgttctttctgaccgtacataaggcaccctgctcccatcttctccctccatcctactccattaaggccccaccttccttccataacaatggagaggggtggcatctaccaggaaagagctacattttgacagttccagcttccaactaccttgaactttttttttcccttctcccttcaccattaccccactttgtggtaggaaagggaggacaggaacaggagaaaaattgaaactgacaagatgactacagagaaggtatggggaactgaagaagccctgcaactctattggttgatttcatgagaaatcgtgaattttaaaactgcccaaatttcattctgactctcagaaagtaaatgactttgttgaaggcaacagagtgggtcagaggttagatcacagatgaaggaaccctggggatcctgtgctctcaccaatttgcttgcaacttttcctgccacatcccttggaatcagagagggaaagataattaaggcccattgtttatggcctgtgttgcttttatgagtacacatgtgttctatatactaaatgctcgtggttggtgacagtctctctaaataaaatccagtgatgactgtgaagaccttgcaggaccattttagaagatgaaaaggagattcctgtgcagtctcagggacccaatacactggatcaattgcaattgtcttttgttctgccacttttattgttacccatgcaaggcagcctgctggttttccattagaaagaccagagagtgccaagcctaaataaccactgaatatcatttctatctctgctccctccctctctcattcattagttagaaggccatatatttgggttgtattgtgcacacattaggaaaggctgggaagactactggttgtttattctgtctttgttcctccttctcctatcttctttccatagtagcctgataaactaacttggttcattttgctacatggcctaataacattatcaccagggatgcacaaattatacctactctccaccgtcctgtgtcttgtcaacagagagacggaaggtgacatggacaggcgaaaagagggacagatggaaaggaggaagagttgctggttagctgctttggcctgctgaatatatatatatatatatgtgtgtgtgattctcactctgtctctctctgtctcccaggctggagtgcagtggtgcgatcttggctcactgcaacctctgcctcctgagttaaagcaattcgcctgcctcaacctcccgagtagctgcgattacaggcgcgtgccaccatgcctggctaatttttgtatttttagtagagacggggtttcaccatgttggtcaggtgaaactctgactcaagtgatccacctacctcggcttcccaaagtgctgtgattacaggtatgggcgaccgtgctgggcctgagtatatctagattagcaggtagaaactctgaattcatgtttctgaaaatggtcagcgaccacctgcatcaaaatcatcgaaagaagcttgttaaacaatgaagattcttgggcctcccacccccagagcataatttttttgtgtatctgcagtgggacccaggaatctgcattttgacaagcaccctaggtcagtctgatatccactgaggtttgagaaccactgatgtaaacaaattctaatacattcacccggtttcaaaggcatgctcaacctctatattcttcttgagttttcatatggtagcctctttctgaggagtttcttccctccatctctgcccagagatatcctgctaatgtctcaaggcccagctcaaatataacctatttcgtaatgtcttctctgctttctgtttctcacctgcaaatagctgggatctctcttgaagcaatgagacagaatattggcttgatgtcagtagtggagtgtgaggggaattgggaacatgaggatgggagagctggaatggagctggagcttgagttctgaggtttgccctgaagtgtagcacctgagtttgcacactggagctgaggtggttaaaaaggctggaagctgagtactagtaaaaaaaagtaacacacgccaagtcctcaaatggtcagagcagtgaccccaaccacctagaaaccataatttgggagggggattagcagccctttcatgcctgaggatggggatgggagacaaacagaatggctgcccactagactactgcacatgctcagtagggaaaaggacctgtttgcaacactcaccaagggggctcttggagtttgggaaaggttaaaggggctattgggaagcatcggtactagggtgcaagggagtcttgggggcagtggatgggcagtgaataataactggagggacagctctctttttggccctgacactttgcagctgagtttgtacacttaaattgaagttgctgtgagggctctagactagctaaaccaatctcaaagtgattcccagcaggccccagaatgattagaacagtaaattctaaccacctagaaaccttagagagtaaatgaggattgtggactgttttgtgggagggaattggctccccatagaccacactgcatggatgcaataagttagaggggagggcattgagggatatgggaatacttgctgaggaatgtttctggcttcagggtctccacaaggttgagggaggctttgactacctccatattttgaagactcctgtatattttttaaacaagttgaaaaaataaagttaaaaattataatctcttcaaaatgctaacatatttttaaaattacatttttagccccaaagcaaaactacaatacaatgtataatttctagtgaggtccagaaatctgcatttttagcaaatgccccatatgattttgatacacaccaacatttgagaagcatgccctgaattctaccaagagaagaaagcaatccaagtgaggtagacttcccttgtcagggaaaatgaaccctctcgcttctctttggcatgtatatgtcacagcaatttgtgttgctttcccatcaaagtgaagtagagctggtcttatactcaagtgaagtaggtaactaccagttaaagtgaagcctcccaatatgtccccctgcccaaaatatctctccaaccggcctgcccatggggcctaagattcctaggagcagcctttctccttaagagttatcattagctctgcttttgctgtgtttgtgcctgccactctccctttgtattaggttataaagttttccaatttgctaaacaagatagttgcttgcaggaaatctgaaagaatatgtaagactttgtcaaaaactggtaagaaattggccttgcagtttgattgcaaggaaaataactgtgagcttggatttgttgagaaatgtaaaattgaacaggcatgttcatttaacctctagctatggccatgtgctcagaatctggacaaatcaacaacatttgagggtgtgctctacaatcagagtatatatactcacactgtgaaaggagctaaaacaaatagaagccttggcctgctctacaggagctgacaatctgaaaggcaatgcagggcacacacatgaattagaacacatctgtaaggctatgtgtcgttaggtgcacattatagccgcacaaaagtcctaaacactgtggaaagtggagaaaaggcaggaccactgtctatggtggtgtagtttgtctcttacacaaaaccacccagccaggagctgatctgggaaaatgttccaaagtcatagttgggtagagagggtaggacagatagtagaaaagggcatcactaccaaacactgaaagtaaacaagggaacagccaatgtccaatttgtctatcagataaggtgaaaggctagtcccacgaaaataaatgaaaatttattggggatgatatctcttggaaagttttagataagtatgattacaaaagcacatccataatgttataattcagtttaaatcaagggttataaataaaacagatttctatataccaagtgattttgtcatccatattattcactgctataatcccaccacctagcatctggcagacaatcaacacatatttttgaatgaattaatgtatgaatgcttaccttactcaacaattagcagcttactgtgtttatccaatccttccaggtgggctatagttgctgatctttaggattcaggtaataccgctgtactccaattgtattctgtgtggcattcccatcaccgccactggacaatcatctctttatacccagaactatacagaacacttgcaatgtgggagttgctcaacacaggaatcaaaaaaataaatggatagttagataatgaattgatacatgataaatgaatggaaaaagactgtttagaagagtatttataataatttctctgctaaattattgcataataattcccaacgtgaggtcacgtgagcaccagaggaatgggagcaattggggtcctcaagctcttttcaaaatgcttagctaaaatcatatcctcatatcagtggagtgggtgcaatgaggggcaccagaaagcattctatgcacacacacaaaaagttgcctatggtttataacttggcctactgtatctttccattctctgtcaaaaatcaagtattcttccctcaaaacctttagaaaatttttaaaggacataactgcttattgtttaaaatacctacaaacaaaaagctaaactcacgtagggattaaaaaaaaaaaaccaccggcatttccagataccaagacatctagccaagtttattaaaaaaatggctgaatacccacaggagttgaatcatcattctccctttttgaacatgtccacagatggaaatctgtgcttgaaaatgtgactcagttcattttaagaaatactgattgaatatctacttcatttcaagagctgtggtagcaaaacataagtgtatttccaaggatgagagattgctgttctgggccatcaaagggtaaaatgagaactcaaggtttgttcctggtattatatgttcagaagtacaggggaaggaatcaacaattatatagctcttactacataccagggagtagcctaggaattttatattgacttctacaaccattctgcttggtaggtatttccccccatttttactgttgagaaaactgtgactcaaagacttgaatttactggtctgagatcacatagctagtaagtagaacaggagtattccaaaccgttctgtgttgtttgactcccccccaaaacctctgcccttttgacagtggcatgctgcttctcaatatttcatactgctcttacctcctatcctcctctgcatcctaatttgcctacagaaacactgtatcccatggcaaatttcaggacagtgagagtttattatagccataactctgtgtgtgtttgtgtgtgtgtgtgcacgcgcaagcgtgtgcacgtacataaaatttatatattgaaattgttttagttcagggtctcatcaagagcattctaacattttgctggcataccctctaatgaatttggaaaaacaaaatctatatatctccttacatatttttggattgatgtccaaatatttcatcataagtttcaacagttgcaaaggatgtaatttctggaatacggtagacattgacatttaaaataaaactatgtaattactcatttaaatgcatccaatggaatctgaatactatagcaacttcttactcatacccatatgttaagaaaataaatggcttaaatcttcttcaggggaagaaagtttacatcattcctttgtctccttgaattctcatttccgttccacatccccacaaaattttattgtaatgttatataatttttgcatttaagtattttattttttattgctttgtcatatttcttcataagaaagcataaattgaaatttaatttttttattccctattgccataaggtaataatgttaaaaccattcttctgaatttagttgtcctttaattattagtagtaccaaactacttgaaagaacacaaatataaatataaattttgataaacaattattagagataaaattacacttttattaaaaatgcctttcttcttaaaaatgtgattggagcttttctcccaactaggtattatattcacagatgaatactgaataacattcaggaacaagattcagcatcaattatattttgtttccatttttataaaagtaaatgttatgaaatctttttcatatcaataattatatgtgaattgatagagtttaattatgctactgtcactcaattttttaactcagagttgtgtgccagaaagtcatataattatttttcataaaataatatttttaacaatttattatctgaatacttgattaagttctccttaaatgttattgaagtcaataaattagaaaccacctgagacagaagacaatttgttacctaagattagagtcattcagtttctcaatttctgggaagtactactctggtaggcagcttctgagatggacccctgtgatttccactttctggcatttgagtccttatgcagtcctctccccatgagtgtgggctagacccaagaactcacttttaacaaatagaatatggcaaaagaggcaggcacggtggctcatgcctgtaatccccacactttgggaggtcgaggcgggcggatcacgaggtcaggagttcgagtccagcttggccaatatggtgactccccatctctactaaaaatacaaaaattagcctggcatggtggcgggtgcctgtaatcccagctactcgggatgctgaggcaggagaattgcttgaacccaggaggcagaggttgcagtgagccaaaatcacgccagtgctctccagcctgggcgacagggcaagactccatctcaaaaacaaaacaaaacaaaacaaaaacaacaacaacaacaaaaaaaaaaacaaaatgaagactacggcatggtgaccatagttaataataataatgtattgtatacttgaagttgctgagagagtagatcttaaatgttctcaccacacacacataaacaaaatggtaactgaggaggcagagcaagatgactgaatagaagcctccaacaaccgtcctctgtgcaggaacaccaaattaaacaactacacacaccgtaaagcaccttcataaaaaacaaataacaaaaaatcaggtgagggatcatagtacctgtttttaacctcgtattgctgaaagagacactgaagagggtagaaaagacagtcacgcattcccgacaccatccttcctgcacctctggcagtggctgcatggcatggagacagaatctgtacacttggaagagggagagcatagtggctgagacattgcattgaattcagtgctgccctgtcacagcagaagcaacactgggcagaacccagcccagtgagctgggctaacccctggagtgagcatttagaccagccctagccagaggggaactgttcatcccaaccatcagaacctgagttccagtaagcctcaccacctcaggccaaagtgctctggggttctaaatgcacttgaaaggtaatctgggccacaaggactgcaattccttggcaagtcctggtgctgtgctgcacatgatgcaagcagacttggggtacatgtgacctagtgagacaccagcaggggcggccaagggagtgcttgtaccacccctctcacaatccaggcagtgcaactcatagctccaggtaagaccccttccttctgcttgaggagcagagagggaagaaacaagaagactttctcttgcaacttggataccggctcagccacagtaggatagggcactgggcagagtcctgaggcccccattccaggccctggctcttgaatgacaattctagacacatcctgggccagaagagaacctgctgctttgaagggaaggactcagttctggaaggattcatcacacactgactaaagagcccttggaccctgaataatcaggagtgttagtcctgtagtactcactgtgagccttgggtgagactgagaaatatattggcttcaggtgtggcccagcattattctcagctatggtggctacagggagagaccccttctgcttgagaaaaggagagggaagagtaaaggggactttgtcttgcagcttaggtgtcagctcagccacagtggagtagagcaccaagcagtctcttttggtccttgatcccaggccttggctcttggacagcatttctggaccttccctgcaccaaagggggtaccactgccctgaagggatagtcccaggactggcagcattcattgcaagctgactgaagggtcattggcccttgagtgaacatcagcagtaggcaggcaatacttgctatgtgcctggtgtggtggtggccatggggaaagactcctcagcttatgaaaaggggaggaaagagtggggaggaaagattgggaagggttttgtcttgtggcttgggtgccagctcagccccagtaaaatagagcaccaggtagattcctaaggtttctgactgtaggccctggctcctgtatggtatctctggacccacctggggactgggggaacttaccacccagaagggaaagacacaagcttggctggctttgccacctgccgattgtagagccctagggccttgagcaaacatagatggtagccaggcagtggtcaccgcaggccttgggtgagagccagtgctgtgctggtttcaggtctgacccagggaagtcctagtggtggtggccacagtggtgcttgtgttacctccccccaactccatgcagctcagcgcgtgcacacacacacacacacacacacacacacacacacagagagagagagagagagactccatttgtttgggagaaaataacggaagacaacaagagcctctgtcttataatccagagaattcttccagatcttatcaaagaccatgaaggcagtacctctacaagtctgcaagagccacagtattactgggcttggggtgtcccctaatgcagatacagctgcagtgacaaaaaccttagatcacaacacctaaatcccttcaaatatctggaaagccttcccaagaagacatgcacaaacaaccccagactgtgaagactacaataaatatctaactcttcaatgcccagacacagataaatatggaccagcatcaagagcatccacgaaaacaagacttcaccaaatgaactaaataaggcaccagggaccaatcccagggatacagagatatgtggcccttcagacagagaattcaaaatagctgttttgagggaactcaacaaaattcaagataacacagaaaaggaattcagaatcctatcagatacatttttttaaaaagatagaaataatttaaaagaatcgggaagaaattctgtagtggaaaagtgcaattggcatactgaagaatgcatgagtctctcaatagcagagttgatcaaatagaagaaagaattagtaagcttgaagacaggctatttgaaaatacacaggcagaggaaacaaaagaaaaaagaatgaagcatccctacaagatctagaaaatagcctcaaaagggcaaagctaaaagttttggccttaaaggggatgtagagaaagagatgggggttgaaagtttagtcaaagaaataataacagataacttcccaaacctatagaaatatattaatattcaagtacaagaaggtaatagaacaccaagcagatttaaccaaaagactacctcaagacatttaataatcaaattcttcccaaaggtcaagggtaaagaaaggatcctgaaagcagcaagaaaaaagaagcaaataacatgtaatgaagttctaatacacctggcagcagacttgtcagtggaaactttacaggccaggagagagtagcatgaattatttaaaatgctgaaggaaaaaacttttatcctagaatagtatacccagtgaaaaaatatcctttaaacataaaggataagtaaagattgtcccagataaacaaacgaaaaaaaaatggtaactgtttgaggtgatggatatgttaattagcttgatttaatcattttacaattatatataaatcaaaacatcatgttgtacaccatgaaaaatatacaatttttgtcaagtttacatttaaaatgccaggagaagaaaaagaatatggcaaaagtgatgtcatttccaagattacgttacaaaaagaccatggcttttctctctctcttactctgagaaaagcctgctaccatgctgtgagttgccctgcagagaggcccacatggcaaggaactgagggaggcctctgtccaatagctaacaaggctctaagaccttcagccgcatagcccatgaagaactaaacctgccaacaaccatgtaagtgaatttggaagaaaatccttccttggttgagtcttcagatgagacgttagctctagccaacaccttgtccatacccttgtaagagatcttgagccagaggcacataactttgccacacccagattcctgacccacagaaactgggataataaatgtttgtggttttaagctttaagtttttagataaaaccaaaaaggctttactaagacttatcaaatacttattaaatatacaaattactcttttacttagaggtaccttgtttaacccaacatattaagtaaaattcatgatatagaaaatagatattttaataattttaatatacctttaccaataaaacatttttttaaatgcttttgtattatcacatgctttgaatataattttaccaaaactacagagctgcagatttagcaatttatagaaaatattggccaagtgctgtaatcccagcactttgggaggctgaggtgggcagatcgcttgagctcaggagttcaagttcagcctgggcaacacagcaaaaccctgtctctacaaaaaatacaaaaatgagccaggtgtggtggtatgcgcctgtagtcccagctactcaggaggttgaggtgggaatatcacttgagcctgggaggtgaggttgcagtaagctgagatagcaccactgcactccagcctgggtgacagagtgataccctatctcaaaaatatatctatatctatagatagatagatagatagatagatagatatctgtaatttagcctaactggcataataattttcatttccaaaacaattggctaaatcacacttacttattttctgtctcaaaaaatacagcttgatttttcagctcaataaatatgtcagtactcttcatgccctttgcccactttggaaaccaaaaaaagtcaaggtccagatggattcacagccgaattctaccagaggtacaaagaggaactggtaccattccttctgaaactagtccaatcaatagaaaaagatggaatcctccctaactcattttatgaggccaacatcatattgataccaaagcctggcaaagacacaacaaaaaaagagaattttagaccaatatccctgatgaacattgatgcaaaaatcctcaataaaatactggcaaaccaaatccagcagcacatcaaaaagcttatccaccacgatcaagttggcttcacccctgggatgaaaagctggttcaacatatgcaaatcaataaatgtaatccatcacgtaatcagaaccaacgacaaaaaatcgcatgattacctcaatagatgcagaaaaggccttcaagaaaattcaacagcccttcatgctaaaaactctcaataaactaggtattgatggaacatatctcaaaataataagagctatttatgacaaacccacagccaatatcattctgaaagtgcaaaaactggaagcattccttttgaaaactggcacaagacaaggatgccctctttcaccactcgtattcaacatagtgttggaagttctggccagggaaatcaggcaagagaaagaaataaaggatattcaattgggaaatgaggaagtcaaattgtgtgtctttgcagatgacatgattgtatatttagaaaaccccatctcagcccaaaatctccttaagctgataagcaacttcagcaaagtctcagaatacaaaatcaatgtgcaaaaatcacaagcattcctatacaccaataacagacaaacagagagccaaatcatgagtgaactcccattcacaattgctacaaaaagaataaaatacctaggaatcctacgtacaagggacgtgaaggacctcttcaaggagaactacaaaccactgctcaacaaaataaaagaggacacaaacaaatggaagaatattccatgctcatagataggaagaatcaatatcatgaaaatggccatactgcccaaagtaatttatagattcaatgccatccccatcaagctaccaatgacttccttcacagaattggaaaaaaactactttaaagttcatatggaaccaaaaaagagccagcattgccaagtcaatcctaagccaaaagaacaaagctggaggcatcactctacctgacttcaaactatactacaaggctactgaaaccaaaacagcatagcactggtaccaaaacagagatatagaccaatggaacagaacagagccctcagaaataacaccacacatctacaaccatctgatctttgacaaacctgacaaaaacaagtaatggggaaaggattccctatttaataaatggtgctgggaaaactggctagccatatgtagaaagctgaaactggatcccttacttacaccttatacaaacattaattcaagatggattaaagacttaaatgttatacctaaaacctaaaaactctagaagaaaacctaggcattaccattcaggacataggcatgggcaaggacttcatgactaaaacaccaaaagcaatggcaacaaaagccaaaatagacaaatgggatctaattaaactaaagagcttctgcacagcaaaagaaactatcatcacattgaacaggcaacctacagaatgggagaaattttttgcaatctatccatctgacaaagggctaatatccagaatctacaaagaacacaagcaaatttacaagaaaaaaacaaaaaaccccatcaaaaagttcgcaaaggatatgaacagatacttctcaaaagaagacatctatgcagccaaaagacacatgaaaaaatgctcaccatcactggtcatcagataaatgcaaatcaaaaccacaatgagataccatctcacaccagttagaatcattaaagagtcagaaaaccacagatgctggagaggatgtggagaaataggaatgcttttacactgttgattggagtgtaaattagttcaaccagtgtggaagacagtgtgacaattcctcaaggatctagaatgagaaatacaatttgatccagcaatcccattactgggtatatacccaaaggattatgaatcatgctaccataaaggcacatgcacaagtatgtttattatgtttattatggcactattcacaatagcaaatgtccatcaataatagactggataaagaaaatgtggcacatatacaccatggaatactatgcagccatggagaaggatgagttcatgtcctttgcagggacatggatgaagctggaaaccatcattctcagcaaactatcacaaagacagaaaaccaaacaccgcatgttctcactcataggtgggaattgaacaatgagatcacttggacacagggtgtggaacatcacacactggggcttgtcgaggggtggagggctgggggagggatagcattaggagaaacacctgatgtaaatgatgagttgatgggtgcagcacaccaacatggcgcatgtatacctatgtattgaacctgcaggttgtgcacatgtaccctagaacttaaagtataataataaaaaaatacataaataaatgaataaataaataaagatatagatataacatgcaggcttgctatgagtttgtcaccattatgaaatgaggtgatatagatagttcttctaatgttgtctttttcgctttgcctttacagaattctccctcaggaatgatatattccttgagcaatagttgagaaatgtagaggaggtcgttaaaagaagattatcatcactcttgtaataccactacaaattatcccagtatcccccaaaccagctcaaacactgtgtatctaagcttcacccttaataaaaatatgtataaggtgtagagtgatttttaaaaagccaatgatggatacatggtacagtaattgaaggtgtcatcttaatattttaatggcatggaattttttttactgctttgtgaagcctttggattccttatctagaattatacttttaaatatataaaaatataatttgcttttgcataaattgacaagctgctcctaaaattcatatacaaatataagagaccccaaagaaccaatataatcttgaaaaatcaatgaagtttgaggatttatacttccaagtttcaaaacttactacaaagctatagtaatcaaaacagtgtggtagtggcataagaattgacataaagaccaacagaatagaattaaaggtccagaagaaataaattttttatgagtttctgtcaagggtaccaagacaattcaatggagaaagactagtcttttctaacaaacggtgctgagacaactggatttccacatgcaaaagagtaaagtaaggctcctttttcataccatacacaaaaactaactctatattgagcacagacctaaatgtaagtgataaaactcttagaagaaaacctaggagtaaatctttgtgaccatgggttagacaatgatttcacagatatgacactggaagcacaagtgataaaagagatgattcatagttgagtttcattaaagttaaaaactttttgcctcaacatatactatcaagaaatcagaagacagcccacagaatagaagagaatatttgcaaatcatagatctaataagtgactggtatccagaacacacaatgtttacgtctcaataatacaaagacaacctgattttttaagtgggcaaaggatatgaaatgacatttctccaaataagatgtacaaatggtcaatgagcacattgtaacatcctcaacatcattcggcattaagaaaatgcaaattaaaaccagaatgagataccaccagttcacactaggatggctataataaaaaacatggacagtaacaaatgttggtaaggatgtggagaaattggaaccctcgtatattgctgatgggaaagtaaaactgtatagccactttgggaaacaatagggatatccctcagatagttaaagttatcatatgacccagcaatttcattcataggtatatactcaagagaattaagaacatatacttccataaaaactcgtacacaaatactcataggagaattattcaaaatattcacaatagcaaagagtggaaacaacccgaatgaccatcaattgattaatggataaacaagaagtctatacaaggaaatattattcagccacggaaaggaatgaagtaccgacacgttacaaaattggtgaaccttgaaatcattatgctaggtgtaagaatacacacacaagggaccaatattttatgattccatttatatgaaatgttcaaaacagataaatcagtagagatgaaagtagaatgattagtggttgacagagacaagaaagggcagcaagaagggagtgctggaaagtaactgccaataagtttatttttggagtgatgagaatgttttaaatctaggtagtggtgatggatgctgaactctgtgaatatatagctgacccttgaacaatgcacaggttaggggtgctgatccttcatgtagtcaataatctgcttataacttttggtttccccaaaacttaactactaatacactaatagcctactcttgatgggaagccttactaataacaattaacacatattttgtatgttatacatattatatactgtattttttttttttgagatggagtctcactctgtcacccaggctagagtgcagtggcatgatctcggctcactgcaacctccacctcccgtgtacaagcgagtctcctgcctcagcctccctagtagctgggattacaggcatgcaccaccacaaaagcaaatttagtagagagggggtttcaccatgttggccaggctggtctcgaactcctgacctcaagtgatccccccgccttggcctcccaaagtgctgggattacaggcatgagccaccatgcctggccaatttttggatttttagtagagacagagcgtcactatattggctaggctaccctcaaactcctgacctcgtgatccaccctcctcggccttccaaagtgctgggattacaagcgggacatatactgtattcttatgatgaagtaaggtagacaaaagaaaatgttattaagaaaatcataaggaagaaaaatatatttattattcattaagtggaagtgaatcatcatgaaggtcttcatccttattatcttcacgttgagtaggctgaagaggaagggaaagaggagtggctgatcttgctgtcttaggggtagcagagacagaagaggtggaagaggtgaaatgggaggcagaagaggcaggtacactcagtgtgagattttgctttttcatttctgtaaaaatttttctatatggtaccaatccttccaccatttgcttcagttttcatgcccatatcatagaagggtccctgtcataaagaagtcaaaagtagtcttgaataatcagaactcttctgccagattgtctaatgttaatttgttttctggcactgcttcttcacattcttcctcattgtctgtcactggttcagaagcactcatctccgtcaagtgatcttcagttaattcctctgctgtggtatctgttagcccttgaatatctccaagacccatatcttgaaacccttcatttgttacccttttttttttatccacatccacaatttcattcatgatttccctgattggctctgtcataaatcctgtgaattcatgcacaatatctaggcacagttttctctagcaggaatttactgttttgggctttgaaggtttctacggctttttctataacaaaggtggcatcctcaatggtgtaatccttccagactttcagtgttctttttatcgaggttttcttccatagcattgacagcactttccatagagtaccatgtgaaaagagccttaaaagtccttatggccccctgatctagaagctggattcaaggtgttgtattttgggtcaagtagaccactttgatgtctttggtgttgaactcacagcattctgagtggccagggcattttccaatatcaaaagatctttaaaaggcaatcccttactagcaaggtacttcctgacttcagggacaaagcattgagggaagctatccagaaaaagggttctcattgtccaggccttctagtacaaacaaaagactagcaactgggctttatttttttccttcagggctgaggggttaaaaggttcatagataagggcagtcttgatcataagcccagcacaaaagaatagagttagcccatctcttcttgcctttaatcctggggcccacttctcttccttactaataactgtcctttgtggcatttcccccccaagaacagaacactttcatctgcattaaaaaacctattcaggcagatatcctttctcttcaagaagagtctgcaaactcgtcagctgccacttcatcggcagaagctgcttctcctgttatcttgacatttttaaagccaaacctctttctaaaattatcaaaccatcttttgctggcattaaatactacagctttagatccttcaccttccttttgctttaagttgtcatataatgaattcactttttcttgaatcatattagaatctataggtatgccttccttatagcaatcctgcacccatacaaaaggtgcattttcaagacgagataataaaggtattttgcaaaaagtgcaaagtttttgcacatgctggaatagctgcagtgacagcttcacaaatttccttttttttttatttttacaatggtccttatgctgaattcatttatcttgaaatagtgggcaaccacagctgcagacctcaatctacgatacatatcaagaaatttgacattttcttgtaatgtcatgacatttctgtttcttgggagtacttccagcattgctagtggcacttcatatggccccccggtgttatccaatgtttgcagtattgcactaaatacaataaaaatatgcaagaaccacaagagatcactttttactgcaatatgcaatttattggagtaattgtttatatggagataagtggcacacagcattttaaatggacactcacaacacctgagctcaccacaatggcaacaggaggtggctacaaaattattatagtagtatagtatgtattacagttaatttcatgcagttgtgatttaatacttcatctttatgcttgtttacatttctctcaactgcaaatggtgccatgtatgctctatgtgtgcatacattttgataaattttaactttttataatagttgtgtatagtttatggtagtaaataatataatagactagcatcaacacatattttatgcattcaggatatatccatttttttcttaatttttcaatatttctaggctctgcggttcatctatgagttatttcaaattgttgaaaatatccaaataattttccaataaatttattttttagaaatccacatgaatgggctcacacacagttcacatattgttcaagggtcacctgtattaaaaactcttgaaatgtaaattttaaagaattaattttatgatgtatataatatatctcaataaagctgttgctaaaaaataaactcataaaagaaaacacagtagtaaatcttcatgacctaatgttaggcaacagtttcttagattaatacagcaaaaacatacgcaatgaaagagaaaatagataaattgagccacatcaaaataaaatatatagaattacaaaagaaagaaatgttgaaataaacagttatccaaatatttttaaacacaaatttgtgatatggtaatatatgtgcttctttattaattcattaaataacaaaatctagcagtgggtctaataagtacctaattttatctaaaggcttcatttttattttgaacttactgcacacttgacccaaaaccatttagtccctcctagaaaagatagaggtatatccactttatccattaatagctgattaggatctcttattcagaaatacacattgaggatctcagaaatcaacagaatcctctaattcagtagttcttagtcatttggggatgtgcagtttcctttgaaaatataatgaaaatccagaaaaatgcaaaactttcaatatttcacatacaggtttagtagatccattgactccattaactttattcatagaatcaagtttaacaatccctgtttcattaaatgacattattggactcaatctgctaatcctttaatatgacagctaagcactactaccttggagagcaaaatgaaagccttcatggaatacctgaaaggataaagagaaaattctaggatttactgacagactgaatgttcactcaaaaaccactgtaagccaacattgtaagggatagctctctttttaaaaatctcatgtgcaagtaaagaaagagatttttatttttttgaagtggcaattttttaacagcacagcagcctaaggcaacaaggccagttagggctaaaaagaggctgataaaaaaatgtaaaggaaaacattggtaacaagatgcccatagggggctttgaaaacctccaacagagttctagggatctagaaggccatggacatgtacagggctgtatgcatgcccagaaacattggagaaggccctaatctctcccttctggctaatcttgagctctacacaagtagtaaggaaaggccaaggcagagttttaaactgagggagtgttgaagctgtgtcacaatacatgagcaccttagcaaagaatgggagaactattgattcaaggcatttgataaaatcactgtgcaatcattaactgagcactagactgaaaatagacttcaatggctttataagacaaagaatacaggcttataataattagtcaaagaaagtcactaaacaaacaccaacaaaaaacctggtgggaggggctcaaatttccagagtagccacattatgtttttaaaatgtctagttttataaaatacaaaacacgcaaaaaagcaagaaagtatggcccatatacaggaaagaaatataccaatagaaactgtacttgaggaagccaagaagttggatttactggacaaagactaaaccagctattttaaatgtgttttaaatatgacatatcctatgtcaaagaactataggaaaccatgtctaaagaatgaaaggaaactatgagaatttttcaacaaatagagaatattaataaagtgatagaggtgataaaaaaagaatcaaattgaaattctggatttgaaaagcacaataacagaatgaaaaagtcactacagaggctcaatagcagatttgaactgacacaaagaatcaacaaactggaagatggatcaattaagacttctagtctggggaacagaaagaaaaaagggtgaagaaaattgaacagaacctcaaagacttgtgggacatcagatgtaccaacatatacataatggatcaattaagacttctagtctggggaacagaaagaaaaaagggtgaagaaaattgaacagaacctcaaagacttgtgggacatcagatgtaccaacatatacataatggatgtcccaggaggaaaggataaatgggaagaaagaatatttgaagaaataatggacaaaatcttaccaaatttgatgaaaaaaattaatctatacatctaagagttcaaataacccctagcaggataaatacaaagatatttacatcatagtcaaactgacaaaatgaaagacaaacaaagaaccttgaaagcagcaagagaaaaagtattatgtcatgtacaggggatcttcaatatgacaacaactaatttttttttaatcagaaaccatgggcactagaagtcattgtgatgacatatacaaaatatttaaagcaaaaactaccaaacaaataaaactatttataaataaccaaatgggatttatctgtggaatgcaaagtaaccaatcatattaacagttaaaacaagaaaaagcccatgatcatatcaattgatgtagaaaaagcatctgcaaacttcaacatacattgatgatttttttttaaaaaaaaggtctcaacaaactaggaatagaatgtaacttccacaacctgatataaagaatccacaaaaacctacagctaacattaaacttagcggtgaaagattgaaggttttttgtctaaaatcagtaataaagatagtatatctactctcactacttctagtctatgttatgctgacaattctagacagtgaaataagaaaaaaaatcattaaggatatacagattggaaaggaagaaggaaaactctctttatttagaaacaatatgatcttatatgaagagacccctatggaatctacaaaaaaacttcctagaactaaaaattagtttaacaaggccacagaatgcaaggtcaacacacaaatctcaatatatactagcaataaatcattggtaactgaaattttaaaatatagttctggctattatctgaatgttttgtgtccccctcccccaagttcatatgttgaaaacctaatcaccaatgtgatggtattagatggggcctttgggagatggtaagattataagggcacagtcttcttgaatggaattgtgctcttataaaagaggccccagaggacattgcctttcccccttttgcttcaccatatgaggttacagcaagaaggccctcaccagatgacagcaaatctgctggcaccttgatcttgaacttcccaggctccagaattgtgagaaataaatttctgttgtttacaagccactcagttaatggtattttgttatagcagcccaaataaactaagtctcattgacaatcactgcaaagaaaatgaaatacttagttataagcttaacaaaacatgcagaagagctgtacactgaaaactataaaacacaatggaaaaaatgatatactgtatttgtggactagaagacttaacagaataaatatattaacaatcttgacaaagaaaattaaagtggaaggaatggaattgcgctacctaatttcaacagttactatatagctacagccatcaagacagtgtggtatgatgcagagatggacatatagattaatgtaacagaacagagaattcagacatagactcacacaaatatccccaactgattttttcttttgcatttaaaaaaataagtcttactaagatataattcacatacaataaaatttacccttttaagttatataattcagtggtttttagtatatttgaatatatgtgcagcctttactactgtctaatgccagagcatttctcatttaaaaatgaagccccataccccctattcccttctcctgctagcccctaacagccactaatctactttctgtttctatggatttgtctattctgaccatttcatagaaattgaatcatagaatacagcctcttgtgactgactggctactttcacttagaataacattttcaaggttcatccatgttgtagcatgtatcagtgcttcattcctctttaatgccagattatatttcattgtatgaatgtgccacattttgttcatccatttattggttgatagacatttgggttattttcattcttcagtcattataaaaatgctgctgtgaacatttgtatacaagtttttgagtggagatacgttttcatttctcttgggtatatacctaggagtggatttgctgggtcatgtggtagctctatgtttaacaatttgagtagcaaccatactgctttccaaagtggctataccattttacacacacacgagcagtgtatgaggggaccaatttatgtatatcctcacaaacagttgttattatctgtcttttcttataatagtcatcctattgggtatgaggtggtatctcattgtggttttgatttgaattttcctaatgattaatgatgttgagaatattttcaggagcttgttgtccatttatgtatcttcttcgaagaaatgtctattcaaacgattttcccatttttacattggtttgtcttttcattgctgagctgtaattattttttttataaattacccagtctcagatatttattcatagcaatgcgagaacagcctaatacagcaagtgtcactcagatctactttctgtacaagagttctgggagaggctccttcgggacgctgatgggactctcttcctggggatgacttgtaaaaggagggttggtaggatgaactacagcccccctgcagctgcagctggtcttgcggctatagctgatattcattcccctgctcctctgctgtgcattctagattctgcttaccattgatgactccctgtgaaggtttaggtgagtttcctagtggtgtgactcagtctctccaaacggaggcattctagttcctgtttgccataccttctcaggctgtagctgctgaacttgtccatttgccattgaaattgtgcaaggtggtactaacaggtgtccaagttgatgatctgggtatcaaacatatgcctcctgcctccattgtgtaacaatagctggactgcctcttgatgataagagtcaatcatgccaaccaggatcctttccttgcctgctggtccttggcatgaagggcccaaagtgcctggatgatgacgtagcttaaagttcagtgaagactcttgctgtattccctggtggaaatgtttcccctttgggaaccaagacctttgaccctgtgggctacatttgtgaggatgaaaacacaaattctttaagtgggtcactgggaatgatagcaagtggggacactgctgctcccacaccatggattcctctcccaggtattctcttggggatacagcattatataatggtgattgacttcaggcattactgcatcctggagggtagtgcttttttttaattttttaaaattttaagttctggtatacatgcacagaatgtgcaggtttgttacataggtaaacatgtgccatggtggtttgctgcacccatcaacccgtcatctaggtttgaagccccacatgcattaggtatttgtcctaatgctctccctccccttgcccccgaccccaacaggccctggtatgtgatgttcccctctctgtgtccatgtgttctcattgttcaactcccacttatgagtgagaacatgtgatatttggttttctgttcctgtgttagtttgctgagaatgatggcttccagtttcatccatgtccccgcaaaggacatgatctcattcttttatatggctgcatagtattccatggtgtatatgtgccacattttctttatccagtccatcattgatgggcatttgtgttggttccaagtctttgctattgtaaatactgcttcagtaaacatacatgtgcatgtgtctttagagtagaatgatttataatcctttgggtatgtacccagtaatgggattgctgggtcaaatggtatttctggttctagatccttgagaaatcaccacactgtcttccacagggttgaactaatttacactcccaccaacagtgtaaaagcattccaaggacagtgctttatcctcacagggtatcacttccaagctggcactttagccaagctttcaataggctgttccattgcttatgagaccagtagcttgggtggtgtgccatatgatgggttcagtggattccatggtcatgtgaccactgctgtgtgtcctttgctgtaaagtaggtcccttagtctgctgcagtgatatgtggaatgccacattgatggattaaatatagcataagcccttggatggtcatgttggatgagactctgcaggcaggaaaggcaaacccatacacagaatacctgcctattcctgtggaaattaatggctgcccctttcattatggaaagagttcaatacggtcaacttgccaccaagtggctggttggtatcttcaagggatattgttgtactgagtttcagcaatggtttctgttggtgtcagggtgattatctggctgtgacagcagcttgggcccatggatagcctccttctttgcttccatgtctcctctgcttatgaatccattgtgccaggactagggtggctgatgaaaaagctggctgacatcaacgggctgagtcattccatttagttattaaatacctcttcaatggtagatgctcttgggacctgtggaggaaaaggatggaagcaaaattggcagaaagagaaagtgggctgcagtgtagtcacaaccagtcctcagccaaccctgtggggagttctaaaggtgggatgatgcttcagagatgttccctgaggaggtgagagggtcaggtcttttttttttttttttttttttttttttttttttgagatggagtcttgctctgtggcccaggttggagtgcagtggtgcaatcttggctcactgcaacctctgcctcctgcgttcaagcaattctgcgcctcagcctcccaagcagctgggattacaggtgcgagccaccatacccagctaagttttcatatttttagtagagatggggtttcaccatgttggcaaagctggtcttgaactcttggcctcaactgatccccagctttggcctcccaaagtgctgggattccaggcatgagccaccatggatcaggtcttaacagtcccacattgactagtcatttgttgcaggctgtccctagaaggtggcaggaccttgaataaggcaggtttctttagcaagacagtcactgaagaaggctgtcagcataaaagcttcccaaaagctagcggaataaatcctttagtcagttttttcccctatttatttatttatgatacttatagttctagggtacatgtgcacaacgtacaggtgtgatacataggtatacatgtgtcatgttggtttgctgcactcatcaactcatcatttacattaggtatttctcctaatgctatccctcccccagtcccccaccctccgacaggccctgatgtgtgatgttccctgccctgtgtccaagtgatctcattgttcaattcccacctatgagtgagaacatgcagtgtgtggttttctgtccttgtgatagtttgctgagaatgatggtttccagcttcatccatgtccctgcaaaggacatgaactcatccttttttatggctgcatagtattccatggtgtatatgtgccacattttctttatccagtctatcattgatggacatttgggttggttccaagtctttgctattgtgaatagtgccacaataaacatacctgtgcatgtgtctttatagcagcatgatttataatcctttgggtatatacccagtagtgggattgctgaatcaaattgtattcctcattctagatccttgaggaattgccacactgtcttccacaattgttgaaccaatttacactcccaccaacagtgtaaaagtgttcctatttctccacatcctctccagcatctactgtttcctgactttttaatgattgccattctaactggcatgagatggtatcttattgtggttttgatttgcatttctctgatgaccagtgatggtgagcattttctcatgtgtctgttggctgcatagatgtcttgttttaagaagtctgtttatatcttttgcccatttttgatggggttgcttttttcttgtaaatttgcttgagttctttgtagattctggatattagccctttgtcagatgggcagattgcacaaattttctcccattctgtaggatgcctgttctctctgatggtagtttcctttgctgtgcagaagctctttagtttaattagatcccatttgtctattttgacttttgttggcattgcttttggtgttttagtcatgaagtccttgcccatgcctatgtcctgaatggtattgcctaggttttcttctaggatttttgtggctttaggtataacgtttaagtctttaatccatcttgaattaatgtttgtataaggtgtaagtaagggatccagtttcagctttctacatatggctagccagttttcccagtaccatttattaaatagggaatcctttccccattgcttgtttttgtcaggtttgtcaaagatcagatggttgtagatgtgtggtgttatttctgaggcctctgttctgttccattggtctatatatctgttttggtaccagtaccatgctgttttggttacagtggccttgtagtatagtttgaagtcaggtagtgtgatgcctccagctttgttctttttgcttaggattgttttggcaatgtgggctcttttttagttccatgtgaactttaaagtagttttttccaattctgtgaagaaagtcattggtagcttgacggggatggcattgaatctataaattactttgggcagtatggccattttcacgataatgattcttcctatctatgagcatggaatattcttccatttgtttgtaccctattttatttcattgagcaatggtttgtagttctccttgaagaggtccttcacatcccttgtaagttgaattcctaggtattttattctctttgcagcaattgtgaatgggagttcactcatgatttggctctctgtttgtctgttattggtgtataagaatgcttgtgatttttgcacattgattttgtatcctgagactttgttgaagttgcgtatcagcttaaggagattttgggctgaggtgacggggttttctaaatatacagtcatgtcatctgcaaacagggacaatttgacttcctcatttcctaattgaatatcctttatttctttctcttgcctgatttccccggccagaacttccaacactatgttgaatacgagtggtgagagagggcatccttgacttgtgcaggttttcaaagggaatgcttccagtttttgcccattcagtatgatattggctgtgggtttgtcataaatagctcttattattttgagatacattccatcaatacctagtttattgagagtttttagcatgaaagggtgttgaattttgttgaaggccttttctgcatctattgagataatcatgtggtttttgttgttggttctgtttatgtgatgcattgtgtttattgatttgtgtatgttgaaccagccttgcatcccagggataaagccaacttgatcatggtggataagctttttgatgtgctgctggattcggtttgccagtatttcattgaggattttcgcattgatgttcatcagggatattggtctgaaattctctttttttgttgtatctctgcccggctttggtatcaatatgatgttggcctcataaaatgagttagggaggattccgtctttatctattgattggattaatttcagaaggaatggtaccagctcctctttgtacctctggtagaattcggctgtaaatccatctggtactggactttttttgattggtaggctattaattatggcctcaaattcagagcctgttattgacctattcagagattcaacttcttcctggtttagtcttgggagggtgtatgtgtcgaggaatttatccatttcttccagattttctaggttatttgtgtagaggtgtttatagtattccctgatggtagtttgaatttctgtgggaccagtggtgatatcccctttatcgttttttattgcatcgatttgattcttctctcttttcttctttattagtcttgctagtggtctatcaattttgttgatcttttcaaaaaaccagcttctggattcattgggtttttgaagggttttttttttttttgtctctatcactttcagttgtgctctgatcttagttatttcttgccttctgctagcttttgaatttgtttgctcttgcttctctagttcttttaattgtgatgttagggtgtccattttagatctttcctgctttctcttgtgggcatttagcgctataaatttccctctacacactgctttaaatgtgtcccagagattctggtacattgtgtctttgttctcattgatttcaaagaacatctttatttctgccttcattttgttatttacccagtagtcattcaggagcaagttgttcagtttccatgtagttgtgcagttttgagtgattttcttaaccctgagttctaatttgattgcactgtggtctgagagacagtttgttgtgatttctgttcttttacatttgctgaggagtgctttacttccaattatgtggtcaattttagaataagtgtgatgtggtgctgagaagaatgcatattctgttgatttggggtggaaagttctgtagatgtctattaggtctccttgtttcagagctgagttcaggtcccggacctggaactttctgtctcgttgatctaatattgacagtggggtgtaaagtctcccattattattgtgtgggagtctaagcctctttgtaggtctctaaggacttgctttatgaatctgggtgctcctgtattgggcgcatatatatttaggatagctagctcttcttgttgaattgatccctttaacattatgtaatggccttctttgtctctttagatctttgttgggttaaagtctcttttatcagagactaggattgcaacccctgctttttttttgctttccatttgcttggtagatgttcctccatccctttattttgagcctatgtgcatctctgcatgtgagatgggtctcctgaatacagcacactcatgggtcttgactctttatccaatttgccagtctgtgtcttctaattggggcatttagcccatttacatttaaggttaatattttatgtgtgaatttgatcctgtcattatgatgttcactggttattttgcccgttaattgatgcagtttcttcatagcatcgatggtctttacaatttggcatatttttgcagtggctagtaccggttgtttctatccatgtttagtgcttcattcagtagctcttgtaaggcaggcctggtggtgacaaaatctctcagcatttgcttgtctgtaaaggattttatttctgcttcacttatgaagcttagtttgggtggatatgaaattctgggttgaaaattcttttctttcagaatgttgaatattggcccccactttcttctggctcgtagggtttctgccgagaggtccgttgttagtctgatgggcttccctttgtgggtaactcgaccttcctctgtggctgcccttaacactttttccttcattttgactttggtgaatctgaaaattatgtgtcttggggttgctcttctcaaggagtatctttgtgatgttctctgtatttcctgaatttgaatgttggcctgccttgctaagttggggaagttctcctggataatatcctgaagagtgttttccaacttggttccattctccccatcactttcaggtacaccaatcaaacatagatttggtcttttcccatagtcccatatttcttggaggctttgttcatttctttttactcttttttctctaaccttgtcttctcactttatttccttactttgatcttcaatcactgataccctttcttccacttgatcaaattggctattgaagcttgtgcatgtgtcacgaagttcttgtgtcatggttttcagctccatcaggtcatttaaggtcttctctacactgtttattctagttagccattcgtctaatcttttttcaaggtttttagcttccttatgatgggttcgaacatcctcctttagctcagagtagtttgttattaccgaccttctgaagcctacttctgtgaactcgtgaaagtgattctccgtccagctttcttccattgttggtgaggagatgtgattctttggaggagaagaggcgctctgatttttagaatcttcagcttttctgctctggtttctccccatctttgtggttttatctacctttggtctttgaagttggtgacctacagatggggttttggtatagatgacctttttgttgatgttgatgctattcccatctgtttgttagttttccttctaacagtcaggtccctcagctacaggtctgttggagtttgctgtagttccactccagaccctgtttacctgcgtgtccccagtggaggctgcaaaacagcaaatactgcagaacagcaaatattactgcctaatccttcctctggaagcttcatcccagagggacagctgcctatatgaggtgtctctcaggctacacgagggtcagggtcccacttgaggaggcagtctgtccgttctgagagctcaaacgccatgctgggagaaccactgctctcttcagagctgtcagacagggacgtttaagtctgcagagttgtctgctgccttttgttcggttatgccctgcccacagaggtggagtctagaggcagtgggcctcattgagctacagtgggctccccccagttcgagcttcctggctgctttgtttagctactcaagcctcaatggtggacccccctcccccagccaggctgccgccttgcagatcaatctcagactgctgcactagcagcaagcaaggttccgtgggcgtgggacctgccaagccaggcacgggagagaaccttcttctctgccagttgctaagaccttgggaaaagtgcagtatttgggtgggagtgtcctgtttttccaaatagtctttcatggcttcccttggctaggaaagggaaatcccccaaccccttgtgcttcctgggtgaggtgacaccctgctctgcttcagctcgccctctgtgggctgcacccactgtccaaccagtcccaatgagatgaaccagttacctcagttggaaatgctgaaatcatctgtcttctgtgtcgatcacgctgggagctgcagaccagagctattcctagttggccatcttgtaatgcccccactcccccataattattctttatatattgtgatacaagtcccttatcagatatatgatattaaattattttctcacgttctatgagttatcttttcattttctttatgctgtcctttgatgtaaaaatgtttttaattttgattaagtcaaatttacctattttcttttgtcacttggtttctggtgtcatatctaagaaatcgttgttttatccaaggtcacaaagatttactcctatgctttcctattagagttttatagtttttatctgttaagtataggtctatgatccattttgagttttgtacgtggtataaagtaggtgtttaactctactcttttgaatgtggatgtctagtagtccagcatgccccactgatgttcggcaaaggggaaaagcagttcaatggagaaatgagagttgtccaacaaattgggtcagagcaattgttcactcatattttcaaaaagaacctcaacataaacctcttcccttatagaaaaattaactcaaaatggatcatagaactaaaggcatatcttacaactataaaagttgtggaggaaaacataggagaacatcttcatgaccttgggctagctgaagagttcctggacatgacagaaaaagcacaatctatgaaaaaatggatagttttataaacatgataattttgactttctcaaaagtaaaagtttgctccagtaaagacatcattaagagaatgaaaagacaagatacagactggaagaaaatatttgcaagccatatatctaacaaagggattgtatctagaatatatatgtatattctatattatattacatatatataataaaaatgggcaaaggatctgaaaaacacttcatcacagaagatatatagatggtaaataagcatgtgaaaagatgctcaacatcattagccatttgggaaacgcaaattataaccataatgagatcccactacatacctgttagaatgactaaactttaaaaacctgacaagcactaaagaagatatagagcaattagtgaaaatggaaaacagtatagccactctggaaacagtttggcattttattataaacacacccttaacacacaatccagcaataccactcttagatatgtaagttagaaaaattaaacgtatatttagacaaaaacctgtacatgaatggtcatagcagctttactcataattgctaaaaactggaaataacccaaatgttcttcagtgggtaaacaaagaaaccatcgtgcatccatataatagaaaactactcagcaatgtgattgaatgggctattgatacatacgaaaacacagatgaatctcaaaggtgttatgctgagtaaaatgagccaatcttaaaaggttacctactgtatgattccatttatatgacattttggaaaaggtaaactatagggacagaaaacagaggagcagttgtcagaggttagaggttgggagagtttgactacaaagaggtaacaatagggaactttggagggtgatagaactgttgtgtatcctgattgtagtaacagttacatcagtcaatgcagctcttaaaactcctagaaatgtacactgatgtgtgtgtgtgtgtgtgtgtgtgtgtgtgtgtgtgtgttgattataatgattgttacatgggtatatatacctgtcaaaactcatcaaacactttaaatggttgaattttattctgtgtaaattgtgcctcaataaagttgaattttttaaaataaaaaagccttccaccacaatccgacaccttaaaaataactactattgacagtttagtgtgtacttgtctagaacatgtaagcatgtaatataaaagattttccagttgtataaatgggatcactgtacataatatatgttgtgctctatattgctttattcacttagagggcttggacagatgcatatatatacatatctataatgtttatggatctaccatatattagtagttatattttataccattttgtagatgtaacaccatttatttaaccagttctactgttgaatatttaggttgctgccagtcgttttgctactattatctgtgctacagtgaacagccatgtacatacatgtttttgtaagtatattgataagatatatttctaagagtagggttactgggtgacagggtatgtataatttgaatttatatagctcttgacatattgccctctatagaagcaactagaaagtttagaataagaagtgagtacatcgtgcagtttcccatcccaaatccttgaacttcattatctttcataggatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagtaagacttttaattttgaaaacttaatttttaaaaattgagatggagtctcactctgtcacccaggctggagtgcagtggcacggtctcgggtcactgccaacctctgctgcctgggttcaagcaattctcatgcctcagcctccccagtagctgggattacaggcgtctgccaccacacctggctaattttttgtatttattactttttgagatggcgtctcgctctgtcatccaggctggagtgcagtggcaccatgtcagctcactgccacctctgcctcccaggttcaagtgattctcctgcctcagcctcccaagtagctgggattacagacgagcaccaccatgctgggcacatttttgtatttttagtagagacagggtttcactatgttggccaggctggtcttgaactcctgacctcgtgatcctcctgccttggcctcccaaagtgctgggattgcaggcatgagccaccgcacctggccaatattatgaatctttttaaacaaaactgtttcctcccgtccctcctttgtgaccaactcactgttttaaacatcataaaatcattccaacatacatttgctttggggatttgtcaggcaggagctcctgtagcattctctagtcctaatatatagaaataattatattcagatgtttgggtgggtagggtgctgggagactgctgatgtaacatctctgtctattttcaattataggaacgcaatgctgacagcctgatacaaaatcaacattatcaggtaaagcttcctcacagggatgaagcacaatagttgttggctggttctgtggaggagaagcaaacttcactctggctgtgtctggacacgatcccatttgactgggataggaggcttggaaaggctgtaatttatcaagggctgaagtaccttctccaagtggaatcacctgctttataatcctgttcatggcccttatgcactgcctcggcttgatcagcaacaactatgacttagaaagctgtcttccttgaagttacataaaatagaatatatggttggtcagtcagtcaaatatgagagtacctactgtacataaaatactacactagatactagaaaaatcactatgaacaaaaaagatgcaatctttctgcccttatgaaatatattatctagcagggataaaataacacgtcattaaaattacagttgactcttgaacaacagaggattgaactgtgtagatcgacttataggcagattttttcaaccaaacgcaaatagaaaatatagtattcatggaatgtaaaaccacatatacaagagggctgactttttgtatctgcaggttctgcagggtgactgcaggacttgagtatgcatggattttggtacatggggcggggggtcctgggaccaatccccagagtataccaagggatgattgtattaaaattaagtgattacaaggataaaaactgccatgaagaaaaaatacacagggtaatggtaatatatataacaggaggaaactaacctcaatgaagtaaaagcttatctgaatgtcaggaatttagatcttgataaattacaacatgactttaatcaaagaaatagagaagcacttctgtattttgttaaaaaaaaaaaagtaataaacctaataaacattaggacactcttcccaccagctagaaaacagccaagcatacaaatatcaccaacacctcttgagaataatccttgcaaatcacaaataagagacaaccatctctcaccatcctgatcaaaagaaaaccaaagtagaaaaatgttctacagcgtttgaaggaaatgcatccttattctataggtcacttctcctaactttgttccccttagaccataactaacaaagagaagcagaaaatatggtattttgtatgtaaacctcctctccctactcccgccttcaaatgttattacttttataataataaatcttaaataagattcattgtcttcattttctgcttcatagccctcaacaataacaaaaaaaaatgattcctgcatgtctcagtgagttcctcaagtacacatagtagcagaagcaataccattggccttgaaatcagactgaagtagaatcaaagtctaatgctgacacttactagttgtgtaacattggatgagtcagcctcattgagccttgacttcctcatctgtaacatgggaagagtaataaaacttaacttacagagttgtgaaaattgagtgataagtatgtatcatatgtattatgtgcatgtgttgcctgacacattgcagtaagtggtagctatcatcatcaccatcactaatacaaactgtagtgaccatgtgtagaccattcccctgggggcttagtgaaaagaggacattcctataaaggagaagtgtaggttgactatgagaaaaatatcttcactatgtaattagtagacattaaaatcagcagacttagtgactctgaagaaaactctcaattttataaaaggagaataaaactctcgttttactatgagtgttaacgtgtaatccatcctaaaggaaaaggatattaactatatgaccatgcaagaattattccactggaaatacatgtttaccttatgcttgggtaaaaaattttcctttagggttaatttgattctgccactaaattcagagacacaatagttgtttagccaatggacttaactcatttttacaataaaaggctggatcctatgaggattttctactgcaaagaaggtctaagcatgttttatttcctatgtaagtttcttactgtactgagagcctgagaaggagactgaatgcttcttcatgttttgtaattccaggaagttatcaggaatttagtcaaaagatatgtggctgctatgataagaaattccaaaacacatgagggacttacagaagaaaattttaaggtaatttaatcatgaagtggtttttcattttacatatcataagcatcatttaatcttcacagtgtgtgaggtttctggtgatggaatttcatctgcttacaatatagcaaagccagttataatgcttattctcttagaattgtctctcatccagtagacggagagattttaccaatgtatgtcacaccacaatcagtgtcaggaatgaaggaaatctgctgtatgcattcttttaatattctgagtgtttctcagtgtggaaattgaatgctttaaatgatgtggcaaggatgcatggtggtgagggacaagataacaaagggaagatgcctgcagacttaattatcttctttacttaaaagatataagatcaaaaaatctgttattaaatctaaggtcttaagaaactctaccattaaacattaaaattatactagtggcattagcctaaaacaaccgttttcaaccaggggcaattttgtccccaagaccacatttggcaatgtctggagatatttttggttgtcacactggtatctagacagtaaagacaaggttgctactaagcatcctacaatgaatagtacagtctcccacaacaagaattatccagtccaacatgtcaatagtgccaagattgagaaatcctatcctagaacacatctatatatatattttttaatttttttattatactttaagttctgggatacatgtgcagaacatgcaagtttgttacataggtatacatgtgccgtggtggtttgctgcacccatcaacccatcatctacattaggtatttctcctaatgctatccctcccctaacccccaccacctgacaggcccctgtgtgtgatgttcccctcccagtgtccatgaacacatctatattttctaaggcacacagaaagtccattatcctaattcatagacataattcatctactgagggtctgctatgttccaagcactctgctaagtgctctggtacagtggtgagcaagatctaaccagctcctactctcaaggagtgacaaacaataataaagggtgatgaacaattttatattctgacaggttaaacacaggacactgtggaaacacagagaggagggacgctcatctgggacttggggagtcaagacagactttccaatggaagtgatgcttaagctgaggcttgaaagcaaagccagccagataagggcgagttggggagaagaatgttctagacagagagaacagcataggcaaaggcccagaggcaagggagaatatgtccatacaggtggacagcagagagcctaggaaaagagtagaaagatgaaactggagaaagcaacatgtactaggccttgaaaaaccttgtagtccatggtatggcatttctactttttcctaaagtcagtgacaagttagtaacaagttttgagaaggggaagtacatgaacagatttcagcttggcttttaaaggaacaatctagtatgtaagcagccagttggagatagaagacatttcatagaggtttgaacagggccccctgtctcaaaacagcagtctcatcacctgacattcaacttttctagtttcactcgttagagtcttaaaagctttttcctcttcagtagtccttttatatgcagacacctgagagccagtgtcctaatctaataacttgttagttaatacttagcaggagttagtccttatgaaagcacctcaacagactaatccctgctaaagtgttagctaatcctgaatcaactttacccattgtacaattttgccaatggccagcccagccctgcccatggaattattaatatgtttttcttgtgtttgaataatggcagatttttctggtgttttgtgatttgctactaggcaaaaacctggaacataccaaaggtatctaatgtgcctactttgaaataaagaccaagcttcttgacataatatgtctcctctcttttcccaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacatttgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcttcgctaagactgtcataaaatggccttgacatttaatcacaggttactttccagaaaggtttctaaagttacagattcagcttttcaaattgtcaaattcactttgaataataatagaacctgggctacattcctaactcatattaacagcaccaaaagaaatagcatataaccccattttataaaaagaaaaacatgtttttctcagaaatgtatatcacttctgaaaacttataagttttctagcagtgaccttatcaacttgtcagaaaacaggctagccagacatggaactgtattccaaaagtcttctgtcacttacgttctaaagagataatatgtgtaaatcaatctctactattgaaagaaccagtgtcatatgtcacgggagtacattccttttcagatcttctcagggttatcgttgtgacttgggcttaagactttactagctatagtgaagcctcatttaggatgggggttaaagctgaacagctattgccctaacttccatgttggtgacaccaacatttttattaactctaattcagtacaaagtaggaaaggaaaaagattttgttcacttccttactctcttgatcaagtatcataaaaggtatttcaagtgaaaatgcttaggtatatcctctgaccccagaggagttataagccaacttgagagtaaatttataaacataaaaagaactaaaagagaactttataaaggatctactctattccaacctcatattttacaaatagaaaataaagaggcccagagaaggacaatgacttgctcaaggtcacagagctggtcaataaactcaagtcttctagattatagaagacatttattagtaagcatatatgttatatatagatgtgaagtggccactacagacacccttttgttcatttgccaaaaatgctgtgaactccaaaacttcagacttacatatttaaatgtgaagttaaaaatgtactgcaaagtcaaacacaaataatacaaaaatcatttactacttatctaaaatatccatatcatgttccacctacattacagttggcttatcacttccggacaccttggattcatttatttgatctcataaaatctccctaataataaaggtaaaaattacaaagaaaatatttgaattatattagaaagtgaccattgttgaaatatctccacttccagctttatgtccagtgaaatacagaggaaagactaaatttaaaatcattttcggaaaatgccaaactttacagagatataaatgcttcaagttacgcttctgtctactgacatggagatattaaaaaattccctgttctgcctccatcatttttcattccactgtgacctaacttaggctatttcagctaagtcgtaaatacctgtctgcaatttgattaaatcatttttaaaaaacgaacgcctccacttttcaaatgacttaataccttttccaaaaagaactttatagttcttatggcagtgcaaacctcatctgaaaacctcagtgggaactttagagataaatatgaggccaaaccttagcctgaaaatacaaatgaccattggcattcatgttacatcatgggtgaatctcgtgtggtgttttgactaatagttttagtgccccagaccttggtttgttaaatcatcaggtaaaaagtacttgaagataggcagcaaatcctttgtttaaaagtaccttagaaaaattgaggctgggcatggtggcccactcctgtaatcccagcactttgggaggccaaaatgggtggttcacttgagtccaggagtttgagatcagcctggccaacatggtgaaacccatctctactaaaaatacaaaaattagctgggcatggtggtacacgcctgtagtccaactacttgagaggctgaggcatgagaatcacttgaacctgggaggcagaggttgcagtgcactgagatcacaccactgcactcaagcctgggcggcagagcgagactgtctcaaaaataaataaataaaggtacctaagaaaaattgagtatattttcttggtaatcaagttttcaaaagattgctcatatagacatagtcaatgcaaattgatccaagtgttcagatcatttaaataacctcttcataccta

SEQ ID NO: 17435 - DNA, 10408 bp, Human
taggaggctgaggtgggtggatcacttgaggtcaggagttcaagaacagcctggccaacatgatgaaaccctgtctctaccaaaaaaaaaaaaaagacaaaaactaaccaggagtggtggcacatgactgtaaccccagctactcaagtggctgaggcatgagagtcatttgaacccaggaggcgaagattgcagtgagccgagattatcccactgtactccagcctaggcgacagagtgagactttcaaaaaaaaaacctgtgaaaaaaataaatacgcaaatacataaaatctgccttttcaagacacacacgtgaccaagaagcatatgaaaaaatgttcaacattactaatgattagaaaaatgcaaatcaaaatcataatgagataccgtctcacaccagtcagaatggctattattaaaaagtcaaaaaataacaaatgttggagaggttgcagagaaaacggaaggcttatacactgctggtgggaacataaattagttcagccattgaggaaagcagtttggcaatttctcaagaaccttaaaacagagctaccattcgtcccaggaatcccattattaggcatatacccaaaggagtatacattgttctaccataaggacacatgcacatgaatgctcactgcagcagtattcataatagcaaagacatggaatcagcctaaatgcccaccaacagtagactgtataaagaaaatgtggtacatatacaccatggaatactccacagacaaaaaaggacgagatcacgtcttttgcagcatcatggatggagctgggggctgttatcctaggcaaactaacacaggagcagaaaatgaaatactgcatgttctcacttttataagtgggagctaaacattgagtacacatggacacaaaaaagggaataatagacactgggccctacttgagggtggaggatgggaggagggagaggatcaaaacactacctatcagatactatacttattacctgggtgatgaaataaatttttacgccaaatcccgatgacacacaatttacctatataacaaacctgcatgtgtacccttgaacctaaaacaaaggttaaaataatttaaaataaataaaaaataaaatcttacttggtattctcaaaaaataaaaaacaaaatctgtcttttcaggggaagaaaagtaggaaagctttatctcattttcctagtggcttcataatgcagggacctgcccccagggaacagggtatagtaggggaaacacacaggggtgtttagagtttggcgaaaggcaggtgagctctgggcactgacccgtcaccagctatttttcaaggagtctgagaggtgttaacctgcggtctaccccgtgagattgctcagagtgtaggaggatatggtttactagctccggaaagcagctattataactgaggaggaaatgaagcttgactggctagaacagaagcaacaatggaggcccatggagggattttccaggcccctattcctgatctccatggtggcgctgcttcccttattctgcagtcttgctttgagaccagacaattctgtactctgtctgtgccttcttccttctcagcagccctgcctctgccacctgccccagaagggctctgggtcctctcatctcaggacagacaagggtttttgtaattatcttcttgggtaacctccctgtaaggaataggagaggttatctggtcctggtcttttgggagagcattgagaagaaaaagttaaaccagtgggcagcccaggctgcatacatcctgggaatattgcgattattctctccagtaatctacggaaatctactggttgttctgcagaaaaagaattaagagagacaaggagacctgttgtctaagactaaggcaggatgacgtttacctagtaactgatgatgctaggctgaggcactcagtgatttgtctctacatttgtccctgcctacctagccaatctgtccctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtaaggacacttcttctggggactctcccttcccctgctcctgtttcagggtaagggtgttccgttttgtaattgcatttgacaccccagatagtttgtctccctggtatacattcctatagcactttgtactttgtagcaattttaatgtaattaatctgtataattatctgtgcagtgtatattccctgctggaatataggcaaggacaatgttcatcttatttattgctgcctcctcagctcctagcacagtgccttgcatgcagcaagtgcttcataaatatgtgcgaagtgaatatttaatatttccagcacaatacaaggctgactctttctcttgaccctttttctctctcaataatttgccttactgaaggtctgtgttctgggcaaattgtcatgtttaaacatgcaaataatctcggggggctactcctatccctgtgcttagtcttgcataaagaggagactggatctaaaaacttatctactacttctactgactccctcaaatcagactttcagaaacttcagtgtatgagcttggtcagtagatgttccctgagcaggaaatctgtgccagactagctggatgtcaccaaggcttaggttctgagctgaatataggaaaaatcaactttttttcttctatatgctcacactcaacacttctttgaccaactgtgtgaggttttttttttttttttactcataccaaccaattctcctatattagctggatatcctataattcaattccattgtgacattaactagagttaacatagacaccaaaggttaaagactcagtcccataagactgcctccatttcagacaccaatcacaagtagtaggttcccaaattacccacatcttctgtccaacttgcctacaaatcagaggttcccatgaccccctccttggggttggtaatttgctaaagtggcttatggaactcaggaaaagtttacttattattgtagattttttacaaaggatattttaattgataataataattataaatattcatggggtggataatgatgttttagtacatgtaatgtacagtgatcagatcagatcatcatctcatttatcatttctttgtgttggaaacattccatatccttcttctagcgatttgaaatgatataaagtattattgttaatgacagtcatcccacagtggtatagaacactagatcataattttgcatcctttaacaaaggatattttaaagcatacaaaggaacatccagatgaagagataccagatctggaagggtcccaatcacaggagctctgtccccacagaattggggtacttcacctcctggcatgtggatgtgtttaccaactgagaagttctctgaactccatagttccgggatttttatggaggcttcatcatgtaggcatgactgattattaactcaatctccagccccttccccttcagggagtatgggggatgggactaaaagttccagacttctaatcatgacttggtctttctggtgaccagcccctcctgcaggagcccaccaagagtacctcattagaacaaaagacactcctgttatctaggaaattctaagcgattaggcactctatgtcaggaaccagggtcaaagacaaagctctgtgcagagctcctaaatatacgtctgtatgttttatatatttattatttgtgtatatttattatttatatatttatttatttattgccaggccagtagaagacattgacctgttctcccttccctggctcctctaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacgtgaggagagaggggtgcagaggggctaccaggaagtgcagttaggagggcaggccagggaggatcccacagtggcccaggggtttgagatttgagcagcaaataagagaaaatgtgtggatctgaaatgtagaaagacggaggattgaacctcaaggggaacaaggtggctgacgtgagtggaacaggagtaaagaaggggaggtgaggcttgaaccgcgaggtgccatgtggggagcttatgcagaggctggggcatctcaggatgcatacccaagatgttcttgccttgttatcccagattttgatgttccagatctgatgtgggcccaggcatgggaatatttggaatcccaggggattctgacacatgctttttctcacccttaaactcttgcattgacaatggcttgaagtttgtgaaagtaaacttgaagatctccacagtacagaacagtgtgtctcaagggtggtttctgaaccacctttctcagaattgcctggaggaggtgcttgttaaagatgcaagccccttagtaccactccagatctgttgaaagaaagtatctggggatacagcctaggaaatctgcattttaacataattccttggatttttatttaagattgtgtttgaaaaatgtcaagatagaggcaagcaagaggatcacctaggagagtaaattagtaaaagatggcagtattagcaatctcattagtttgactacattcattccaaatttaagagtgagtcctaagttaggcttgtttccttgaactatgtgaggagaaaaagctttaactagcaaaagaacgtattaaacaagatttggagaaaaattccttttccaccttaaaaaaacccaatgtacaactctggattactcttagcttccttatttcaaatactttccagtttatgtacttgaaataaatacaacaacttctagaacagcttgcagttcagatctggcttttactaattgtaatcaaacataattctggaggaggaaagaaagaaaggggcaatgaaggaatgggagagaagaaagagtaatgcaggaatacattctaacggttccccttcaaggggcagcatggcagagggggctggggtggaaagtgggttgcaaaatctacgaagagttgcgatagggaagaaaccaggttgaggaagcagccagaatgtcaccctccttcctaaacatgtttttttctcctatgcagggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggagtaagtgtatggcagatggatggaattagggtcaaagcagagaaaatgagatgtggatcgatacatggtacatggtagacagcgaagtgctgaaaatggggactgagtctggaggaacttacggggggcttaggaccagaatggggaaatgggataaagaaatggaaatatttaggttggtgcaaaagtaattgcagtttttgccattactttcagtggcaaaaaccgcaattacttttgcaccagtttaatatttagtctgtgctattgctgctctggtggtgtggttgatgttgctgcgtctatgtttgagggtgagaggggagcgtgcttgctttgaaatgaggatgtaaatttggcaatcatattttcagaaccccaaattgtaatacactattctagcctccttagatttcaactattctggtgccagaagcagatgggagctgaaggaatgatgaaggttgaagaaggggggcttttcttggtgtggggcagtactgcatttggcctgctctaccaagcatacgggagtagtaaagccacggctggcagaccatttggcatgcatgctcaggggccagtggataaagaattacttacagttcaaacactgtttgaactcagtgtcgggagtagttaaaggtatcgtgagaagttgcacacagctttggggactcttggaaaagaaagaggaagaaatgaggaagaggaagggtgtctacaaagggccagagaacaggatctcagatcagctgctgtaaccaggtttccccttgtgggaagtgttgtttcttgctgggcagttgggaagggaatggagaacagagaagagagtggaaatcacatgctcacttgaactttcctggggaacgtctcctcacagcgtgcacaagagcctccctttagaaatggagtgttcattttatcatgggaaaagaatctgagtgggacatgattcagaacaggaccggcccaaggaagtgcaggggctgtggagtgggatggagacaagctctgaaaggacacatgggagatctagatgtagaaggtacacaagtagtaggataactcacaggatggatccactggaggttaagacatgtggtaagacagtgtaataggaagctgctcagttggagaaagtaaggaagcaaacattgttaccgtgggggcaatggagaggacagtgaggagccctttatcctgataagggtggctttggggtaaaggaaggaaagaggatgccttgagaggccccactgtattagagaggacctggaagccaggatgctaattctggggagatgggttccccaggcttactctaggagtagaggtccatgggacgagggtttgatttgagaaagatcattttcttgggagtgggtggtgtgagctagacccttggagctgggataaaggaccttttaacccactgagaggtggctgcaataaatggaattgccctgggggtgagcaacagaaactgggtcaagtaagtttctattttttgcagcacctgggctgtcccccatgcagaccctgaaggtttctgtgtctgcagtgactctgggcctgggcctcatcatcttctctcttggtgtgatcagctggcggagagctggccactctagtgagtgactcgctgaactcccatccccactcttggtcccactctctgcttactttctgtttgtgattaactctctccttcctactgcatttgctatgaatactgctagatattttcatccacaaagactggtataatcaagtatcttcctctcttaggttacactcctcttcctgggtccaattattcagaaggtaacatctctgttggtctgtttccctacttgccctttggtaggggtgcgggttagaggggtcagtgttgggttcaactaatcttgattattatatgggtgagcttccatgaggatctaggcaagggcatgatttaagctgccattgctaggattaagagcaggaaggagcatcctcctcttctaccaagtgggatgtctgtggagaggaggctgaaggtgcttcctttgtattagttgttggtgccctggagttttcagtatcactgtattaaggcatgggatggttacagtgacaaacgatgggggcaagttgggttgaagcctcattatctcccttttatttattctgtaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaatattgtttttccatgtcttcttcctggggccctggggaaggaatatgggcaaagcagggactgaggttaattctcttctgcttgagtaggggagaaatcaatgccttcttccattttcccacttagacatgacagaatttggggccgttttctgatttataattcataaggagaaattcaactgtggtgggttggagtcacagagtatgggcaaggaagggaattaacagcttactcacctcatacaggatcttatgaggattaaatgagttcatacttgtaaatggctaagaacaccgccaggcacatagccagcctgcaatagtgacgttagctatattcgattattcaactttctggccaggcattgtaccaggtgctttgatcctcatcacaaccgtaaggcagacccctcatacccctcaggattcaggggacagagcttaactccagattgagttctagacagttatttcttccataccctgaatgcagaagggaacatagcttgagtgattattatgtcttaggcactggtctcagacctttatatttgtagctcattctcttctcacaataaccacacaagggacagattgtttccctctatgttacagacaaaagatgtgaggctcagagacatttaagtgacttgtccaaggtcaaagaacagatttctgtaggatgtttgtctacctgagctggaagtagcagattactttattctgaagaccctcatgctggtgagcacacatctcttcagagccaccgttccattcccttctaccccaagaccaaggagagccctttgggggaatggactccaccctaaggaagagaggatgctggctggtggtttgttgtcccacgaagggcgacacctgctggacacagaaacctagggtgtggaattgtttttggaattagagctagatactagaatatgggtaagaaaaagaaaccaagaaatgagttgatttggaacacctccataatttcttcagaagcatccttggaattagagcatctcttctggaaggggttaacagaagaagtcagtggaaggaacttaatctctacattttaccatttttatgtttcattttcatttttttctattcactgtttttgtttttatttttgtttgtttgacaaagcaaattccttttgaaattctagtttagtctaggaatggggggctttgggccttgtctatatctgggcagttttatttattatttttattttatttatttattttttttcgagacagagttttgctcttgttgcccaggctggagtgcaatggcgtgatctcggcttattgcaacttctgcctcccatgttcaagcgattctcctgcctcagcctcccaagtagctgagattacaggcgtgcaccaccatgcctggctaattttgtattttcttagtagggatggggtttcaccatgttggtcaggctggtctcgatctcctgacctcaagtgatccacctgcctcagcctcccaaagtgctgggattacaggcgtgagccaccgcactaggcctatctggacagttttaaaggagaagctgcagatctgaagggtctagttctagtcacagcagtgggaatcaaagtggcaggatcccagagaaaggaagtagagagttagctaatgggacggcttccagttccttttctagagattcccagtgcaggcttttctctgccctaactttgtaggttttttgttttataggaaaggctgtccccttccaggtaaggaatagggaaaagtatatgtaggtctgctaggatccagaaagtcagaatactataggtagaaaggggagttcttacacaggggaatgagtggtacttgaaaggaaggtggaagaagggtgatggtgcaccaattgtaggaggatgaggagaagagaatggatgctgcatgaggagaatggaatgtaaacataatggattgccaaaaaaggagtgcgtgtgtgtgtgtgtgtgt

SEQ ID NO: 17436 - DNA, 7053 bp, Human
ggacagaaagattctcaggacaaattgggaaaaggctcagttcaccaagactgtaataattcccaagagtaaacaccttaataacctaaatgcagagagggcaaaagttgatttaaaaattagaaacaagttgaaaaacctacagtcacagttagagatttaaatataccattcataggccaggaattgtggggcatgcctatagtcccagctactctgggaggctgaggcaggaggatcgcttaagcccagctgtttgaggctgcagcgagccatgattacttcactgccctccagcctgagcaacagagcaaggccctgtctctaaaaaataaataaataaatgcaccactcttagttatgtataggccagtccaaagataaagaaaaccgtaataaattagaatgacaaaatccacatgcttgatccaataaacatgtacatgtataaaattctgcatcacatttattagagcccatgtgaaatatttacagaagttcaccacactccaagccatagaggattatcatgtaattaaattataagttaataacaaaaaacatactttaaaaaatctatgtatgttttcaaataaaaaaaacacccgatactcgactgttattaaccaaagaagcaacattctttatcatgagtttttcatggctttcccgtctttcatctcatggctccagctcccacctcacttggggggaggtgaaggtggcaagggtcctaaccagggcaggaccaaagcagtgaagacactgttcattcatgcgcaggtgtctcctaggcgcctatgatgtgctaggcattacgtagacactgtggactagaaacgaaaaaactaagattagggctccccataaaccgggccatgcaaatcaattactagctgtcatttgattaatttgaagtcagaagctgtgtctgccccacttaaaataggcatcccttattcattgaggaaagagcattggagcaggttttaccagtccacagactacccgagaaccacctggggagcatgctgaaaacacaggttccctggccctgccttggaaaggctaatctaacccattaagtaaagaggaaactcaggaacacgtattataacgaaccccccaggtgattctcatttggaaccagagacccgcatgatttcctagctccctccaagttgaaaatcatcgatttcatggtctttgacacatggcctaatttggttagatttctctttacacagacgttagctttacgttgttgttgttttgttttgttttgttttttaaatatatatactggactaaattctcccagtgcctcttattagccgagcccaaccagaagccaaaggcaagggtgatgccgtcctccagcctgtgtcagcctggaggaggtgcccgggtcctggagggaccaacagagaggaccagcacctctgccctcctcggggagtccacgggagctctttacactttgctttagaccaaacaactccaacaattacacattttttcttacacaatgaaattaaataataataaaagaaaaataaaataacatttttgaaagtgatttaaagttttaagaggtttttattccattgtgtagccaatgttttccttttaaagattattggtaaagtttattttactttctaactcaaaatttgtccacggaaacttcttgggaaagtaggattccctgcatcgcagatggacatagagagaggatttgttggagctcagctgcgcggtgctctgacggccttttctctctcttcagggggtcccttcttggaggacgtggtaatagttggtccaagcccctcccatcctccaaaacttcctttggcctctcctgggggcccagtgaatccttccaccttctcaccccggctctttccctctttacccagcaacagatacattcactcagagaatttctgtgattggctgaagacagcaggggtcgcccccatcctcgaatctgttttcttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaagggtgagtgcgagggcgaggagggtgcggcggggagcagagatttacggagttgggttacatgaggaggtggcatggaggatgcttgttcctctcgctctctggtttatgggcaacttccttcaccaagagacacccaatccccctcatctctgtcacatccactctggacctaaatgaagatgcagctcggtcagctgcgcaggtgccccagtcagcctttgctgacgttcagatttctcctcattccttcctccttcctgagacccaaacctccacccaacagatgccagcaagcaccctgatttctctaccacccctggccgggaatgtgcccgatcaagtccagttctgttgcagtatttatgcccatgccggtagttaactatttacctgtctttgttcttcgggagacatgagctggggtgcgggtctacagatggttcatcttttttttcttttatttccctggcccaccattgtgctgggtgcatgctagttcctcaataactgttgctcaaacaacttcatagagttctacaagaattaaaacttaatccctaacttccagaaaactagacaacagttatggaagagccacactcagtcataatgctctgagatggaggaattgggacatgaaccttgacttctgactcctcgtccagtgctctttgtaatgccttgagttgcctctccctatccccttggtctctgggtcactaaccttaattcttacccctgccagccgtggcctgtttcccctcacacccacctgcactgcatctctgtgcaaagctccatactctcctgtccttaatcattcctcctcatcccacccccacagtcccaccagctcacaacacagggcctgacaacacagccagggcagatgaccacagccaagatttaaattctggaaccccaagcatgattttaggcagtccctcctcttcccatcctgatatgccagactgcactgtctctgtgccgactgcagtgtgctgggatgagcctctttcttcctgttctctctccctttctctctcccagggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacggtaccggccctccctctgcccacccagtcaggcgggaaggtccagagaaacttcctcccagttcctaggctcccatcactctggggcgcgctctcagcgcccgcgcctgtcatgccctgttcctttctttcccaggaggctccaggtcttcccagacccctttggcacccctctccttgaggaatgacacctctcacccggactcccgcccagggaccagtcaaatataggagctcctggcgtccccactccctccccagtctcctctccctctgtttccctcctctcctgccccagtggataccccagagcatcccctgcccacagatggctacaaagggggaacgtcccttaatcccagtcctagtaaggccctggggtgagggatgagcctgtggactcagggcccgttcctcctagtgcctccacgggtgaccgtgctccccaagtctcgggtggagctgggccagcccaacatcctcatctgcatcgtggacaacatcttcccccctgtgatcaatatcacctggctacgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtacggagccccctccccatgcaccctcctggccccaggtttcctttactctagaatcctttcatataccaccgactccttcctttctctcctagagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtgcagaggccccgggagtctggggggtgggggaggaaagtggatgactctgaacaggacgtgggtggagaatcagagattctgttgtggggaaagaagtcagaaaagaaatgggcagggagaaaagaagcagaggtggggtgagagagtgaggttttgggggaggtgggcactcagagataggatcccagcatattgaaattgagcaacctcgatcgtatgttttctgctattttaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacaaacacacattcttgctctacccaaagctctggctggcagcactaaatgctttggtggtgtttgcactgtgtcctttccaggccttggccagttcttccaggggtgaggcatgtggtgctggggattggcagccgtcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaagacaggctcatggggactccactcctgcctgggtttactctgtatgaagaggccactggtatcctgccatgatgttatctcctttttctacttttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacagggaggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagt

SEQ ID NO: 17437 - DNA, 9366 bp, Human
cacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcctgtagcagccagcgcttgcaacccgcaatgagcatagagtatttcttttctgaggggggtcgtctagagtgtccgtgaagggaacaggcacgcgaggctggtggaaaaagcgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttaggatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtcggtccgtcggaaagcatactcagaggagcgtcctttggggccagagtaacttacggcctggtaagaaagacacagtgaaaccacttataatttgggaaatctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttacctccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccgttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcgttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatgtgacctgtcccagtagtgtacagggatgagtaaaggaatagggtctgagagggggacaggagatagatttttgagggtcttctttccatctgtgcttagggatcaaaaagatgattctgtcaagcagatacctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcaccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcgcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagtacctcatgagacggttattttgagaaccacattctatatgtgaacacagtttaaaagctgtaaatcactatcctgatataaataatcaggaagaaggtgatattgtgacccaccataatatcaggcagttaccatacgagaaatcaaggtcgttgggacggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgattctttaacctgaggatccctttcccaggtatatggaaccctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccacggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtattcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagcgtgggtgacagagaaagaccctatcttaagaaaaaaaaaagaaaagaaaaagaaaaaacaaacaaaaaaaacacccaaccctatataggtattattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacatacgaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattggaagacttcggccaggcgcggtggctcgtgcctgtaattccagcactttgg

SEQ ID NO: 17438 - DNA, 5640 bp, Human
agaatcagaaggcacttagtgacaactacatatgctgagcaatgggggaaaaaaaagatactgcctgctttcaaagggttgtctgtaatactaaattctgtgttcatgattcagtcatacccctgaacaaagttacttttttctttttttgagacggggtctcactgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggcttcctgtcctttctgtccattctaatagggaatgttaaagtgctgggtcctttttccatttagagctgccctactcagttgcccacacagtgctattagttttagcagtggtgatgctgcagaccccccagtctccctatatgtagctagtgatgtccctctctgtaaagagaaatgtgagggtaaaacagttcagccttgaggggctgacccagaccagtttagagaccaacaccctggggttggtgtgcagcatcattgtggagtgggttagctgagcctagccagttgcagttaaggtgagtttgcaggtcttggtcactctgggtttttttgtttttgtttttgttttcttttaaggggtcatctagtcataagggaaaatccttcgggctgtgaccgaagcaacaaaggcaaaaacgcggacgttggttatgaagggtgtggtctccctggtggagtacgtcggtgggttgggatggggagcggctggacagaccggtctcactccgtttggtgccactccacccgcccgggtttccgcgccctgccgcgctgctccgacgccgcttccggcggggatgggagcgcgcaacgcggaagcgggcggcagaccggccgccggggcgaggcgggggaggggccgtgagtgccgcagtcggccagccatggagcggagcttgctggcggcgaggccgcggcgacaaggtagccacccccgcagcatgcctcgaccgcggtccgcagctgcaccgcctctccccgccccccagggtgcgctggtcccggtcgcgcgctcagacctccgcatcccgggcgtggtcggttaagtccccggccgtgacccaggcccggggagctagtctccgcccttcgctcttacggatcccctcggagtacgccgcaccatgcagctcaggctcttccggcgcctccttctcgccgctttgctgctggtgatcgtctggaccctcttcgggccttcggggttgggggaggagctgctgagcctctcactagcctccctgctcccagcccccgcctcaccggggccgcccctggccctgccccgcctcttgatccccaaccaggaagcttgcagtggtcccggggcccctcccttcctgctcatcctggtgtgcacggctccggagaacctgaaccagagaaacgccattcgggcttcgtggggcgggctgcgcgaggcccgggggctcagggtacagacgctattcttgctgggagagccgaacgcacagcaccccgtgtggggttcccaggggagtgacctggcctcggagtcagcagcccagggggatatcttgcaggccgccttccaggactcctaccgcaacctcaccctaaagaccctcagcgggctgaactgggctgagaaacactgccccatggcccgatacgtcctcaagacggacgatgatgtgtatgtcaacgtccctgaactggtatcagagctggtcttgcgagggggccgttgggggcaatgggagagaagcacggaaccccagagagaggctgagcaggaaggaggccaggttttgcacagcgaggaagtgcctcttctgtacttgggccgggtgcactggcgcgtgaacccctctcggacaccggggggcaggcaccgcgtatcagaggagcagtggcctcacacctggggcccctttccaccctatgcctcaggcacggggtatgtgctgtcagcgtctgctgtgcagctcattctcaaggtggccagccgggcaccccttctcccattagaggatgtctttgtgggggtaagtgcccgacgaggaggcctcgccccaacacagtgtgtcaagctggctggtgccacccactacccgctagaccggtgctgctatgggaaattcctgctgacgtcccacaggctggacccctggaagatgcaggaagcctggaagctggtgggtggctctgacggggaaaggactgcgcccttttgctcctggttccagggagtcctgggcatcctgcggtgtcgagcaatagcctggcttcagagctgagagtgcctggggccacaggaaaggcaggaacaggaccttctctctcccaggcccaacgcaggggccctcactggctgcagctgatctgtttccttataccagatcctcagtctcactaaagacagcgatatgggagacacccaggggcctggcccgccagcccaaaagatggtcatcgggaagagaaaaagaaaaaaatgctgcagttgttctctcaagctagggcagaagaggggtgtcaagctcctcaataaacttgtctccacttcttcgagtgcagtgtggtcttcaccaggacccccagaacaccacaaacctggagagcccagaggctgccagaccctgctgcatgggaaggacatctccagggacatgggagagaggacagcctctctgaggaggaaggcccctaaaaggcaaagctaaggccacagcagccacaaggtatggggtgggggtagaggcaggacactgacccctccgatcctagaatggcctcatgcttggcaagggggaggggaacaggtccacaagatgatccagacacattatccaaaaaatcgctttcctctttaataccaacccaccccaggagacagctgtccacccccagttggggaaggggccacactgcccccacctccttgttccagggaacactcatttccctacaggtgatcttggggagagactgttcccaggcaaccctggagtctggctcagcgcacaaatctgtccagggcagatggccgggcccccgtgggcttggccttcgcctccttatgatgctgctgctgaaggctctgccggaccttgtcctggggaccggagacggggaggacacaggcacagagtgagaagtggcaggctgacaagggcagaggcacaagcaggagggtgcagcctgtggaaggcccggcccatgccaatgctcatttaccctgtgttcctcatccatgaccttcctcttcctcttcaccaggcttgccgtggagctgcggcccttctgctttggctttggctggaagggagccttagcctgcgggtcatagccctgagggaggggacaggagtgatatctgttacagcctcggagtcagggaactggcagcacccacctgctggccgcacttctggggacaagccatggtggggagaggatgtgggggagaagacgggcctgggcattcaggggcctgctccataccagcctctctatctgctccttctttccctgctccagggagatgacatccacctcggccagggctcgtgggtccagacaaataagctctgcaggtacctgggggtgtcacagagggacaggactcagcaaggagccacaggagggtagcaccaaaaagagaagccagggaggctgctgaacccctctacccaagacccccagcatgagacatcaggagagctttctctacctccaaccccaaaccacaccttccccagcagcaggggcctcactctctgcagcaggggaacctcacctccaacaggggcaatctcaccctctccagcaggggggaacctgaccctctccaggagagggaatttcaccctctccagcagagggaaacctgaccctctccagcagggggaatctcaccctctccagcagagggaaacctgaccccgtccaggagaggggaatctcaccctctccaggaagaggaaaccttaccttctccagcaggggggaacctgaccttctccagcagtggggaacctgaccttctccagcaggggggaacctgaccttctccaggaaggaggaacctcaccctctccaggacgggggaacctgaccctctccagcaatgggggggatctcaccctctccagcaggggagcctcaccttctctagcagggccttcacctcccactcctggcgctgcttccggcttctgtatggattactctccaggccatcgaagttgggctcaccggcccctgaagggagggagggagaagcatggagccataaggaagaacctcagtccaacagctccagcccaactaagcccccagttcctggatgtctctggcccaaacttccacccagagttcattcacttcaagccccatcccctggcccactcaccagggaccagcatgctggtgatgcccccagtgtgccccacccccagcacatcttcaaaggggcagaactgaaggccatgcacagggcctgagagccggtgggtgaggtagggctgttcaagggagggtgggctggccttgccctgccctgcccag

SEQ ID NO: 17439 - DNA, 15229 bp, Human
ctatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtatgcttgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgatttccagcttcctccatgtccctacaaaggacatgaactcatccttttttatggctgcacagtattccatggtgtatatgtgtgcattttcttaatccagtctatcactgatggacagttgggttggttccaagtctttgctattgtgaatagtgccgcaataaacatatgtgtgcatgtgtctttatagcagcatgatttataatcctttgggtatatatccagtaatgggatggctgggtcaaatggtatttctagttctagatctttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacttttcctgcttacacccttcctcctagacctctccacacccctcctaggacacacctaaaaggtactgacatcatgtcacctcctcatctttcagggtagcaaggttggaatctcctgaatacagcccctcaagccctaaaacctcttatctattaccttgggttcattgtccaggaaggggaggagaacttgaacttgtagtcacagaagggtgctgagaactaaccagcaggacggctcagccctgggaactgcagaggggtgaggctggggagagaggaggctggagcagcactggtgacactgaacagtgtcaggaggaagtgacggatgcagcgcccccatcccataggcagagctgtcatgtgggatgagggacagtgttgggagccaccaaggaaacccagaggtgggggagcagagagcagaagggggcatgtgatgctgggcagtgaaagggaggacaggcaaaggctgggttgaggtttgtagggggaatgagatgaggcagtggagccatgtgacagggactgagggtagattactggagctccctgcgtagaatgaatgttcaatcaaaacctgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaattgaacaggcaggggcggatggatggcagaggaggaggaatctggactcaaggagctggggggctctgggcctggaattttagggtctggggcccaaggcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgctaggggtgaggttaataaactggagaagttaatttgtggagcatgaaacagatgagcagaacaatcacagcaccttaatttccccagtgtgcccaagaacagagcaggcctgaagatactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaaaacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccagggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatactttccacatcttttgacaccaagtctttctgcagccatgtttgaaaattaactttcaggctacagagtctttcttataccaaagttgaagaaagttttaagaaatatatttctacatctcctacatgcaaaacaacaggagcaagttgaggaattctcaagaaactggtcgagaagagagagcgcttagctatggaaaagagaaagaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccacgtgaaacgtctccgcctcctccagccaccagcagaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgaggtgagtgagggctttgggccggcggtcccagggcagccccgcgggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgagatacatgagaccatccagggagaggggacccagggggaagagcaaaggaccggatcctgggaactggacagttgtgatttggccaagacagaaaagcctgtgaaagagaccaaaaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgtcacagggcagtgtctcagttcattcgtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacttgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcaggccttaactccagcgcaccctggaggtcactgatgtggctccaggctgacctgctcctgtcaaagaatattgagcaagatgcctctcgtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccagaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtttgacagaaaagaaatgtcagaaagctctagaggccactgatatcagataatcggggaacaaacatgacctatagcgagagagggatcccaggctgggatcttaatgcagccagatgcatgaggtcccaagtactcaggctcctgcggagcgtccattgagtgatgggcaatggaatttggtgggatggaaatgtttctctaactatctgaggtggtttcaatggctgaatacataacctttcctctttcatttcagttcaacgaggatctgcataaacaggtaatattcctgctttgatttccttggggggtgggttacaggaggatatgactcttttctgtgcattgtaatactgaggctcctccaggaagggaatctcaggcatgaacccctctttcaacctcagctctcgggtgagtggggaaaaagcattgcacggctccattgctgaaggaagcagagatcagttctgttctttatcagcctaagatgcagcctctcaccataatttttctctcctggacttaaaggaaggaggccagcaacctgggataacttgtcctttacccccacagggttcctgacctcaccgaaaagactaatgtgccttagaacaagcatttgctgtgttttgttagcacctggttccaggacagaccctcagcttcccaagaggatactgctgccaagaagttgctctgaagtcagtttctatcgttctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagagacaggtcccagaggagacaagagctgagagaccatccaaactgggaccaccttgtcactagacttcaaattttcaatattgatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacgctgcctcagatggttatcaaggggtaccctaagaagaaatcatctcaccctctctttgtccccatttgtcaagtagcagtgaggccgagccaggggatggtgaaagtggaaggaggtgggagttgggcattgggtgtgaagatgctctttaaaggggttttaataaccacttgctaccaggccagtgaacacttatcatagttgatgcct

SEQ ID NO: 17440 - DNA, 8413 bp, Human
atgaccgtaccaccgcattccagcctgggtgatagaacaagaccctttttttttcctttttttttttttttttttttttttttttgagataatctcgctctgtcgcccaggctggagtgcaatgacgcgatctcggcttactgcaacctccgcctcccggattcgagcggttctcctgcctcagcctcctgagtagctggagctacaggcgcctgccaccacgcccagctaatttttttgtatttttagtagagacggggtttcaccatgttggccaggatggtctcgatctcttgaccccatgatacgcccacctcggacccccaaagtgctgggattacaggcgtgaaccatcgcgcccggccgaccctgcatttaaaaaaaaaaaagacaaaagaaaggaaaaaaaaaaaaaaaaaaagaaaaggtggtattcatggtgccttggtgaaagaaacagggtacatttccctttattttaaacaggtaagattacccccaggagatttcatggttgagaactatacttttgaggggggaggggaaaaaagagaactattcttttttttttttttcttaagagggtgactctattgtaaaaggagaagtgaagaatgagaacctgtactgcaggtgtttccttaggaagaccaattttgggaaagttgaggttcttgaaattaaatcccttacatcttccaagtcccagtcctcgcggagagtttttatgttccccattttgaaagctgtagactttgacgactggagagaagtgatgtgggattgttcaacggacgggtgtttgcgattctaggactcagcgttagggatctaataagctctgtgaccctagttaagtggcaagatgcccaccacttgtggaaatgggaatcttagcgattgggaccctgttaatctttctggtttcctcataagctcacctctggacccagccttgcctccacgagtccctccagcctccctaaacacaacgaggtgggtatcaaatctgtttcttcatccttcattcttttttcccctctccccgaagaggaggaggaggagacccaaagtattttatgagcctcatttcgcctcacagcagccctcgcagcggcaatttgcacaaactctcctccaagccccaccccatcatcgcccatccgcagaccctaggcctcccacgacaaagcacggccacctggtcagcacagacggcccttcgaggaccccctctggagaagaaccattcaggtcccaacggtctggctggtcattagttctgtggtgaagcttgaaaagcaaatcagcaacaatagtaataacaataacacttttatggcgcgttgtgctcatttgtacgcatgtgttataacgatcgcgggacgcagcacctggcagtagaaacagctgctggacagcggcaaggagcgcgccgcccttgcaggggaaggggctgggtcagccgaataagccgtggaaatgggaacctgggggacaggaaagcagggccagatagcttgccaatagcccaactgaaagaaaaggttttacttcccttttaagagacttctgcccttccctgaaactctgcacagctttggaaagcccaattcctaatccaccctgttcggttcccctgcccctccttggaaacgaggctcggtcctccctacgcgctactctccggcggttgggccccaggcaggaagtttctgattggcggagtcgtagaagcaccgggtgaaaagagctccactggctgcgcaccggagtccgggcgtagccagtgccgtacggcaaaatggcggcccccagctgctttgggacgcctgggttcggggagacaaactccgacctggaagagaccgttgactatgtgggccgcactggaggtgttcgcggggcgggcctactgtcacctccggccacaggaagcctgtgttccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggtgggggccggacggtgcggggatcagaggcgggggcggggatatagagggagaggtattggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcggtgcggggggacttttgatcagttacgggtcaccgagagaatggggaaaattagggtggggtgaaagggaggggacttgggtaaaatatcttcaacctaaagccccagtttgaggagactcatcggagggtgaaatatggagataattcaaggaggagaaaagagaacggactgttgggagggaacctctttcacctcagagagtctaggagttggggtgatcattcaggatagggtgggtgtggggttgacttgtttgagagcagagggggcaaacacatgaggtggcgcccacaggagtgtgttgtctgtgcaagggggtgtcaggacgatttggggtgcagtgtgggaggaagaatcaacttgccaactctaagaaataggggggaaatgcaacagaaagaccggaaatcgacgtgaggggtggagcagaaggtggcaacttaaggtgtgggggtggtttgccccccccccacaccacttgaagggccccaaaaagcatatagaactaatggttattgaaatcaggtggtgaagacagtgttggtcagggctggatgttactgaaacccaaggagttcagaaaatgtgtgaggtgaagggatggggctatgctggaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagaggtgagctttagcggggaagattgttgtaccccagggagggggatggctgactggttctcctgtcctttctttcccactaaccccacctcccctttctctcaaccccctcccttgtctctcttccccttccttcttcccctgaaccttctagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggtagggggttggtgggatgcctctcagtgacccttatatgtcaggtatgaggcggatggggcatctctctagtcctttctagggtttttactcttctagtcccttcaagggctgagtgctctgactttatgtcttcccacgtaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgaggtgtggatggggtacagccttcagagagacattgtccttcccctgcactggccaccagggagtccaggttgactgatgggggagcatgagaaggaaagcaagaaccaaaccctctggggcaagggattccttagagaaacttctttgtctcccagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtatgtcaagggaacattctcctcacctgtcatttctgttttgttaggcatgagccacctgtttgaaacctttcccttcctcctcctagtgtcctctcagcagtattttttccccctcattctcaggctaccctctccccttttcttcttttccaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacaggtaataacaagaggaggaggaagagggaagccaaggagggattgcaggggactttcggagagcaatactggggaactgagtctgctgggagagactggactgcccccctccagcctcagtcttcccgtacccctccacatatttatgtttctgtttctagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatcactgtctttttcttgtccttctactgttacagattggcattagctgtccccttgctcagggttagcccagtatccccggggtagtcccgctctgtcctttctagcctggcctttttttttttttttttttttttgtctcgctgtgtcgcccaggccagggtgcagtggtgagatcacagctcactgcagcctggacctcccagtctcaagcgataatgcctcagcctcccgagtagccgggactacaggcgcgtgccaccatgcctggctaatttttgtttttgttgtttgtattttttgtagagacggggtttcgccacgttgttcaggcagtacttttttttttttttaagtgcttcagccgccttaacgcactttactttttcacttcgtgcagtaggagtgagaaagccaatgaggggccgactcaaggttatttagccaatccaggcccggagaaagggggcggggcttcagtgggactgtaaggagctaggaagagggcgattagatcccaccaaccagctaatggtcacagctcagaggcggagcctggggaacgatacctggacccatcgccaatgggaaaaggcaggcttatagctttaaaggggaataaatgcttcggccgaaccaagtcctgagctcccagcggaggaggggacctgatcttttaaggtggaatgtggcgatgtttctttaaaggcaaagtggccgagtcggccgagtattgcccagcggcacgggcggggtgcccggctgtgcctttaaaggcggaggggcgggaggcggagcggaggcggagggcggagggagtcggcgcaagatggcggcgggaggggcccaggttgctgctctggccgccgagtgaggggcggggggggcccgggggcgcgcggcccggtaagcggggacgcgcgaggttggggggcgccttccgggtgggagaagaggccgaggtagcgcttggggcggagcgggggggggcggggtccgttgtgggcggaggtagacaaggggcggggtcgaaaggcccgatagtgggcggggcacggggggggtgggcctggaaaggggcggggctagagaagctggggcgaaagggggcgtggtcggcgagagagcttggggggcatagcctgaggggagatggagcaagcgttggttttcagtagcagagctgccctgccccctcccaaaaagtgggtgcaaaacaccaaaaaggtagattttggaatgtcaggctctcaggtaagtcggaaatagggtataattccgaaggaagccactccagcccctaagagcaccttatttctctaacctccaaggaaagggcacaagatttgtcagatacctgtgtttgctggcgctgccacttgctgtgtgaccttggataatctcttaatctttctgagctttagtttcctcatctgtcaaatggggttgagaggaatacctacctcactgttgtggggagttacacagataatgagcgtgaacatatttttgagttgtaacgggctgtgtcgttatgagatgttatcattattcttttctctttttcttcccagagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgc

SEQ ID NO: 17441 - DNA, 9267 bp, Human
tgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctctgtgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtccagaggcggggctagcgcgcgctcccaaactgttggctctttcctcccgtcccgccctttccctgcctttccgttcgaacggctggggctctgcccgctcgctgcccattggctggctctcggtggcgtcaccgccttgggtcctcgcgcccttcgtctgcgccagccctggaagcacggggcgggacgtccacgggaagcggcgcgcacgcccgccgactccctcgcgccaaccgccgacggccgccgcccggtgaaggaggggctcagtcctcccaggtgccgcgcgcaggaggggacacgcgtgcgcaaaagggcggtgggtggggcgcgactcgtcacggggagggcggggctggggctaacagcgagtggagggcggggcgcgcgagggaggagggcgtggtgggggcatcgagaagggtgaatggagggcggggctgtgaactggggccggggggcgggacttggagtgaccatggggggtggggcagctaacggatgtggcatggggcgggggaccaggccggaggcgggctgccgggaggggggattccctcgtgccccaagggcgaatctcaggtcggaggaaggggctgaggggattccctctcccaccgggtccgactcttcgctccccaagccgcggagggccagcctcttcttcggcgccctccaggcctgttggaggtgagggaggtggggtgaggtggtgcccgcccccccctccggctcctcctttcccccagtcctcccctcccaccaccctcccccccaaccggtccgtccctcccctccctccctcccccccgccgcctcctcctcctgccgctgccgctgctttggctgctgcgtcatacgccccagagccgccgggacggaggggctgggcctggggaccccccggcctccgcctgcacgcccccccacgcccggacgtgccctctccgcgcgggggactcgcctaggtctcctacgtctgcccctgcccggctcccggcggccccagctgtcaccggtaaggaggcggcaggaggcgctggtggggggcagggagccgggggtcggcgcggggcgcgggcgggagagcctcgccgccttggcctcgggtccgggctgggccgacacaagtcccttctcggacttgccgtcctggggagtagagaccgggactgggacacgcccccctcccggggcactcagagaagttgtctaacccgggggcagggagccccgaatttgagggtgacctgacataacctggcaccaggatgattgttcttaatgagacgcgcaggcctggggagacagccgtttctgctctggaaaacatctccagaaaaggtcccaaaacacgtctctgggcaacaggacaccctaattatgatacctctaaactgagtagcctttgcttctacaaccataatttctcctaaaatttcaaggccagtatataatatcccaggagagctctggaagctgggaaactagcaactaggtttggggtcggggggagggctgttagttaccgagaggagagccagtcactagagttggaagaggactcaaaaagctggtgatgggtgcccagtggtttcctatcaaggtgtctcagggatttggagatgggggcacagatacttcattcttgatggcaaaataggcaaagaaaatggggaggctggccgggcccggtggctcacgcctgtaatcccagcactttgggaagctgaggtgggtggatcatgaggtcaggagttcgagaccagtttggccaacatggccaacacctcatctctactaaaaatacaaaaattagccaggcatggtggcatgcgcctgtaatcccacctacttgggagactgaggcaggagaattgcctgaacccgggaggtggaggttgcagtgagccaagattgtgccactgcactctggcctgggcgacagagcaaaactccatctcaggaaaaaaaaaaaaaaaagaaaaagaaaatggggaaggtttctcagcattcataaccttctcctccccatttcttttctggctaggcccccccaggatgcaatggcgcagcccccccggctgagccgctctggtgcctcctcactttgggacccagcttctcctgctcccacctctggccccaggcctcggctttgggagggtcaagatgtgctggccagatggactgatgggctgctatacttgggtaccatcaaaaaggtaagaccttctacctctgaccttcttcctagttcccttatctaattctggttcccatttcatcctgtttgctcacccattccaggtggacagtgctagggaggtgtgtctggtccagtttgaggatgattcgcagtttctggttctatggaaagacattagccctggtaagactctagagacctgagattgcacatcccatggaaaacaaacctggcctagaggggcagaaagagacttaaaggcaggccctgtgacactgtgttctctcacagctgccctccctggagaggaactcctctgttgtgtctgtcgctctgagactgtggtccctgggaaccggctggtcagctgtgagaagtgtcgccatggtgagagggcaggtcacctgaatggtccagcttgctcttccctccaggatggtctctatatcacctgtcctggccttagtccccaagccactgctctggccaggctgcttagccttatcttagtcctcatccgctttcagcccagggagaagcagccatggaaaggggtggtataacctttgcaggcagaagatggtttaaatgcatccttttctaaccatatgacctcggacaagtcccttaacctctaggagcctcagttccctgacttgtaaaataaggataatgcaccccctcatcaagaccatggtcagggattaaatgagatgggtaaagactattcctgtcccaataccaagcacacacaggtatgcaataagtggtctactattatcactgcagcttatcaccaggactgccatgttcccagggctccagcccctggagagggagagggcacatcctgggtatgccgccagtgtgtctttgcgatcgccaccaaggtaaaggcacttccctgttacccttcctgtgggagcctcccatccacagcctctcccaagccttttcctctccccacccctctgaagccacccacctgtcctgtctctgcagaggggaggtgccctgaagaagggcccctatgcccgggccatgctgggtatgaagctttctctgccatatggactgaaggggctggactgggatgctggacatctgagcaaccgacagcagagttactgttactgtggtggccctggggagtgagtaatgagaggggagcagactgtggaatgaatgatgtggtggtggatcccaggaaatgaaggaaaaagaacaggatgagggtagcactcagggggataggaggtaagtttagggtttgggacagttatggggaagggggtttctggaggccagaagtcctgtgttccccctcaggtggaacctgaaaatgctgcagtgccggagctgcctgcagtggttccatgaggcctgcacccagtgtctgagcaagcccctcctctatggggacaggtgagaccaaggcagactctctaggagccaaggatgccctctttcttcgtgttccaccctcagttctcccacgcccttctccactccagtctcttcccaacctctgcagcgttacctcacctgtttgccccgtccttgcttgtgagtcttccaggggatggcacagttttcctgtgtaagtgtgtttgctccctcttgcccatgtccaggttctatgaatttgaatgctgtgtgtgtcgcgggggccctgagaaagtccggagactacagcttcgctggtgagctggattgggcatgacctcagtgtaactccacaccacagtatttcactctatatgccccaacctcccacctcaggactcccctggctcttaaaatgcctctgtggtcttgaaaactttgtttttccagggtggatgtggcccatcttgtcctgtatcacctcagtgtttgctgtaagaagaaatactttgattttgatcgtgagatcctccccttcacttctgagaattgggacagtttgctcctgggggaggtaaggggtagtgcagttttgggggttgggatgggacagggagatgtagcggaaaggggaagagaagaaatcactgctcccctggccccatttttcttcatttctcccagctttcagacacccccaaaggagaacgttcttccaagctcctctctgctcttaacagccacaaggaccggtgagttggagggaagaggaggcaaggatgaggctcggaaagagatggagagtggaagcctggaaggggaggggcttgcaacccacctggaagactgtgactgaaaaggattgaggaatggcgtaaggaggaaccgttttttacagcactgaccctatatcatttctcttcttgccccagtttcatttcagggagagagattaagaagaggaaatgtttgtttggtctccatgctcggatgcctccccctgtggagccccctactggagatggagcactcaccaggtcactggtccaggggggatgggggaaattctcagggtgttagtcctggggggtatatgtatagagatggggaggtcttgggggtgtccgggagggggctggggggataaggaggcctcttacagcttcccttcagggcagggccctgggggaggggtctcacgtcccctggggaagcgccggaggccggagccagagcccctgaggaggaggcagaaggggaaagtggaggagctggggccaccctcagcagtgcgcaatcagcccgagccccaggagcagagggagcgggctcatctgcagagggcactgcaggtactggagcagggggaaccctatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctg

SEQ ID NO: 17442 - DNA, 11440 bp, Human
gaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaacggttctctcattccaacccctttccaagctcaatgaatattccaatcacctctggtcccttccagtgaccctgaaccgctcagagaacgccccgtcgacaccgttcggggcgggcgccactactggcgcatgagatgcgctcaagcagagggtactccaccagcgaggatacaccgagccgacggggatctcggtctcggcgccggaagcctctgagagccgaatctggaaccggatgtggctgcttcctgccccgccccctgccgagggggcgggaatcgagggcccttcggaaaacccggccgggatttcggtcagctacattcgtgggttgtggtagggagggtaatcccgtggggatggagtgaccggctctctctccgcctgaaacgcttcccgcgggagttttagccgtgttattgttggggaagggaatgtcaaattctgctcctgccttcccccaggggctggagactggaatctttattccagttcattgcgggtcgacgtggtctccagaatccccgagtgtagaggcggaggacagtggagctggggactcgggcgcctgggtcctggtccctgagcgtccagcgctcccctagtccgcggccctggctcctgtcctcacttccttccccttttggctcctgctctcggagcgggcggacgcgggggggagcggaaagggcgggagggcccaggagcccggcgggggggttcaagggggtacggaaaagccggggaggggactcggtccggggccggagaccgacggcaacagcggctcaggacccacgctgcccccacccctcccgagcaggtcagagcctgagcaccctgcgcgtccccgtactcgtgacctcctccttccccaacagcaccaagggcccccctattccacccttctgttgccccctcccccaaccttcctgcagaactcccttccggtcttcttgacacccacccacgtcccttccctgcccggttcccccgcgcctgcctgactctccacccccaccccaccccgtctctccccaggcgcccccatggcccgaccccgctgattccttcactcggccatgctcccgcggcccctgcggctgcttttggacacgagcccccccgggggagtcgtactgagcagcttccgaagccgggaccccgaagagggtgggggcccaggtggcctggtcgtgggcggggggcaggaggaagaggaggaggaagaagaagaggtgagacgcgggtggtgggaggtagggggcgtatgtatttctgaagtctccacttttctcttgtctctgggtccctacatctcctcctccttgcctcagttattctcgcgcctccctgggtgtcggcccgtttctctgctgcggggagtcctggcgtctccgtggttctctgtcagtgtgactcaggacctgcccgcaggaacctgccctgttcctgcctggaacttctggctggctgtcctgtccctgcgggtctttggccctccacctctgcctgcctgagtgtgcctacctctctgagcagtcgtgtcttggtccctgtctccctccttgtttttgtttggcggggaggggtttgtttccacagtaaccagctcctctgactctgggattggggagggaaccctcagatttcgtgacccctccttccctctctcccccttccccccgcccccccgccccgccccggtcctgggtagaggccgggaagccacggttctgggacctggaggaaagatcctagggtgggtagagagtggtcatctgttttcattagggattaatggtggtggccaggagcaggatttcgggcctcaggaggggccagaatttggatttggggccccgaggccctaaactcctaggtccagatcctaggtgagggcaggttgactggcagggctggtttttcgggatcggtcgggggaggggctggggccacgtgactctctgagtctaccgcccccaaccccctatcatcccacttccccttttccttcctgtactgggattggagctgctaccttcgggggtcccttagggctgagatagtggaggcgctacccgagggaccagggtgaaaggggtcctgaaaaagactaattctctgggctggtatagtccttggccgggaggggcggggcatgcggcagtgcctggactgaggtttcagctacccctagtcgctgcctctggcttgctgcctctcgcttccctctcctgccctttgtaccctgcttctctgtcgtgtgtgggttcagctctggggagaaggggctttgggggtctccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttaccgtcacaagccgccaatatcgacctcttgatcccttggtgagatcatgactttagcttctcacctctgactcttcattcccagttttccttcctctggctgactttctggccagagtgctaggttggagttctggagtcctggactctgctgtgtgacataggccaagactcttgccctctctgaatatcagaaaaatgagtctggaacatctcctgggtctgggattgtcctcagaaatctaggtgcagagtgggagaaagggttagcgatcatctctctgtgttctccaggtccctatgcctcccccacgttcctcccgacggctccgagctggcactctggaggccctggtcagacacctactggatacccggacatcagggactgatgtgagcttcatgtcagccttcctggctacccaccgggccttcacctccacgcctgccttgctagggcttatggctgacaggtcagagtcataagggacgcagggtagtggagtatctgcccggatttcctaaagccgcaacatcccaccaaaatagtcaaagccactgagggtttgggaaaaatggacagatagatcctcttctccccctcaggctggaagcccttgaatctcatcctaccgacgaactagagaggacaacagagtgagtgacccctggttcttaatctcacagtcccctctgcccaggctgcagctttacctctcacccttggctgattcccttctcccagggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggtgagagagaagattgccctacggtttgtggccatggaatggagaggcctcccatagccttagctctcttctttgacccccacaggagtgccggctgctccgaaacttctcttcagtttatgccgtggtgtcagccctgcagtccagccccatccacaggcttcgggcagcctggggggaagcaaccaggtgcggaggctgaggcattggactggggtgggggttcctcagaaggcggggaagagggggtgacagagccaggcctgtcctcagggccacttttctcccttccccagggacagcctcagagtcttttccagcctctgccagattttctccgaggaggataattattcccagagtcgggagctgctcgtgcaggtgagagcctggtttgtggcattcccacctctccttgttccctactgctcccccatgtctcttttattttgtcaccaccaggaggtgaagctgcagtctcctctggagccacactccaagaaggccccgaggtctggctcccggggtggggtgagtgactagcggggtggtgggcgtgggggtggtgattatgaaggggtgaggagtatgttttgggggagcagcctgaaggatgggtaagggaggcacagaggggtgaggagaatgaaatctgttctctgaggcaatgaggagggcaagtgcggagggatggagggccctcacgtcaatggcaggcacttctgaccctgacccctgacttcagggtgtggtcccataccttggcaccttcctgaaggaccttgtgatgctggatgcagcctccaaggatgagttggaggtcagtggtgtgtgtgtgtgtcattgcaatgatgtaacaagtgggctgcagggtcggacagacccccccgccccttgcaaggggctgtaaggcacaaatagctgagtgtgggacagagccagatctgtttctgtgccaagtcgcctcagtgatctgtaaatgggaaactagaaatagcatctacattgatctgttataagggttaaatgaatttgtatttgtcaagtgcttagaacgtgcctgaaacgtaagcacatctaggttttgtgatgggctcctgctctattgctagagtttgttaaataaacaaatactgagaccttggacaagttccttatcctctctggataaggaatcctgtcgaattggatactatccagtcctctcatctgcaaagcagactcgttgtctacctgagaaattcaatttaaagggtcaagtggagtgcttaggccatgatagattgaggaggaaggcagggagggatcgaagagtcagagaggctggagggaagtggttgtgagttggatgtggctgtgtgtgtttaagagaggggatattctctctctgtggccggaaggtagggttggaactttcaccccatccccattttcctcgcagaatggatacatcaattttgacaagcggaggaaggtgagcggagtgtctgggctggatgctggacttccctatccatgttccaggaaggggagggggaaaagtcaggggtccctgagttttggctcctgcagtttgagggctccttcccaggagtttgcagtcctttctgagttgcgacggctccagaatgaatgtcgtggctataacctccaacctgaccatgatatccagaggtggctacaggggctccggccactgacagaggctcagaggtgactggcgggtgaggttgggactccagggttctggccaggtgtgggggattggtgtcatgtcctgagctctgcctattgcccccctaacccagccatcgtgtatcctgtgaggtggagccacctggttccagtgaccctcctgccccacgggtgcttcggccaacattggtcatctcgcagtggacagagtgagagattcactggctggggggtggtttcttgggacttccacttttctctgatcctcccaatctcctgccactgcagggttttgggctctgttggggtccctaccccgcttgtgtcctgtgaccggcccagtactgggggagatgaggcgcctacaactcctgctcctctgctgactcggctggcccaggtgagctctgctcctgactctgaccttgacgctgaccctcactctgtaaatgtttcttccttaaacctccctgccttcatgccagtcccatgttgtttgttcctagcacatgaagtggccatctgtctcgtcactagactctgccttggaaagcagtccatccctgcacagtccagctgaccccagccacctctccccaccagcctcctcccctaggccttctcgaggtcaccgccgctcagcctcctgtggctccccgctgagtgggggtgcagaagaggcctccggggggactggatatgggggagagggatctgggccaggggcctctgattgccgtatcatccgagtccagatggagttgggggaagatggcagtgtctataagagcattttggtgagggagccttgggatggagttggggtgaaggatggtgtcttgttggactataaatgttgtctgaggtttgggcagccaaatggaattgaatgtagttttaattttgacctttggttttggcagttatgttttatttttaattttatcttctaaactctagtcttcaatagaagctgaaatttgttttattttgatggctattttgcattagttgctacaccttaaacttttggtcgccgtgttaaaatttcagaatcaacagcagtttccccacagggaagcagctctgtttcactgggcaccatgtgggctggcttatggggtataggaagccaccatattgggttttcctgttcattttaaagccttggacacaagtaacattttgtggttgggttcagtggctgagggtagaaggatgggaaatcatggctgattgattgctcttttggtctcctgttctgccaggtgacaagccaggacaaggctccaagtgtcatcagtcgtgtccttaagaaaaacaatcgtgactctgcagtggcttcagagtatgagctggtacagctgctaccaggggagcgaggtcagaggccatgagggaaaggcagactcgggaggagagtggagtacttccacatctgggcggctgtggggggaacaactgtgtgtgtgctttacatccatcccctgaaccttcagagctgactatcccagcctcggctaatgtattctacgccatggatggagcttcacacgatttcctcctgcggcagcggcgaaggtcctctactgctacacctggcgtcaccagtggcccgtctgcctcaggaactcctccgagtgagggaggagggggctcctttcccaggatcaaggccacagggaggaagattgcacgggcactgttctgaggaggaagccccgttggcttacagaagtcatggtgttcataccagatgtgggtagccatcctgaatggtggcaattatatcacattgagacagaaattcagaaagggagccagccaccctggggcagtgaagtgccactggtttaccagacagctgagaaatccagccctgtgggaactggtgtcttataaccaagttggatacctgtgtatagcttcccaccttccatgagtgcagcacacaggtagtgctggaaaaacgcatcagtttctgattcttggccatatcctaacatgcaagggccaagcaaaggcttcaaggctctgagccccagggcagaggggaatggcaaaatgtaggtcctcgcaggagctcttcttcccactctgggggtttctatcactgtgacaacactaagataataaaccaaaacactacctgaattctactcccctgtccttgcagtacatatgaactggctgctatgagtgggggtggggaattggctgaaggtagatgccatggaacaggaaggggcacaatgttttctgtccccatgaacagagcaaaaagtgaggtattggtgaaaaaagtttcctcagaacagtttctctccagtaacctctctaccactggtcccttgctgcaaatgtgtataaaacaattttaggacaaggaaatggcagaacaactttatggacaacatataaacttgggaggacttataataccataaagcattacatgctgggattttaagtcagtttaaagctacattcaagcaaattctaggaagacagaggctgaaaagtactaatagagatgccagggctgttggcaaggagggtaaccacatttcatcctggggcctcaggttagagaactgtgtattctttttcaattaaaccgacattcctagcaatatggtatgttgcaaatgcccttccaaaagaatcatgccaaccaagatgagggagagttaagggttgtatatacaggcaagaagtaggtttgaagacatttaggatttcactttcaagaaagaacactgtgccacaaagagattccaagtgcaagagtttgaacctgagggggtaatacaggtggtgtgtgttaaggtggaaggggctgtggggatatgacagaagtgcctggtcaggaaacagagccaggtgtttttacattttattagctacagtatagatcctagagctgcctcattccctcccctcccctcccctccccccaccatggggtcaggccttgccaggagcccctgcctttgctgcctgggcccgctggaactcctgctgcagctgagcaagggtctccctctgttgctctgactgccgctcaagatcccgaagctgggattcgtatcgcttactaaggagagacaagggagacaagcagaaagggagaaattagtaggactcactatggagagtgctaaacgcaagaaagagataggtggaaaacttgagatccaggggagggagaagaaggggggttaaaagggaaggaaagggttggaggaactggaggactaggggccactatggagagctgttctgcaatggttcaacacctctactccaatggttcacttgcatcacagggtgcagcacacggtggtggaataaaaactcacatttcagctgtgatatagtccagcctcttccctactgtggcccgagcctcccccagctcctgtttgactagcaccggacccagaagtttaaagaccacgttggacccatccagcagggccagttcctgatggagggatgggacatatgtgatcagaaccatggctagtacaggtccctcctcgccccacaaatcccagtccctcacctctttcacgatattattttctgttagttgtgcttcaagtttctgcctccccgacatggatttacttaagtctggggatgagaggaaaggcaatttagaaacatcaaatgtgccacctatccccacaatcctagtcaggtggatatggatctgaggaagcagaaaaggatgggggcagcgggtgagtgaacagggaagagtactgagactgaggcggggaagtctctgcacgcgagggcccagatggggcaacaaaccttatctcggtaatggctttgggttgtaagtgcattgggcgagaccataccgaccctgttcccttacccttctgtagctgttgatatttctccacttctccctgtagcttcttctggatcagctccgccatggcggggatgaaagcctactgggtgcgagacaagggcgctgggtctcactctctggaaggtacctgagctcccttttctgatctggcctgcggaaatgatagcactcttgagaggtagccctgaggggcaccgcaacctcccccccgtcccggatatcgactccaccctgtccccaggagatggtgggcgaaacgcaagacccc

SEQ ID NO: 17443 - DNA, 10720 bp, Human
ggtctcactggcccatctttgggtactgtgctccctcctcgcctcttctgaacccctcttgtttccttttcttcttcctctgagctctgcttctccttggtagaacgctctgagggaagaaaagagttggtcagagtggagaacagatcttccaacatgtcctctccctcctgagggccataagatgaggagattctgaggcaggcaagtcagctttcaggaaagttgttcctgggctcaccttgtcttccatgtccatgacttccacgtgtatgactgtgagcgtgtccatgtccatgactgtgaccatgtcctcctttcacatgtctcacaaatttctccacgacaagaaaggcaacaattccactgagaacccacagtcccacagacagaatggggccctggcctgggaatggaggcattgagacattaagggagatgtgcattccagactcctcctcctcaagtgcgggaggtgaggaatagggagagacggaccttccccagcaccccaactcccatccccatctgtctcttcctcaccactgtgggagtgtccatgtccgggttgctccagagtgtggtgagaatgaggttctggaagaaggggggaaaaccagatgagggaatatctgacacaatgagtgtgtatttgggggaatatcgaaaggtcagggatcataaaggagaaagaacccttttcctccaaagaacgaaataggttagatttgaggtagaagtcagaggttacttaccaagagcatgaggaatgaggtgcaggaaagcatctcccaggagcccaccggaagcaaaactgagcaagatctgaagtagagagcgatgccggggagagttcgactccacggggataaggaagaggacaaaaaatggagctgctgagatcagcactgtggcccccagtgcctggtgagggagagtcaaggtcaagtactgtggagtttcccaacaatccagaaccagcccttctctctcccatcccctggagactcacataagcccagagagtgacagcatccaggtcctgcttgatgcctggagccccagactccccatagcctccatggctatgctcatggtcatgtccatgtcctctgtggtagaggctctcatgggagtagccatggctatggccatggtgtaaatcctcatgtgaatgtccatggtcgtgatcgtgggtatgtccatgccagatgctctcgtgagtgtggccatggccatgggcatggctgtggccatggtggaaatcttcatgtgagtgcctgtggctgtggccatggaagtcctcttgcagatcgtcgtgcaggtcgtcatgacccccgagtccagccaccagaagccccaaggtcgcccaggtcagcagtcccacggccacccagtggggggcccccaggcctctggccatcacgctgaccagagggacagaggcagtgactccacttgactcaactctatacctacacagggtccgctttactccaatcgcgccctccgtccacctctatgggccgctctcccattcccttaagttcccacctacattgttcccaagactagttctctttatcccgaaccacctcccggatgtagggccctgggacactaatctttcaccagccactttacagactctctgggccctcgtctctacgactcattaggtgaggaaaaggcctggaaaggatggtagagaaaaaacagagaattctcaccggctccgggatcctctcctttcccggtttgcttggacgtggcagtcccgcctttagatcccgcgagaacaggaagttccgttccaccttcgccctaatgcctttaccaatatggcggcactccggtagcgacgaatccatcctgcactgacacgcatgcgcgagtgtggaggtgatttgaggggagggtgggcgaggcgggctaacaggccggaggagaccgcctcctcggtttccaactagacgagggggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcggggtgagtgccccagcagaagggcaggcgagccagtgaccgctttatctgcgacccctcccccacaccctcccccggtgctcttttccttgcgctcccgcccccttgtttgtaaacacgcgtcccctccctcccgagggccttagcaccctcccccccggggcggggcggggaaggggagcttccgccctcctagctgtgaccgcttgaggccttgggcaccggaggtcgcgggcctgggaagggcacgattcctcttaaacctcaggactttgggcgtttacaggcagatcctgcgtcttaggaggggtctctcctgcctgtctctttcccttgcacgctctggctacctggctttacgctgggaatagaggggctcgatggtctaccccacgtgctgccccacccacgagacaggtgtggctttgggatgacctggtattcattcaaatggattggttggaaaattttcctcacctgaactatcctcctctccttgtcaactccctcctctcaccacaatgaggagttacgctgtttttgggtttttttagccagtcaaatatagcagtgggaggttgtataccaattttagtgacacaaatgttaataagttctgataacccactaccatcggaccagccggagttacactgttgtttgacagcagggtgtctctgaacttggggatgggtggagtgggctgggtccggcacggtggggtattagagaattaaagtctctagttggatgtttgaagactcattttctttttttgtctcttctgtctcttgtgtgtctgtgtgcctgtacatacccctccctcagactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccaggtgagaggttgtgaccaacttactgcctggccactttcattttcttgttttccttgtaaccccagatccttgtgtgaacttccccatggcccattgaccttccaatcctctaaccttgtcaggcctgtggtctttatgagaccccttgcctttcctgaggtgactgatctttcagtgcatgcttcctcccctaaaagaactctaatattctttgtttttgtgtgtgtgtgtgtgtttttttttttttttttttttgagatggagtcttgctctgttgcccaggctggagtgcagtggcacaatctcagctcactgcaacctctgcctcctgggttcaagcaattctcctgcctcagcctcctgagtagctgggattacaggtgcctaccaccacgcccggctaattctgatattcttgatgtccttttcatctatctgattttctgcccttttgatcccatctgctttcccaagacacctgcccttcagggtcactgtgttgcacaatttcagggggggcctgtttattcactttggggttgtgctccagggatggcctttcacatagactgcagtgtaaatgacagcctctggaatgtgcattgcagggccttgcttagtggtagggaatgatttccatcacttctgtgacattctgcttcccaataagtcttcctgtgacttccctatttcccccatcccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggtatgtggctcagaggatgaacagagagggagagtctgggccatgtatcatcacctgtgggattcccagggcttatggagtttggtcagagcaagtgacctgggggaggcctgatgggagtaaagaagctgaagctgagatgtaggacgcgattggggggaaggtcagagggaaaaggaagcagcgtgtagggtttctgaacagtgaggagactgggactggatcatcactcagctcctggttccctatctctgtatttggcaaacagggaggactttaagttttgctagggggagattggaaacagactaaatggtgaaggtgtctccatgcaaccttcttattgctcctcccctttccctgtaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggagggtaaggacccgccctgcccaggcgtcttagaccacatgcccttctcccttatcccactcagactgtgtacctctctggaagggtggactgctctctctcctctagagggcgatatttgatttctctctcccttcgcagctctcctccctgttaccctgttctggcccttgagtttccttcttaatggttaggcctctgtggcctgcacatatgacccctccctagactgatcctaggataggataacttttccttagccatgatgggctgtctccccatttctaacctgagtggttcctcctctgattccatggaccttctctggtctctgtctcctgttatctgtgatctttcctctaactcctgggactgggcactcttaagcttacagactttactgaagacctcagggcttcccttccttcttctgtgtctccatcttatcttcttaagtcagattcctaggattctgagagacactttagagcatatcttggtcaaaacacccactttagagaagatgagcctgaggcttggctttcccaaggtcatgcaacaaaggagtggcaggcaggtttgggatcagaacccacatcttcaaagacctaggccagtgctcctttcactgcctatttgttgagtcagaagagcacaagatttgcactcagacacacttagagtcagttgtatgacctgccatgtattatatgaatttaagcaaactaatctctttgaaccccgagttcttcatcttaaaaatgagaataaatgcttccagcatcattatgataattgagtgaatggtaaaatgtgcttagcatgtttcttggcatattttatttaaaaaaattttttttttcaatcagctttctcaggttgaatcttggcatgttttttttaaccatgtagtaggctctccatttaaattcctccctaattcttttacctacctcacccttcccgactgacttacctgcccttttataacccttccttcagggctgcccccagtccaccctttctagtgacttccccaattcctataaatatctcccaagggccatgagatcctgatgaggccgtaaggatatttgtggaaccccttcatggctggctgctgactttccattttttctctcccccttccccctgcagcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggtcagtgaccttggatccctttgacttcttgacatttgacccctctttgacttcccgatctttagtgaccccagtggccttaccttgcgtacccagggagccaaacttgctgacctcgccacctcttttctccttctcttccactgatgtgctttgaatcccttggcctgatttctggctcctgacccttgctgccccacccaggctggaatgaactcctcattgcctccttctcacaccgatccattgatgttcgagatggcatcctccttgccacaggtcttcacgtgcaccgcaactcagcccattcagcaggagtaggagccatctttgatcggtcagtggccctcggctaggctggcatgtagatagagggggtggggctataggctggtccgtgtccaaggctggctgagctgtgacctttgagtgacctgcaggtccctctccagggtgctgacagagctagtgtccaaaatgcgtgacatgaggatggacaagacagagcttggctgcctgagggcaatcattctgtttaatccaggtaagaggaggattacctttgtctctcaaggccaaggcaaccttggagcctcctcttctccgagactcctaagttacccagctatccccctcagtaagaccctcaacctggaaatctcccaactggccgaggaaaaacccacatccacggatccatcccacaaacccagtgggccctgcttcccttgccaggcctctggtaaagggcaagcaagtgcagcccaaaaggggcatcctgtggctcacatctgcatggccatcctgatttggtttgtcttcatttctcttcctcctctcttccctgccatcccagatgccaagggcctctccaaccctagtgaggtggaggtcctgcgggagaaagtgtatgcatcactggagacctactgcaaacagaagtaccctgagcagcagggacggtgagatggggctggggggcactgaggctcccttgggggtggggagtgctatgaggatgtgttcagggcccgtgtgcttccagctctcaatccccttctcccacctccaccccaggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctggactgaggtgactgtatgaggatgggcagcgccgtttcgggcttggggggggtatccggttgggagctccggacgcgatccctggacgccgccgccgaggttccgtggggcccaagaggtgcacgcagggtgggggacacaaggcaagctttgtcggggagggggggagagggtgtgccaggctgggggcggggccggccggaggaggaagggggggcggtggattctcaaaggcgccttgttcgctcgtgccctctccgcgccagcgggcggcggcgcctcggctcgctgcggccttccctccgggcgcgctgcgggctccgggcagacccggcgccgtgcccgctcgtgggggcgcactgggcgccgagcgctgcgtgcttctcaggcgttgcccgcccggaggcggcccacgtccccgagtgaccccatttccctggacccttccaaccagagtcgactgctcgctcatcttaccactgctccccctctacctcggctctgggactccctaaccgcgtcccccatttgcatctccttggacctgactatcctgtgtttgtcggtgggtcccagtctctggcctcttgctctccgtagaacaccttcccccacatcccccgccccagttcgtcgctatctatagccttgtctataaatacccccgccccggcccggctctgtaattacacggggcggggtgagggaagtaattatggagacctgattatgggtggggtggggactgcgacccccaggcccgcctctccccctcccactgtgccctaaatcccgcccaggcctctgctgaaagggggctctgggcccccaagagggagggaatgggagggagtgtgtgtgactggacgtttgggtcctagaaaaggaaggggctagggaagatattggggttcccgaaaagagaatcttagggtacaggccgttgagacctacaaggggcaggagagagcgagcgatagagggagggttcccgcctccctccccaggtggagactgagggtggggtttcccttcggtggctgtgggcgggcggctggaggcgggggccgggccgggggcgggggcgaggtgggggctctgggcgccagggtggccggggacacacagaagcggcagccaccgaggagggagcagtgccgggagccccgacggcgccttgctgcatggagctgggccgctgacagctgtcgctgcccgcagcctctgacctccctgggaccccggcgtctgaggctcatagtctgctccctgtcttctgtcagcctcagggcatccagcgtctcaggccgacctgggtccctgggacccggcgtttcggcttctcagccatggagcggtgcagccgctgccatcgcctcctcctcctcctacctctggtgctggggctgagcgcggccccaggctgggcaggtaagaggagtcctgatgcctgggtcctcggagtcaggctggagctctgagtgtctctgggaaggggccagctgatgcctggggcagcagcttctgagtctaacaaggagatttggggcttcaaggctacaggctggagggcaggacacctgtgttccttggcatcagggtaggaatctctttgtccttgaagtgactgggggagggcag

SEQ ID NO: 17444 - DNA, 25249 bp, Human
ctggtctcgaactcctgacctcaggggatccgcccacttcagcctccgagtgagccactgcactaagcctcaaatttaattatatgtttacaagtgaaaagatttacttcaaaatgggtgtgggaagagatatagatgaaataagatttctaatttttagttagatacatccatgaaggttattctctattacacttatgaatgctgcacctctacttaagcctcacagccggtctctgaaataagtacagtatttcacactgccttattagtttcacagagcacccaacagaaggaatttccctctacaaattcctcaacagagccaacagtatccctactactatccattccctaacgtcgcctaagtacctaccatgcaacagaagccaagaagacaggcctagccctgcacgcatggacacatactggtaggctatttccacaactaactacacattctgacttaagggaaaaaaaaagaacgttatgtatctagaaagccaagaattcattaggtttgtggagagaaatactcaagtgaaataatattcttgcattcattgattcgattcttaaaagccaaagaaagatggatgtactccttcacacttcgacaggaaaggagtgtcaattatggctcatctgagtaaatgtcccactcagacttcttccaccctccatctacaggcttcttcacactttttatctgttggtatttctacttatccctcaagatgcccaataatcctccaattctcagggaatataaatttcgcaggaagggttgctgttatgatggtgggatgggtaaagaaaccgaatctagaagaaatctcacaagctcgtggttcaggaaaatcttagcgaattcgggtgagcaaccatacctcctccccacttccccaggtgaaatgttttggcttgaccttagaccactatcttggctttaatcacttattttctgtggtaaatgctaaaggggtcagtctctccctaaaccactttcttttcttaatccagcagtcaaggtgatctggatgagactcaagtctccccagccttgcttcatttttgcttatgtcttcacaacccaattctcatttacattccctattccttaccctacttcacttaccttaatggcagtgatggcaaaggctattttccgccgcccatcgatgttggtgttgagtactcgcaaaatatgctggaacttttcagggatcactagagactagttgaaaaagtacgggggaagaaatcagacacagtaaactatcaaacagtaaggccgataaggcaaacgaacttcatacaaaaaggttaagcctgtcacacaagtggcaagacacccgccccccattccttaggttttcacaccacagagcaaactcctcagtcctgcagagtaggcacatgaagcgttcaagcttgggaaaatgcaacctctggagagaggaagcaggtctcctgcccattcccaaaagtgcgtggcaaaagccagagttccccatatacgcccaagccttagacagctttcgtgcgcccgagcagtgacccttcctcgggcccgctctccggaattggaaatctttggtgtccctttccagggacgcgatccaaggctccatacagaaagtcgcaggccctcagggcaggacgtttccagaaccctgacagccggctttccttgcccgagctgcgatgccgctggatcacggcacggattccagtcttaccatggctgcagcacaagcggcggcgtgtaggcctcctgtggaagagagagcggaagtgacgcgatatcattatatagcttccaggaggaagaggcggtgcgatctaggagaagtgcttccggaaactgtttcagcgcgacctggctggatttatgagagtatggcttgggtaccacaacttccggtgcgcctttctttacagttcgtaaggttcataggtaagagaacagcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggtgagagcgcggagctgtttctcctccgtagttccggtgctcctagcttcagaaagacctgagctgggtttaggcacaagggtgggaacttggctgctacccgtgatattacctgtttggctccccgtacccttccctgtgatcagacccgaccctgagcgggaccctagtggctgaaactcatgttctggggcacaaaatttcaacttcactccacattttggggtagagtcacgaagtagtatagtgtaaaggttaagaacatggcctctgaagccagactgcctgagttctatctctgccacttacacgctgtgtgcccttgggcaagttaaccagcttctctgtgccatcatttctcacacctttaaggtgaggaagatagaacctattgtatacatcgtcgttaggattagatgaatatgtgtaagattgcacctggcatgcaggtaaacactatgtgttttgacatttctagaaagcctggggttccccagaggtgtgatagaacacccaagatggcaggagtctgagggtcttaaatttaagtgcaagttctgctctatcctctgcaattcctagctttcctcattcggtcatctccactgcacttttttttttttttttttttttttgagacggagtcttgctctgtcgcccaggctggagtgcagtggcgcgatcttggctcactgcaagctccaccttccgggttcacgccattctcctgcctcaacctcccaagtagctgggactacaggcgcccgccaccgcgcccggctaattttttgtattttttagtagagacggggtttcactgtgttagccaggatggtctcgatctcctgacctcgtgatcttcccacctcggcctcccaaagtgctgggattacaggcgtgagccactgcgtccggcctccactgcactgtcttgtcttttacctttttttgttttctttagacgggtttccctgtgttacccaggttgaccttgaactcctgatctcctcaaacaatcttcccgtctcagcttctaagtagttgggactacaaggagcccaccaccatgctgggctacctccactgtctcactggatcgtctcactccttgtcgtattccttacccatcagcacaaaataggagagtgggtacaacgtgagactcttagaatttttcaaagcagtacctgtggctcccagtaaaagcagctccttctcacttgaaggactggggatatccaattatattttttctttctgtctttcaccgtaccctactcccattaacttatccctttccaggcgggtggtcctgggctccaggaaccactgcaacttggggagttggatatcacttctgatgaattcatcctggatgaagtggatggtaagcgatggcatggggtgggtgcagtacctgtaatctgagaggcatgggggctggaaggaataaggtagggattggtgtgcagatactcaatgtggggagagggagctgtggagctggacccttatgataaacttctatttccagttcacattcaggcaaatctggaggatgagttagtaaaggaagctcttaaaacggtgaggctttcccctgtactaatctgcccttctatctattctaccccaaaaggaaaaacaacagtctcttgcttttgttgtatcagcctggtatctgaccctttagtccttcactgattctgttacagtgtccctttactgagacttccttctgacctgtcatctttatgttctcccagggtgtagatctccgtcactattcaaagcaagttgagctggagctacagcagattgaacagaaatccattcgggattgtatcctccagcagagggaaggggtggtgctattgacatggggattttgtggcgtgtggtacagatgtcccagctggggtcaacatctctgaggtttctatcacttcaaagagaaattggagaggtactacaaatctgaggatctcccatcttcaccatgaggccccttgactttttgtggatcagatattcaagagagtgagaatatagcatctctacacaaccagatcacagcctgtgatgctgtcctggaggttagtaatcatgacctgtgacccctaatagctactctgaaccagatcatggactctggtgccatttttaggtcatcagcctcaagatggggacaggttagggtcattttcaagatgacttcaggagccttttttgttattactgccatatttaatgttatttcctgataatctggggtgtctcatcatctgccaccctcaaggactgataaatactgaagacttcacaaagagtctttggtggcccacttatcccctacaaaccctatagcactccggcaacatctaccctccctacagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacgtgagttaccagtttgaagggttataatgtccatagcaggtggatgggctggggtgacccaccctatttaccatatgggtctcctggctccaggttaagtgctttttagaaattagtagccaggttaaccaccatttctttaggtatgcattaggcatcaaagattaagattaagaatgatgtaagatcaggtgtatagtggggaggtccaggaatagaaaactttgtacatgtgtcctgactatatggtacaatgcaaggtggtagagatgacaggggctggaggtaaggagtgtggtctgggtctggtttagggatgtctgggtctcccttgtaactcatcccacccctccctgctaaccagggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggtgggaagtagggatggataccctggaggctactggaagcagccttcccaagatcttcactatggatttccttggcagagctcactgtagcctgtctccagggacttcaccctgccttttctgggcagccccattcttgtctctctgggtttccctgaaaatcttgagaaataccaaagagatattcaccacccttctgcctatgtttaccatttgttgcttcccccagttcctctcatacagcaaaagggttgcagcttcatgccctgtgtttggttccccacatctaggcagtgacgaagatccgagagtttatcctccagaagatttattccttcaggaaacccatgaccaactatcagatcccccagacggccctgctgaagtacaggtcacaaccccaaggaagtgcatgggatggcctttgagtttttgagcggcctagtgtgggcatctggtttcttgggagacaggtagactgacatgttcctgaccccctaggttcttctatcagtttctgctgggcaatgaacgagcaacagcaaaggagatcagggatgaatatgtggagacgctgagcaagatttacctgtcttactaccgctcttacctggggcggctcatgaaggtgcaggtaaggtcaggagggagaggtattcctgggcacatggactgggaggaggggacatccctgggcaaggaatattttattgtgttgtgggaagagacggttatcagttctcttttctctttccttagtatgaggaagtcgctgagaaagatgatctaatgggtgtggaagatacagcaaagaaagatatcctagtactggggaaccctcatgccaggccttgagagtgggaggactttcgactccagccaccaatgcactgctccttaccttttcctatgggactgaaaccttttagaatgtgatgaaagctatagcctccctccccagaaagatgcacacattattttgacacatagttttgcatatgattgcaagggagggagagacaccctgaagcccattcacagatgtcagcacgtggggccctagtactgggaaagagggctggctaggccacgtctgcctgtctggggtccccacagatagtgagtctttgggcccagttatggtctcattgttttccctgactctgacccatcttacgattcttctcaaagccatcgctccgcagcaggaacaccattttcaccctaggaacccgcggctctgtcatctcccccactgaacttgaggcccccatcctggtgcctcacacagcgcagcgcggagagcagagggtatgaggaggaacaagcttcagtcacgaaagaggctctgagcacggtggggagggaaggccagacctcagggcagagcttcccaacctgcaggccctgtcttaatccccttagacttgggagtggccttctccaatcactccagcctgctgtgatgtgaaaagagctgggaaccattgacttaagggcatgcagaggggagagactggatgaggggaatgacagtcagaggcaggtgttgaggtggatgcaggagtagcaacagcaggtgggtgtaggccctttttgtacccctatgttcccccaccttttcagtgcccattcagcttgctcttagacagcccggacctagatagatgcgaagggtctgcctagctcttattactcaggtttactgattttccagccatatccatgggaagtcagtgttggggtccatcccttctgtttttcttctttactcctcctctcccagtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctggtaagactcctgtttcctgtaccattcaacacctttgtccccagtcttcatcagcagcatagtggggtcatgactctggtagaactgaaatcaggatcgcctcattctaaaatgtctaagccttggctgggcgtggtagtgcacacccataatcccagcactttgggagtccaaggcagtaggattgcctgagctcaggagtttgagaccagcctgggcaacaacctcatctctacaaaaaatgaaaaattagccgggtgtgtgttgatgtgtgcctgtggtcacagctactaaagatgctgaggtggaaggattgcttgagcccaggaggtcaaggctgcagtgagccatgcactccagagtgagacctgtctcaaaaaaaaaaaaaaaaaaaaatagccaggtgcagtggcttacgcctgtaatcccagcactttgggaggctgaggcgggaggatcacaaggtcaggagtttgagaccagcctgaccaacatgatgaaaccctgtctctactaacagtacaaaaattagccaggtgtgcgcggcctgtaatcccagctactcgggaggctgaggcaggaggattgcttgaacctgggaggaggagattgcagtgagccaagattgcgccattgcactccagcctgggtgacagagcgagactccatctcaaaaaaaaaacttgttacttagacttgtcacagtgttactcccccatgaaatcctcagtgcgtagggtccctgagactacccctactgctgacccacaatcaggcaatagcacgtgaaaactgagggtcccccaaatcttggtgctcaaacccctgacccaagctcagccctgaactctgctgtgataggcttgtgatcatagatcctggtgtggccaggtgcagtggcttatgcctgcaatcccagtactttgggagaccaaggcaggaaggttgcttgaggccaggagttcgagaccagcctgggcaatgcggcaagaccttgtctctacaaaaaatttaaaaataaacttaaccaggcatggtggtacacacccatggtcccagttgcttggcaggctgaggtgggaacatcacttgagcccagatgtttgaggctgcagtgaactatgattgtaccattacaatccagcctaggtgacaaaacaacctgtctctaaagccgaaaacaccgggtgcagtggctcacacctgtaatcccagcactttaggaggctgaggtgggcggatcgcctgaggtcaggagttcgagaccagcttgaccaacatgatgaaaccccatctctactaaaatacaaaaattagtcgggcgtggtggcaggcgcctataattccagctactcaggaggctgaggcaggagaattgcttgaacctgggaggcaggcggaggttgcagtgagccgagattgtgccactgcattccagcttgggtggcaagagtgaaactctatctcaaaaaacaaaaaaaaagccaaaaacatagatcctggacaggaaagcagggggcagttccattttacgtctctcccttctgtcctgtccagtgcatcatccccaaagaaacaaatgcgtttgttcatagtcactgaggacaacaaactgacattctcttttaatcctctgtttgttccccaatcacacagaaacacctggattcttatctagctgactgctacgatgccattgctgtttttctctgtatccacattgttctccggttccgtaacattgcagcaaagagggatgttcctgccctggacaggtcactgaattctggtccttgatgcccaacaggccacgaactctcttggtcttgcatgactctgccctgaccttagactcctactgacctggtatcatcaacctttattcccattcatttgctccggaggcagtagtgctgctttttgactcacctttctccaaccactgccccccaacccccacaactagctattgaccattaaactgaatgatgccccactccctcccatccccctccaacattccttgctggctgacctctgattctgattaagcccacaggtactgggaacaggtgcttgccttgctatggccacggtttgaactgatcctggagatgaatgttcagagcgtccgaagcactgacccccagcgcctaggggggttggatactcggccccactatgtgagggagggcaagggtaacaaagggttcttgaaaggcagggctctaagcatcattgtgggggttggccaaggtcacagttgtgtcatgggccacgctatgagcaggtgttctgggagggtggtgaaactcatggtgagtggtgcactgtgggtaggagggactgaaggtagagtcacatcacatggaggtgggttggctaaggaagttgggaggttgtgttggttgggccaggaggtgggtgtgattttccttcccactctctcctagatcacacgccgctatgcagagttctcctccgctcttgtcagtatcaaccagacaattcctaatgaacggaccatgcaattgctgggacagctgcaggtgagggtcggacaggagacacttcccagcagcagggctgcttccagtgggtggagtctgaggaggagccagatggggcccagatgaccttgctttctggtgtcacctcttcctctctgccttttcaggtggaggtggagaattttgtcctccgagtggcagctgagttctcctcaaggaaggagcagcttgtgtttctgatcaacaactatgacatgatgctgggtgtgctgatggtaataggtgctccttctccttgccttcctacccagaaaattcggtttcccccactgctgttagctctgtgagggcagagatgatgcctgtcttgttcagtgttttactcttggagtctggcacagtgtccagcttagtacaataagtgtggaatgaaggggacatcctgaagtgaaggactgctttccccaaactagacatttccctttgtcttcccttaggagcgggctgcagatgacagcaaagaggttgagagcttccagcagctgctcaatgctcggacacaggtaggggtgtggggaaaagggaagagacagccttctgtgctgttttcagctctctctctctctctctctgtgtgtgtgtgtgtgtgtgtgtgtgtgtgtagggagtggcataatggatctcaggtatgcggaattactgtaactcttgattcacaacatactgtcattattggtctattttattttattttgtctttggtttttttttttttttttttttgaggcaaagtgtcactctgtcacccaggctggagtgcagtggcatgaacatggctcactgcagcctcaacagcctgggcttaagtgatccttctaccttagccccctgggtagctgggaccacaggtgcgagccaccatgcctagctaattttttatttttagaatgaattttatttttttctttatctatcctctcaagcatttatcctttgtgttataaacaatccgattacactaagttattttaaaatgtacaattaagttataattgactatagtcaccctgttgtgctgtcaaatagtaggtcttatttattcttcctatttttgtttgtacccattaatcatccccaccttctccccagccttccactagccttcccagcctctggtagccatccttctactctcttcgtacatgagtacatgagttcaattgttttgatttttagattccacgaatcagtgagaacacatgacgtttgtctttctgtgcctggcttatttcacttaatataataatttccaattctatgcatgttgttgcaaatgactgagtctcattcttttttatggctgagtagtactccattgtgtatatatcccacattttctttacccattcatctgttgatggacacttaggttgcttccaaatcttagctattgtgaacaatactgcaacaaacatgggagtgcaaatatctcttcaatgtactgatttcctttcttttgggtatatacccagcagtgggattgctgaatcatatggtagctctacttttagttttttgagcaaccttcaaactgttctccaaagtgtttgtactaatctacattcccaccaacagtgtataagggttcccttttctccacatccttgccagcattgctattgcctgtcttttggataaaagccattctgactggagtgagatgagatctcattgtagttttgatttgtatttctctgataatagtgatggtgagccccttttcatatatgtctgtttgccatttgtattcttttgaaaaatatctattcaaatcttttgcccattttttaataggattattagactgtcatgtagagttgtttgagccccttatatattctggttattaatcccttggcagatgggatgtgcaaatattctttgtctcttcactttattgtttctttagctgtgcagaagctttttttttttttttttttttttttgagatggagttttgttcttgttgtccaggctggagtgcgatggtgcgatctcagctcaccgcaacctccgcctcccaggttcaagcaattttcctgcctcagcctcctgagtagctgtgattacaggcatgtgccaccatgcctggctaattttgtatttttagtagagatggggtttcaccatgttggtcaggctggtctcaaactcctgacctcaggtgatctgcccagctctgtctcccaaagtgctgggattacaggcgtgagccaccgtgcccagctgtgcagaagctttgtaacttgacgtgatcccatttggccatttttgctttggttgcctgtgcttgtggggtatggctcaagaaatttttgcccagacccgtgtcttggagattttccccagtgttttcttgtagtagtttcataatttggtcttagatttaagtctttaatccatttgatttggttttcatatgtggcgagagataggggtatagtttcattcttctgtgtaatggatagccagttttcccagcaccattattgaagagactatctctctttttttttttttcagacggagtcttgctctgtcacctaggctggagtgcagtggtgcagtattggctcactgcaacctctgcctccttggttcaagtgattctcctgcctcagcctcctgaatagttgggattactgatgcctgccaccacgccgggctagtttttgtgtttttagtagagacgggatttcaccatgttagccaggcttgtcttgaactcctgacttcaagtgatcctcccacctgggcctcccaagtgctgggattacaggcgtgagctaccgtgcctgaccaagagactatcttttccccagtgtatgttcttggcacttttaccaaaaatgagtttactgtaggtgtgtgccagctaattttttaattttgtaaagacagttgtctttacaaaagacaactgttgcctgggctggtcttgaattactgccctcaagtgaaaaatcttatgattcttttttttttttaaagacggagtctcactctgactcccacactggagtgcagcgatacgatgtcagctcactgcaacgtccgcctcccaggttaagtgattctcctgcctcagcctctgagtagctgggactgcaggcacgtgccaccatgtccagctaatttttgtatttttagtagagatggggtttcaccatgttggcccagctggtcttaaaactcctgacctcaggtgattcacccgcctcagcctcccaaagtgctgggattataggcatgagtcactgcacccggcctagattctgtttttaatgacactggaaaacaacgaatttttgttttggcatatatatagctttacttttaaaagcaagaacacacacaaaaaaagggggaaaaaagcaagaacacaataaatgcaacatttagatcaacgagtacctgtgcacgagaagcacagggatggtttcagtaggatttcatagtttgatggtgacttttgccaagctgctgctacttggattgtgtggtgtgtttgtgagtgtttatatcattaaaaaacaaaacagccactgcactgggttgttttattttttaatgatataaacactgatgagacaaggcaagaaaacagcaaggcaaaaaagaaaaaaaaaaaagccaggcatggtggtatgcacctgtagttctagctatttgggagacaaaggcgagaggaccactttgaaatccaggagttcgagattacagcgagccatgatcatgacattgtagtctacccttggcaacacagcaagaccctgtctcaaacagcaaaacaaaacaaaaaaccccagaatcacaggatttttttcatgcataatttttctaatattgtcatgttattgcatatggctatagctcattccttttcactgccatatatgacttgtgtgattaaacatattctataaatggattgtttccagtttcttgcttctgtgagcattgttttatgaataatcatgtcttttagcacacatagatattgattatcttcatcaaaagtttctcttgggtataaacctaggacagtagtcttgctgctaataagatatgcagtattagtctttatgagacaatgataaattgttttcctaagtagttccttctcaccagcaatatgtaagaattcctactgagccacattttctccaacatgtggtattatcaggtctttgccattttttttctttttttttttagagaccaaggatgctgctaaagatgctcgggatcagaaatgtttcagattttgatttttttcggattttggattccttgcattatttttactggttagcatctgtagtctgaaaatctgaaatctgaaatgctccaaagagcattacctttgagcatcatgttgatactcaaaaacttccggattttggagcattttggatttcagattattggattagggatactcaacctgtatttcagtgggttttatttgtaattttctgattactaataacattgagcatcatttcaaatgtttagtaactatatgtaggggttcagtcaggctggtgggaaaaatattagtgatgatagccacaaaccctcttggaaggcctaagagtttgcataacttcagtaatagatatggttgaaggcgacctgatctttacctttagttaaataaattagagtaataacaaaggaatgtggggaagttatctaggtagcttgtttactcatatggtcttaagactaatctttgatgtaccgcaggtgcttaactgctttctactcaggaagtccacaatgtcagttaccccgtagtggtgttgactcaagtctttgtcaattaatctttactgaataaatgcgagtctcactagctggtcagggccgccattgcaactgtttacagtactcttcagggagtctgtaaacagcctggacacactcagctggactggcaaagcagagtatctgtgtgtcagtgtacctcattcatccgttgccgggtcaggggtctgcaagggacagactccctgaagctggtgctctgtgtgaggagcgtcaccacaactatacaatttttttttttcctgtaaaatggctgtcatagcatttgaccttttaaaaatcggcttgtggctgggcagggtgtacacctgtaatcccagcactttgggaggctgaggcggatggatcagttgaggccagtaattcaagaccagcctggccagcatggcagaaccctgtctctactagaagtacaaaaattaaccaggcatagtggcgcatgcctgtagtcccagctcctcaggggcgctgaacctgggaggcggaggttgcagtgagccaagattatgccactgcactccagcctcagttacagagcgtgactctctcaaaaaataaagaaaaaaataagtctgctagtattttttatttataagagttctttgcatcatctacatactaatcttgttgattatacgtaggttacagattatcttttagtatgtatctttttacttttttttttttttttggtgagatgagggtctttctgtgttgcccaggctcctgggctcaagaaatccttgcacctttttttttttttttttgagatggagtttcactcatgttgccgaggctggagtgcaatggtgtgatctcagctcactgcacctctgcctcccgggttcaagcacttatcctttctcagcctcctgagtagctgggattacaggcgtgtgctaccacgcccggctaatttttgtatatttagtagagatgggttttgccatgttggccaggccagtcttgaacgcctgacctcaggtgatccatccgcctcagcctcccaaaatgctgggattacaggcatgagccaccgcgtccagcctttgtttttttaatgttgctttttgattaaagaaatttgtaattttaatatgattgaatttatctgtccttcatttttatgtctttgtttttagtaacagtcttgctctgtcacccaagctggaatgcagtagtgtgatcatggctcactgtagcctcaacctcctgggctcaggcaaccctcctccctcagcctcccaagtaactaggactacaggtgtgtgccatatgcccagctaatttttgttgttgttgttgttttgtagagacagagtctcactatgttgcccaggctggtctcaaactcctggcctcaagtgatcctcccgcatcagcctcccaaagtgctgggcttacagccaccatctaccacgcctgactatttttgtcctgtttaagaaattcctgggctgggtgtggtggctcacgcctgtaatcccagtactttgggaggctgaggcgggtggattacgaggtcacgggatcgagaccatcctggccaacatggtgaaacctcgtctctactaaaaatacaaaaaaattagctgggcgtggtgatgcgtacctgtagtcctagctactcatgaggctgaggcaggagaatcacttgaaccagggaggtggaggatgcagtgagccaagatcgtgccactgcactccagactggtgatagagtgagactccgtttaaaaaaaaaaaaaatgaaattccttattactccaaggccagaaaaatattatgctacattttcttcttaatattgtagaattttggccaggtgcagtggctaaagcctgtaatcccagcactttgggaggccaaggcaggaagattgcttgaagccaggagtttgagaccagcctaggcagtatagtgagacctcatctctacaaaaaattaaaaaaatatattagccaagcatagtggcacacacctgtagtctctgctactcaggtagctgaggtgggaggatcacttgagcctgggaggtcgaggctgcagtgagccctgtttgtgctgctgcactccagcctgggcaacagagtgagaccctgtctcaaaaaataataataaaattaaagaataaacaaatatatagagagaatttttttgttacctttaagtctcaaatttacttggaattaatttttgtgtgtgatgtgaggtagggatctatttcttttttttatgtggatggttggcccagaaccatttatagaaaatctttttcttttctttttttttcttttctttttttttttttttagacagagtctcactcttgtcacccaggctggagtgcagggccacaatctcagcgcactgcaacctctgcctcctgggttcaagtgattctcctgcctcagcctcctgagtagctaggattacaggcatgtgccaccacacccagctaatttttgtatttttagtagagatggggtttcaccgtgttggctaggctggtctcgaaaagttttcacattttaaaaagtctttaaggattttgattagaattacattgtctatagactaatttggaagaattgatactttatgatattgaaacttcctatccatgatcatgatcatgggctccctatcctttttttttttttttttttgagacaggttttgctctgtcactcaggttggagtgcagtggcacaatcatagctcactgcagccttgaattcctgggttcaagtgcttctcttgtctcagcctcccgagtagctaggactagaggcacacagcaccacacttggcttttttttttctgtagagaatacaaaatttaaaaatttaattttttgtagtgtctcactaaactgggattacagatgtgagccactccacctggcctcctcctccaatttttaagagagtcttttaatgtcttttgataacctttttaaattttcagcacaaagacactgtaagtcgtttgccatatttttaggtgggtataatacgtatgtttagttctactaggaataaataaatcttttctagttttttgtctttaacatcttatgtttttgatttcttattctactggctaacactcccaggatgatgtttagaagttgaacagaaaggtgatagtgagaacccttttcatattcctgattttgaaagaattgttgctggtgctgtggctcatgcctgtaatcccagcactttgggatgctgagatgggagaatctcttgagcccaggagtttgagagtttgaggggatctgcctgggcaacatagtgagactccatttcttttttttttttttttttttagacagagtctccctctgtctcccaggctggagtggtgcagtggtgcaatctcagctcactgcaagctccgcctcccgggttcatgccattcttcctgcctcagcctcccgagtagctgagactacaggtgcccagcaccatgcccggtattttttttgtattttgtatttttagtagagacggggggtttcaccatgttagccaggatggtcttgatctgacctcgtcatctgcccgccttggcctcccaaagtgctgggattacaggtgttagccaccatgcccggctaagaccccatttctttaaaaaaaaaaaaaaaaaaaaaaaaaagccaggcgtagtggcatgcatttgtagttctagctgcttgggaggctgaggcgggatcattgcaggagattaaggcacccacaaagatgcacttaaaccagttgtttctgctgagagcagctgggatttgtcactggatttgccaggtatagagactcgccagctgccatcaatgcttctggtcctttttggtcagctgctgcttcatactacgtaggaaagattgttaaagcccagtgcactgtttcctctggtcactcctctgctatcaaggtgttctcttttgcgttatagaaagcttaaagttcatctaagtccagaccagtactcctataggaatataatgcatgccacaaatgtgagccacttaaataattttaaattttctagaagctacattaaaaagtaaggagaaacagatgaaataattttttaaaccactacatccaaaatattattatttcaacatataatcaataaaaaatagtactgaggccagcacggtggctcacacctgtaatcccagcacaggccaaggcagggaggatcgcttgagcccaggagtttgagaccagcctggacaacatggtgaaaccccatctctacaaaaaataaaaaaaaaatgagtgggacatgttggcacatgcctgttagtcccagctactcaggaggctgaggtgggataatcactgagccaggaaagttgaggttgtagtgagctgtgattgtgccactgcactccagcgtgggtgatggagcaagaccctgtttccgaaaaaaaaaaagaaaaaaaagatatacttaaaatttattctaagatgaagtcttcaaaatcaggtgtatatatcatgcttacaacacattatataatttatggctcctgcctagcaggggtcatcactgttagttcaacttttctttggcaagtctactccctgtgccccaccgtacactgctacattattgtttgtatatgtgtgtgtgagactgcatttaggcaactgtaataggttgaatttggttatttaatctctgtccaaaatcacatcacaaagatgccttgattatagaaagatccttccttgcagcatattagttatttgacaccctcagtggatataagtgaatattttgagggaagaatagaaaagatacaatttttatttatttatttatttatttatttactgagacaagttgctgctctgtcgcccaggctggagtgcagtgacatgatcttggctcactacaacctctgcctcccggttcaagtgattcttctgcttcagtctccctgagtagctggggttacaggcatgcaccaccacacctggctaattttagtattaataatttatttttaaatggaataataatttcactttcttcttaccagatctttctgtctgggttgtttgcttttatgagtttttttgtttgaatctcccttttacattaaacaaaaattaacattttattatgggaaatttcactatgctattagaaaagcatagtgaacccccaggcatcatcagtgatattcggtgtatagcagttcacggacagttttgtttcatctataccaacacctattgcttatcctccttctgtgtcccccagttactttgaattaaatcttatacatatacagatgaatattatcacttcatctgtatcagaatgttatttttattaagaaaattatttttgagatagggccttgctgtagtgcccaggctggagtgtagtagcatgatataactccctgcagcctcgaactcctgggctcaagtgatcctcccacctcagcctcctaagtaactgggactacaggtgtgtgccaccacacctggtaacagatggttttaaaaactacaatacattatcacacttaaaaaaattatcttatctaaaataactattcagattttcccagttatttcataagtgatttttttttttttttttttgagacacagtttcactcttgttgcctccaggctggagtgcaatggcccgatcttggcacactccaacatctgcctcccgggttcaagcaattctcctgcctcagtctcctgagtagctgggattatagacacccaccaccacgcccagctaatttttgtatttttagtagagacaggatttcaccatgttggccaggctggtctcaaactcctgacctcaggtgatctacccgcctcagcctcccaaaatgctgggattacaggcatgagccactgtgcctggccttcataaatgatttttatggttcaaatcaggatccatataaagtccatatatgtgtctttttttagtctatagatttcccttccatctcctctgcaatttatttttggaagaaactgagttattgagtcatttgtcatctagaatgatgtacagtttagattttgctgactgcattccatggtgtggccaaacttcctctgtctggtgtatttctcataagtgtgtaattagatggaaaggcttggtcagatttaaattagtttttttttttctacagggatatttgagaggtagtggtatgtatttccatcaggaagcacataatgtcttcttggctctctttgtgatgttagtagccatcaatttcagtgcctagatacattaattagatttctgtatctcctactatctcaaaattttccatcttctgtctgtgctacattctgagtcctttcttcagttataaattctaattcattgtataattcttgttaatctgttgactttctaaaactggcttttcatatctaaaaaaatttccttttttcaagtctgttcattcctcatagttcttactaattggtcatttttacatcctttttttttttttttttttttgagacggagtcttgctctgtcatccaggctggagtgcagtggcatgatctctgctcactgcaacctccgcctcccaagttcaagtgattctcttgcctcagtctcccgagtagctgggattataggcatccaccatcatgcccagctaatttttgtatttttagtagagatggggtttcatcatgttggccaggctggtcttgaactcctgacctcaggtgatctgcccacctcagcctcccaaagtgctgggattacaggcgtgagccactgtgcccggcctatccttaactttagacattgcacacagtacaactgctatccgtatcggatagttcttaaggtcagcagctattgcttattgtgtctgctgactctcttggtagctgcccttcttttgtgtctagtgatctttgagttcattgtttgatcttaaccaggggaactgtatgggccaaaattaggattgaggatatttttctccatagaggattttccttaacttttgcagcagctgaaagatgccattcagatggatctacattagtcatgatgccagaattgggcaaatctgctgacaccaggacacctgtgtatatgtgtttgtgtctttccaggaattcattgaagagttgctgtctcccccttttgggggtttagtggcatttgtgaaggaggctgaggctttgattgagcgtggacaggctgagcgacttcgaggggaagaaggtatgaggaaaatatggtaatgatgggatcagtggtaagggaagtggaaaagaaaaatgaaaggatgcagattacatggtgggggaatagagtatgaaagactggattgagagaataccagaaaagagggtttgatgataaggatggctataccttggggagaacttagtggagttgaagatcagccagatccctctctgacactgtttcctcctgctattagcccgggtaactcagctgatccgtggctttggtagttcctggaaatcatcagtggaatctctgagtcaggatgtaatgcggagtttcaccaacttcagaaatggcaccagtatcattcaggtgacctgcaagtcccaggccccactcagatcccccatcattaattattttccccatctttttgctgggctcagcatcatctaagtgacccttggtcttcagttactagctgtgcccaaagttctgtatgagccctaacctgattcttttttttttgtttgttttgttttttttttgagacagagtctagctctgttgtccaggctggagtgcagtggcacagtctcggctcactgcaacctctgcctcccaggttcaagtgattttcctgcctcagcctcccaagtagctgggattacaggtgcctgccaccacaaccagctaattttcgtatttgtagtagagatggggtttcactgtgttggccaggctggtctcgaattcctgacctcgtgatctgcccgccatggcctcccacagtgctgggattacaagtgtgagccactgcgcctggccgcctaacctgattcttaatcatcactattagcaccattttacggtttgatccctcaatgactttctttgaccagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacacttatcccatttcctttctccttcctcctgaaggtttttcaggtggccccatctctagaatgacctttcctttctgactacttcctgggcttacatcccttctggtgggtgtaacctctaacctctagctactcccaggccattggaggaaggtggcccctggctaaaatagcagatgctgcaagggatgagaaccaggccgcgcagccccagacactgtcccaagggctcccttgggacaagcccaagctgactctggaatccctcctccgtagcagctccatagctcctctggttgtggctgtgacagccccttgctcgggggctgcagcacccaacccacacccacaccgttggggcagggctagaccaggcgaaattcgtaccatccgtttgtttgacttggagccttcctgctgtcctcgcctatacgcctcgtttgaacttaggctctagactggagagacacggggacccctttaaggcctaagaagagaggcgcagttaaggaaaaatgttacgtttcctgtgtcctccacccctacggcctaaacattccctccccaggtccctggagagtggtggaaagcggttcctccccgcttaggcccttcggatgcaggtctagcccgtcggcaacgggaggtgtcctgagtgggtctgtgactgccgagcacacccgccgcggagcggaggctgctgcttcctgaggctgagagtggatccggctccgggctctcctaattggcggacgctggggggcggcgtggtaaggcagaacggagcggcatctcagctctcgccttttcagggttccgccccatatccgagagccgctctctaattggcttgggaaaccgtatctcagcgctttggcctagcgactttgaacgtgtttgcgcctgagaccgaagtgcagaagagggcgagcgcaggaggagaggcttggtgaatcagcgattcctgattggccaggcgtgccttgagggcggggccagaactgcgtccttaactgacctcgcccttgcccagatcaccgcctccgcgttgctccgggtttaccccgcctgactcgctgcgctatgcgttccctcacgcctgccggatgccaggcggcgatgtgccaggctctgaggggccgcgagctcaccccagacgccggccccgggaatcctctgctcctccactttcccttcccgctactggtttcttgcccacccactcccaggtgtcactcttgggacatccagatgttctgacatttgacctgactccagcctcagcgcgaggacgggagaagggccaagggtatgagattttggacaggagaggcattggctactctgacaaagagcgtggattcccaaagaaagggtccccagataccccgcaggggagactgtcgagacaggcgactttagccaactaatgctcgcacgcgaggagggctgtgcaggcaggcaccacggttcttcacagccttccttctttccttcccctgtccgtcgcagaacccaaatcctcagagctgatcgagaagcgcgtgttgttgcagaagtcactgaggggcagacctggaatgtgagccgtggggcgaagggacagctctggagactcgtgattccggaacccggtgggcattcaagtgatactggagcacgcagttttcggggacattaag

SEQ ID NO: 17445 - DNA, 4989 bp, Human
caaatcgaaggaccctcccctcatcagcaacccaaacatacactgggaatggctgaagtggttaaggaaacacatcttagttcaagagtcactagaattcaaccttaccttccagttcgagagtagtttagtctgtagggtccaaactgccgcagattcaagtcaaagtgctgggaaagagaagagtgaaaaaaaagagtgccctgcagtaacgccttcttctagcccccattcctctattgtcctgcaccaccaatcaatcccttggctcctttacctcctcaggctcaccttggctgcacttgcaatgtccacagcctccacaatgtcagcctggcatatctttgctgtgtcttccccatcctccccttccagaaacctgaaagcaagggttaggatggcagtaaagcttcccaatatgaagcaagtataccaacataaaaacgagaaaagacagtcccaaaaggcagggaatgggggtccagattagggctcactcacccaggttcttcagcaagcagcagctcagaacgagcagctttgatacttgtttcctcttcctcagcttcagccacctcaagtcggcttcgagttttggctttagaatgtggtagctgtaacattgttggtggggaggagtggcagaagaaccacaggataagtggggtcacaggagagctacctgtcccagcctccatccaactcacccagacactccctgcctccagcacttcccaactctccggctggacctcacctttcgggatttgtcaatgcgacagaacttctggaccacttccacagggacgggggcggggcctgggaatggatcttgggcctaggggaaaggaggacgcaattagcagacagccttggattgaccccaaccctctcactctcaaggaacgaggcggcctgcctcgccacccatcaggtcccacgctcaccccggacaagccgcgctgggactccgggttcttccattctcggggtttcttcgggacctgaggcttcttagagatccgagacttctttaagatgtaagcattttttggtctctgaggacggagctcccgattcttcttgttacgaggaggccctggagaggctccggctgtggtcggaacggtctcttcctcccagtatcgccgcggtttctacaggcacatcaggaactccgcactcacgccccgccccccgaccccacagctaaaaacttcgtttcccacccagggaggcctctacctttctcttggtctgaagtttgtctttcttgggcgggacatccttgcccggcttgggggctgtctccatctcgcccacccgaacggcgatccacgtgcaaaactcctctcagctgccacacagtcggcttgaaaactcccggaagccctctgtccttcatccaatcagcagcgtaccaggtatgaagctctctaggtgccatcttgagtgagggcacgctctccttagaggggcggaacagtttttggcaccttatcgcgagcggcagcttatgcaagagtgacttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgtgagtaggttaggatttcggttgagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaagggtaagggaacagggtcggtatggtctcgcccaatgcacttacaacccaaagccattaccgagataaggtttgttgccccatctgggccctcgcgtgcagagacttccccgcctcagtctcagtactcttccctgttcactcacccgctgcccccatccttttctgcttcctcagatccatatccacctgactaggattgtggggataggtggcacatttgatgtttctaaattgcctttcctctcatccccagacttaagtaaatccatgtcggggaggcagaaacttgaagcacaactaacagaaaataatatcgtgaaagaggtgagggactgggatttgtggggcgaggagggacctgtactagccatggttctgatcacatatgtcccatccctccatcaggaactggccctgctggatgggtccaacgtggtctttaaacttctgggtccggtgctagtcaaacaggagctgggggaggctcgggccacagtagggaagaggctggactatatcacagctgaaatgtgagtttttattccaccaccgtgtgctgcaccctgtgatgcaagtgaaccattggagtagaggtgttgaaccattgcagaacagctctccatagtggcccctagtcctccagttcctccaaccctttccttcccttttaaccccccttcttctccctcccctggatctcaagttttccacctatctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggctctgtttcctgaccaggcacttctgtcatatccccacagccccttccaccttaacacacaccacctgtattaccccctcaggttcaaactcttgcacttggaatctctttgtggcacagtgttctttcttgaaagtgaaatcctaaatgtcttcaaacctacttcttgcctgtatatacaacccttaactctccctcatcttggttggcatgattcttttggaagggcatttgcaacataccatattgctaggaatgtcggtttaattgaaaaagaatacacagttctctaacctgaggccccaggatgaaatgtggttaccctccttgccaacagccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgccatttccttgtcctaaaattgttttatacacatttgcagcaagggaccagtggtagagaggttactggagagaaactgttctgaggaaacttttttcaccaatacctcactttttgctctgttcatggggacagaaaacattgtgccccttcctgttccatggcatctaccttcagccaattccccacccccactcatagcagccagttcatatgtactgcaaggacaggggagtagaattcaggtagtgttttggtttattatcttagtgttgtcacagtgatagaaacccccagagtgggaagaagagctcctgcgaggacctacattttgccattcccctctgccctggggctcagagccttgaagcctttgcttggcccttgcatgttaggatatggccaagaatcagaaactgatgcgtttttccagcactacctgtgtgctgcactcatggaaggtgggaagctatacacaggtatccaacttggttataagacaccagttcccacagggctggatttctcagctgtctggtaaaccagtggcacttcactgccccagggtggctggctccctttctgaatttctgtctcaatgtgatataattgccaccattcaggatggctacccacatctggtatgaacaccatgacttctgtaagccaacggggcttcctcctcagaacagtgcccgtgcaatcttcctccctgtggccttgatcctgggaaaggagccccctcctccctcactcggaggagttcctgaggcagacgggccactggtgacgccaggtgtagcagtagaggaccttcgccgctgccgcaggaggaaatcgtgtgaagctccatccatggcgtagaatacattagccgaggctgggatagtcagctctgaaggttcaggggatggatgtaaagcacacacacagttgttccccccacagccgcccagatgtggaagtactccactctcctcccgagtctgcctttccctcatggcctctgacctcgctcccctggtagcagctgtaccagctcatactctgaagccactgcagagtcacgattgtttttcttaaggacacgactgatgacacttggagccttgtcctggcttgtcacctggcagaacaggagaccaaaagagcaatcaatcagccatgatttcccatccttctaccctcagccactgaacccaaccacaaaatgttacttgtgtccaaggctttaaaatgaacaggaaaacccaatatggtggcttcctataccccataagccagcccacatggtgcccagtgaaacagagctgcttccctgtggggaaactgctgttgattctgaaattttaacacggcgaccaaaagtttaaggtgtagcaactaatgcaaaatagccatcaaaataaaacaaatttcagcttcta

SEQ ID NO: 17446 - DNA, 18319 bp, Human
gctgggagctcccagcagagctggccgctgctctggccaccttgtgcaggagctggaggaagtcatctggggctgggcagctgttgtgtgtgcatgcacacatgtgtgtctgagtgtgcccctgtgtgctggcttatgttcaggatggagtgaatacatgtgcatgtgcacaaaatcgaatgagcgctccctcaaccaaggctatggagcagccttgtggggcctgggcaggagccagtgtgcacataggtgcttgcacacctgtgtgtccttcacaagtggcaacctgaggagccccttggagtcacttactgtagtgaacattaacttagagaatggtgagaaacccaggagtgtgggaggctgctgtgtatgaatctgcaaggcacattcagcgttacattcaacattaaaatacagtttgggttttttttaatttttatttttctgaggcagagtctcgctctgttgcccaggctggagtgcaatggcgcagtctcagctcactgcaacctctgcctcccaggttccagccattcttctgccctcagcctcccaagtagctgggattataggcatgcgccaccacgcctggctagtttttgtatttttagtagagatggggtttcaccatgttggccaggctggtctcgaactcctgacctcaggtgactcgcctgccttggcctcccaaagtgctgagattacaggcatgagccaccgcgcctaggcagtttgggttctttttttaagagatagggtctcactctgccacccatgctggagtgcactgcgtggcactctgctgccttgaactcttggcctcaagcgatcctcttaccttggcctcctgaagtaccaagattatgggagtgagccaccatgcccacctgttttatatttggggaaataattagtttgaaggtgcaggcaaccttccaggcaagcgagaggcactcgaccccaaggggtcaatttagaagggtcaggcacactgatgtgggcagagcctctcactgccctgatccctgaacagagtgggtgccaagttagtggaatgtcagcttttggttctgattctctgccttagggtttcagtttccccatctgaaaagtggggggtgtttatcttggcactgcttgtctgcctgggtagttatgaagaaaaaaccccaaacttagaaaatcatgaagggctgcatggggcaggatgggagaaagaggcagtactgtcctgtccccttaccaggtgacaatggcacataccaggtgcctggcatggagcaggtacccagcaatagggtacttagggagtcactgagtgactccccaaatgaatatctaggggtgacagatgcaaatgccaccagggcccaggtaggaggagtgaagagagtgcccctggcctggggtagattgatggagggcagccatcccagtgctagctggctgttgcccagtgggcccaacatcacattttccagttttaccagagacgccgcaaatccagacttacataaacctctcaatatttttctttttctttttctttttttttttttttttgagacggagtttggctcttgtcacccaggctggagtgtactggtgcgatcttggctcactgcaacctccgcctcccgggttcaagtgattctcctgcctcagcctcccgagtagctggaattacaggcatgcaccaccacacccagctaatttttagtagagatggcttttcaccatgttggtcaggctggtctcaaactcctgacctcaggccatctgcctaccttggcctcccaaagtgctgggattacaggcgtcagccactgcgcctggcaaacctctcagtttttaacactggcaactgagactagtgtgtgtgtgcatcatgtgggccaaacccaatcatagcagagccctgggggagcgggtccctgagtgctgcccgtgactgttcccgctggtcccgcccggccgcctggcctcacccctctgtgtgcacagccccactgcaggccccaccatggcgccgttcctgcgcatcgccttcaactcctatgagctgggctccctgcaggccgaggacgaggcgaaccagcccttctgtgccgtgaagatgaaggaggcgctcagcacaggtaggcctggaggctggaccgtggagaggggctgggaatctgggcccagctggaaggactggagggggcctggccttgttccctgcaacctctgaaggattctgctcttcctcatccttgactccctgccccactcagctatgaaggcagaggccactgagtcgctatagggctgcaaacactggccaaattgagccctccttggaaggcttggagtttctggttcctcctccctggttgttttacccagcaatttttacatgtccatttgtgccagggcctgtgcggggcactgaggatactgtcatgctccaggactaacctggccctgccctcatggggttcatagtcaggtggggaaaccaggcacgtcaaaaagcagtgagtcctgcaatagggaagcccagagaaggcaccctctgaacctgaggtcagggaggacttcctggaggaagcacatacctcacatcattccctcttgcttttgccctggcctggtgaacccctatttgtccctcaggtctcggctgaactgttccttcctctaggaaatcttccctgacccttaggcttgaccctgtagcactaccagccttgccctcttcagtctcatcacaactgtgacttaacagttacttgaggaaggagttggtgcattcgccacccgggcctggggatccaggaggacaggccctggatgtagcttttctttcagctgtgttctgcgcctcgaatattatggctggcatgcaggagctgtcagcccatgttccctgcatgaatgcataagggcaggcgacatttaaatggagctggagcaagaggatcagaggaagagggaacagcaggaacaaaggcctggagggaggacctagcagggtgcccaaggtagttctgtgctctagaggacactggggaaccacagcaggccctcaaggcaggagagtcgggcagattctgccaggggaaggccgtggaggtctaggagggagggacagaggggccatggcccaaccttctctgcctggccttgttgcagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctgggtaaggggcgcacgagccgtgccgtgtgtgtgtgtgtgtgtgtgtgtctgtgtgtgtgtgcatgcgtgcatgtgtgtgcgtgcacacacgcgggcttggtcagtgagcacagctgaagagcaccgggccctgtgctggccaccagtccagccctgtggccaacatgtcctgggtgtgaatcttggctctgcaattcaccagattcccagcctctctgagcttctgcttccgcatctgttaagggaaggcgctactaaatgtgcctacctcagggtcagttgttcaaatgaaaggagcagctggatgtacagggcttattgcagaacctgacacatagcaggtgctaaagacggccaacttccttattgtgactactttttcctttttaattttggaaaggcaggatatgcacatagtaaaacatttttaactgcatgaaagggtgtgtccctgccccaacaccaggccaccaggcctccttcccagaggcacccattatcccagttctttttggaatcttcgcatatattctaggccttggcagccattgagggggcaacatagtgatctttaacagcaaggaggtgggagaaggggaggctgacggtctcatctacttacctgctgaaatggagactctgcacaagcatgtggccacttggccatgtgcagctgtgtgttctgggtggccacaggatgccagtgctggcagaagtcccctggggttacatgtgggatgtaaccaagatgtctccaccaggaaaggccctgtgaccattggaggctctgatcagcctcctgcgaggggtgagggggctgggatgggagagaggttaacacagggctgtactgacccttggccagtcaggcagggacacagaggggcctctggctgtgctgtctccgctcccccaagggaggatatcagtcaccaggtctaggtcttgggggaggtgaggggatagaggctcaggtcccaccctcgagactgtccaatctgcatgaggagccctcggcacagagggaggagcagcgtgtgtgcacgaggatgagtgtgtctgtgtgtctgtctctctccgcatgtgcacacgggtaggggcctccattctaagatccttgctaagggagctgcagcgggtaggggtggggaatttcccttcccgctctattccccagctatgtgtctgggctgggtgtgggctggaccctttcacttccctaaatgtaataatacccctgggtacagggtgggggtggggctcaggagtggggctcaggcggggccctgcccacactgggcagacaagtgtctggctaggccttggggggctgccttggccttgggggaccagccatgggggtgggttctgagtttggcctggcccaggctgccctcactgaccttgttctcccctggcctctggcccccaacagctggacctgcagcctcaggccaaggtgttgatgtctgttcagtatttcctggaggacgtgggtaagaactccctgggggtggagggctcccttgccgggttcagaggcagagccagcactgaggtgtagggaagctgctcccttcggcagagctgtccaggaccaccctgggagggactgtaggggtgccaccccttccagataccagggctgacttccctactccatggtcaccagattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggtgagaaccggccatgcccactggtggtggtgcagggtagtgggggccgatcccggtccccgctcactcactttgcctgggttttgcctttcaggggcctcaacaagcaaggctacaaatgcaggcgtaagtgtctccacaggccagtttgtacgtatgtacccatgtgtgctcacgtgtgccagtgcctgtgtgtatgccagtgcctgtgtgcgctcagagagtgtatgcacgtgagttttcccagtgtagctacagcagctgagttcagtgagtgctggggctggcttgctgctgctctggaaaaccagttctgcgcatctcttcccagctccgcattcagtgacggggagttggtggatggcaattgggcacagtagagtattcacgcagaaaccagcccaggccatgcaccaggcctcttttccccggagaggcaatgataggtcctttactggcacatagtggctgcatgtgcttctgtgtagatgtgggtgtctctgagtacacaggtgtgagcacactctgtccctgagggtgtatacacgaggcgccgcaggctggagccagactgcctgggtttgaatcccagctctaccacttcctagctatagggccttaggcaaagttacttaacctctctgtgcctcagtttcctcatctataatttttttttttttgagactgagtctcattctgttgcccaagctagagtgcagttgtgcgatctcagctcactgtaacctccctctccaaggttcaagcgattctcttgccttagcctcctgagtagctgggattacaggcgtgcaccaccatgcccggctaatttttgtatttttagtagaataggggctttgtcatgttggccaggctggtctcaaactcctgacctcaagtgactcacccacctcagcctcccaaagtgctgggattataggcgtgagccatcgtgcctggccctcatctataaattagatataactataatgtataatagggtcattgtgaagatcaaatggaataagatatgtaaagctgtattttaagtgccttccactggtagccgttctgtgtaagaagtctgttatcattattacacatgctttgtgtgtatgtacaggtgtctgttttgaggcgtgtccatgtgcatgtgtaagagagggcatttaggagccgtttgctatcccagggcttggaagaactgcccccgcttctcatattgcgatgccctgtgcccgctaacttctgcccacctccctgcccactaggactccttctttctaagcccctgcagattggcctgtcctctccgccccgtcctctccaggctcctccttcgagggctggcaggaggaagactcaagcgctgggcctctgcggggtgagggtgtgggcggtcaggagaacggtggctttgtgtagagggctagactggtcggcaggcaccagctcatagactctgcccctcccggtgctttcccttccccctcctgggcctgtgcctcttcaagaatgtaacgctgccatccacaagaaatgcatcgacaagatcatcggcagatgcactggcaccgcggccaacagccgggacactatagtgagcctgggtccggggcagggctggggatctggggggcttggccagatgggagggatttgcaccctctccccaccctccctggggagcttaccctccctccccatttttcttagtctttccttgcctctcccagtggagctctcttgggatgttgttgtgcccagggttgggggagagctaggggttgaagaagaggctggagctggcacgtgaccctcagcctgtgatacccccacctccagttccagaaagaacgcttcaacatcgacatgccgcaccgcttcaaggttcacaactacatgagccccaccttctgtgaccactgcggcagcctgctctggggactggtgaagcagggattaaagtgtgaaggtgcgtgccaccccgcccctgggctgcaggaggggcactcccagctggtgctgctgtgaattccagccacctcacgccaccctcgcctcctcacctggagacgggcacctcattcagggacctgatgagggtgaggccttggtggaccctccccactggcctgactggctctgccacttacctgctgtgtgaccacaggtgggcggctccacccctctgagccatttggaggagaaaagcaggacctagagagtccctgtgaggggccagtgggcagagggtgctgaagccaggcctggtgcacaccgacaggcgcccagacaggcctcccctgccctctgcttcacttagagatgagacagaagaccctggagggaaagcggcttaagttgacccagatgttctttaaagggtttcgaattaggtccctgtcttctggtttttcctttttctttaaatcatgaaagattggctgggcgcggtggctcacgtctgtaatcccagcactttgggaggccgaggcgggcagatcatgaggttaggagatcgagaccatcctggctaacatggtgaaaccctgtctctactaaaaaaatacaaaaaaattagcctggcgtggtggcgggcgcctgtagtcccagctgctcgggaggctgaggcaggagaatggcgtgaacccaggaggcagagcttgcagtgagccgaaatcatgtcactgtactccagcctgggtgacagagtgagactccgtctcaacaacaacaacaacaacaacaacaacaaaaatcatgaaagattgaaatgcttggccaggcgtggtggctcacacctgtaatcccagcactttgggaggccgaggcaggtggatcacctgaggtcgggagttcgagaccagcctggctaacatggaaaaaccccgtctctactaaaaatacaaaattagccggatatggtggcgcatgcctgtaatcccagctactcaggaggctgaggcaggagaatcccttgaacccaggaggcagaggttgcggtgagccgagattgcgccactgcactccagcctgggcaataagagggaaactccatctcaaaaaaaaaaaaaaaaagagagagagagagagagatcgaagtatttatgatggcttcagatcaatgttttcctagaaactggaacccagcagaccccactgaagccctcctttctcttgctctcctgcgcctctcctacactgccccctgcccttggctgagctctgagactgacagccccgcttctccctcaccccagactgcggcatgaatgtgcaccataaatgccgggagaaggtggccaacctctgcggcatcaaccagaagcttttggctgaggccttgaaccaagtcacccaggtgggcaggtgccatggggaccctggacacagggcagtggggtcagggacagtcaaggcttacagccactgctggggagccacagacagccaggatatatttagacccaggactctacttcgggaagatgcaactcaagaatttaggcagcagagggaggggggctttttttcataagaaattcattattcaggcagttctttacttgagggtgaacctggggaccacaggagtgggtgttggaacactttgaactaagactttgggtgtggacgtttgtatgtgggtggggcttgagggatgccacaaaacctaaaggtaaaattttagaatcaatcagaaatgaagctaaatagtcaaataaaatctatcgagtgagtggttgggaaggtagggttccgtttacaaaacttctgtttgtaatcagagcctttcagaccaccaaggcttctctgggctcctggaagagtgcgtgtgtgtacacgcagcccgagtagggggcctgggctgtgcccctgttgtctcctcttggtgttaagggtggagttatacctgggagtcttccttctgggctgggagttctgataatggtctgaccatctggccccccacctctgctccctccccagagagcctcccggagatcagactcagcctcctcagagcctgttgggatatatcagggtttcgagaagaagaccggagttgctggggaggacatgcaaggtgaagctgggtccattgccccattacggtttttattccccctgaggccaaagaaaggggactgtcctcccttccattgtcaagtgagacatggaaggaaccaccggtcctggggagcgagccccttcctctctgaggccccttcccccagcctaccccaggccccgggggaggggagttgtgtagactgagaccccgatctgaggaggtgccatctctcgggcagacaacagtgggacctacggcaagatctgggagggcagcagcaagtgcaacatcaacaacttcatcttccacaaggtcctgggcaaaggcagcttcgggaaggtgagggctgtgagccgggcacctgcttcccaccccaccctggcttcttcccgcttaggtggctgaggtgggagtctgtgaatcgggctgtggcccctgccccgtcctcacctgctcagcacccgtgtctccccatcaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggtgcccgggcctcctgccgtcaccaccccatgccacagccatgtcccacagctcctcagcccccctcagtcagggctgtgtctccccctcaggccacttaaggcagggccatgctttccccccctcatgcctcccagggcagagtcgtccacctcagccagggcctgtccctgctgtttcctgttggggcttggccccagtggccctcagtgagggagcctcctgcctattcctcacccctgctcaccacccttcccaccccaggaccacctgttctttgtgatggagttcctcaacgggggggacctgatgtaccacatccaggacaaaggccgctttgaactctaccgtgccacgtacgtaagggccatggtggggaagggcccagtgtggaggaagggctactggctcagagcccacttccagtctgccctccatgccttcttccctctccctagaaaagccagcctgggctagagcggcaactggggagatgtgggggtagcctgggtcggcaccacacaggaagccatgggtggcaagtgaactgcggctgggtgcgcagcgcaaatactctgggtcctggccgctccgtgggccacagccagggcagccttgcaaatggtggtcctgcatgacacaggacacaggaccctggtgcgtggcccccagacctgcttctccccattcacatgccccttaccccaaactaaccgtgtatgtgtgtgtgtgtgtgtgcgtgcatgcaaacacatatgtacatgcatgtaaatgcatacactcttagagaattggctcactgagagctttcccttcagaactttctgcctgggctgccagcccccacttgcctgatacaagatgtacttgatcatgctcaggtggtccatggagttatttgcagcatttcttgctcctggaagtggggttgagggcccgaggagaagcagaggctgctcggcagagatcccggaacactttatccctctctcttgcccaggttttatgccgctgagataatgtgtggactgcagtttctacacagcaagggcatcatttacaggtgcgggggtgagggcagcgggggctcttgggaggggaggctccagccccatcatatcttctgaaatgctccaagcaggatccccccaactccagttccttctctgctggaaatcaatctttagctgggtatttgcctatgcctcccaccctggtgttagcattcctgtggccaccatttgaggctggctcagcttcaggaactaggaactcactgctcatatttgacaccatcgccccacccatccttggagccgtcagtctcgctctgaagccccatcgagtcatctaagcttctgccagaagggactccttccataaagtctcatctaataagttatgattccatcctatggtgggaactgtacacccaccaaaaaggctgaggtcaggctctgtatactgatgtgggataatgccaagatatgttgttaagtggaaaaacaacctgtgggaaagtgtatatcgaatattagcattcagcctttaaaacgtgggagggagactgagcgcgatggctcacgcctgtaatcccagcactttgggaggccaaggtgggcagatcacccaaggtcaggagttcgagaccagcctgaccaacatggtgaaaccctgtctctactaaaaaatacaaaagttagctgggcatggtggtggatgcctgtaatctcagctactcaggaggctgaggcaggagaattgcttgaacccgggaggcggaggttgcagtgagctgagatcatgccaccgcactccagcctgtgtgacagaatgagactgtgtctcaaaaaaaaaaaaaaaaaaaaaaaaaaaaaaaaaggtgggagcgagctgcatgctgccatatgcttgtccacgcctagaattgctctaaggagagcctcatgattgagctcagtggaaggtagactttgtactgtttgccatttctagttcccatatgcattaagtatatactcaaatgactaattactaaatatagacatggtctctgcctgtgggaagtagacaaacctgaacctgggggtcacttctgctgctgactgctaggggaccctgggcgagtgacatcacctgtttgagccccatttgggcttcaggaagtagggcagtgtatgcccagcgtttagcacacagtaggggacttgcaagaagcacctgtttttaggatctctttctccttctgcttccttttctgtttctcattcccttgtacccttggggacagtcctggactaatacggctgaaaattaggacatggggggcagggttggaaggagaagaaatgtcccctgctgactcttacctgtcccctgtccttagggacctcaaactggacaatgtgctgttggaccgggatggccacatcaagattgccgactttgggatgtgcaaagagaacatattcggggagagccgggccagcaccttctgcggcacccctgactatatcgcccctgaggtgagccgatacccttccagccccccgctcagtcaggcaccttgcctccccacggtgggccagggaaggattcccaagggcagtgatgtccaagccaaagcccataggctgaggcggcctggctaggcttcgtgcccaggggcccctctcagcctcagcacctcagctcctgctgacctgctgctctccccaccgccagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaaggtggaggccctgggctgggctgggctgggctgggctgggctggggcaggggctggcagacactgggctttgggtgaggagcttcctgtctctggaatggcagcctcagtggtgctgcagtcctaacatacggggtattgctctctcaccatgttcccaggaactcctgtctgagtcctgtgcatagaatcagcctgacatggtgactaagggcccagggtcaggagacagacccgaggccaaatgctggctctgcctgggactagctggtcacttaacctctcagagtttgtctccttatctgtaaaatggggctatgagcagacttgactcacagagttgttgggaagaaaatagaaacatatgatgctcagctgtgggccaggcagatagtaaataataaaaagttccaccagcagagtcgcagatgtccagcccagagcctgtcatctccgggggagctgggagcactgcaggccagagtggcctccctcagccccaccgttccccaggctgactggggctggggcaagcctggctttgcatccctgggcctgctggggatttgctgaagctccaatttcccatggcccttgggtgctaaccagggtccctgctgggttgcagctctttgaaagggaaccaaccaagaggctgggagtgacgggaaacatcaaaatccaccccttcttcaagaccataaactggactctgctggaaaagcggaggttggagccacccttcaggcccaaagtggtatgtgatcctgccctgtgctgccttcaggctgagctactcctctcctgccctccctctctcctgcatcattcacacgctttccacctctcccttcttccagcaatctccatagcatgttcagtcacagccgctgcccttgtattctcatcctctccctcctgactcagtcattcagcacacactggggactgtggatcccactgtatgcagaggaccctgttttgggaaatagagttaagacctcactttatcgctccattcaatccattttccaatacatatggggaatcctgagtccctgttgaatgcagagcacagtgctgggctgcacagcaaagtgggagatgcagtcccagaaccggaggagctctcagctagttggagagataagaaacttgcacacctatgacaatttgtgatacgagatgacagtataagagatgccccaggacacatgatccgttgctattgagtgggtctgtcagcaggaacccaggtggcagagaagagggtgggtctgagaggccccgttggaagaagtgagacaagggacagctgggaggcattccaggtggaagaggggatggttcactcacaggcccagaatctacagggctaccaaggaaccagcctgagagcagaggcaggtggggccactaagaaatttggggctgtgtggcccctctgtgaccacagttcttccttcccactccccttctgtcctttgattcccctcctccaccagggcacacagttcccactgggcagcctgtgtaatgcgccccacatttgtgctttgaggctacagagcacttcccctacaccagggacctcaaactcagacgtgtcctggctgagcatgtaactgacaggctaggccagctgcaagaaaatcacacagcctgctttcagtctcacttttgatagatttccttctccgcactaagaaacacaaagcaggtgtgatgtaccccttgtcagtggggcaggggctgtccagggggctcttagcaccaagagtgggcaggaagtgggcccagggctgctttaatctgccagttttcaaaagaagctggaaatctggatttttaggttgcattgctcaattttaaaatataagttcaggccgggcacagtggcccacaccagcactttgggaggctgaggcaggcagatcacctgaggtcaggagttcgagaccagcctggccaacatggtgaaaccccgtctctactacaaaaaatacaaaaaaaattagccgggtacggtggtgcacacctgtaatcccagctactcaggaggctgaggcaggagaatcgcttgaacccaggaggtggaggttgcagtgagccgagatcgtgccactgcactccagcctgggcaagagagtgagactccatctctaaatgaataaataaataaaaataaataaataaaatataggttcaaattccattaaaacccagtacaagccgaaatgattgtacttgccagttcagtttggctgaagggccaccagcttgcggtctttctatattaccatcccatcatatcctcaggagcagagaatcagcaaatttctcctgtaaacagcctgatagtatatattttaggcttttcaggcttgatggtctcaaagcaggcatagacagtatgtcaacaaatgggcatggttgtgtattacaaaagctttatttatggaaagtgaaatttgaatttcacctaattttcatgtcatgaaatatttttcttttgattttttttccaaccatttaaaaatgtgaaagccattcttagcttgtggtccccacaaaaacaggtggtaagtgagcctccctgggctgtgattcggtggtctctgagcaagaggctaccacctctcctaacccaggcccagagctccctggtcactttcctcatcctcttggggaaatggcagcctccttcccatggggctcctttcaggctgctaggggaggctctgtcttctgttctgggtgaggacagctctggcctggcccagccctgcagggactccagcctggggtgtctggagggccattccctaggtcctgttcgctcacccctgccctctgcttgtagaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatatattatatacatagacatatatatatatataataggctgtatatattgctcagtagagaaaaaccatgggggactggtgatatgttgatctttttcaaaaaaatatatatatgacaaaaaaaaaaaaaaaaggagcacaagctgtttgaaccaccaggtttatttgtgtgtctaaataaacaccaaatagtaccaacctggttgtcaggacacgtttgtcccaggaagctggtggtggccactcccacttttggcagcactggcccggaagccaactgctgggccttcatgcaaatgtgtttgtatttatgggtttcctctggccccaggaccctgggcctaaggcagacagcttttctgggtggcgacagggagccccagatgtctctgtggggtgatgggaccagctgtagctgtctctggaagggcagagaagtagaagacatgagcagaggctttgaggctggctccagatgagggaggaggacaagggagaggaagaaaatacagctcaggcttcaagcatatctggatttaaatcacagagtagccaaaggatgtgggcacgtcacttgatcattttaagcctcagtattgggtgggcgtggtggctcacacctataatcctagccctttgggaggctgaggtgggaggtctgtgtgagcccaggagtttgagaccaacctggacaacatagcgagaccctgtctctttaaaaaaaaaaaaagaagaagaagaagaaaaagaaggagaaaaaggctcagtttcctctaaaatggggacaaggcaaggagaccatagctgtaactcctcatctcattaccatttatccctgcctttgccgcagaggagtctgtgtctaaattctagaatctatatcatagcagcttttgcctacctggggaaggagagacaggcagggtgggagagaaaggtggaaaaatgctgagtgactgggccaaggttgacagacatgctccagtgtgcctgtcgtgcaggtgaggaatggctccaggagaccaggaggtgccggcatccccccaagagtgcacagctggagacagtgtgtctgctctgccctcctccccaccgtttccatgtctccccctctcctggcttttcattgcttccgcctccctcgctacctctccctctttctgttcccgccctgctgtctgggacaccggtctcaggcagagcctgctcttcagcccctctggtccagccctggccctctgtccctagaggggggcgaggcactcctagcaccggattggctggcctgggcagccaagcaactgacttccagcaagttcatttttctgggctgaggtacaagtttccacaaccggagagggtgggatggtatggggctggtgctggcccagggagggggctgcagggatgggggccaaactctccccaaagagaccaaatgtccccttctcctccccacctcctatcttctcaaggaaccttcctcttgaattcctgctctgccttgggccagcctgggtgtccaggacagcagggaaaacctcagaaagtgcttgtcctgtgggatcacacgtggaggaactggcagcatggcataggctctgttctgggacactggggctgtaggagcccagaggaggtgcctggagaccccctgttccctgcctctgccacaacacacacattccccaagaaccctcatggagccattcagagggaggttagaacaaaaacgtggttggtgtctgaactcagagcctcccagcgtcctcctgaagcaccaaagcggagccttgtaactcgagccgtttcctcccgtgtggaaccggggaataggttgtttatcagccagaggcagtggagggtggtgggaagaacatggtgcctggaatcagaagcctggggtttgaattccactccgctacctacataccaggcactcgatgagttccttcatgggcctcagtttcctcatctgtaaaaccagaccattaatcctgctgcctcatggaactgactctggcaggcccttgtaggactgttggtccactactcagtggtgccaggcagagcccaggaaaggacaggggctgggcccgtgaggtccacctcaagcagcccaggacaggaagcagctgctggggacactgccaaactgcctgggaggctacaccattccaggcccatt

SEQ ID NO: 17447 - DNA, 41815 bp, Human
gtgcggatcttgtccccgcagccgtggactgctgctctgccgacagcagcctctgcgtccccgggggccgagggggacgttggaccgggacagaattcccgactgctcccaacctggcagaaagaggctgagccagggacaccagggcatctggaggtcaagtccgttccccaaaccactcgccaattttcaccccgtccgcccctccccggccggattagagcgccgaggccggtcagccccctggggaggagcggcccccggtgtaccgaaccttgccagggcctagagcttcgccgcaggggcaggggcaagtcctgctcccctcaagatcccgtcgcaacgcccccttccttccccgcgtccacagtctaatcccggtctgcggcacgggaagcaggaggccggcggcccagagagcccggggagaggacaccttgtgtgggcggctgtgcgctgaccctcagcggggcgcagctagtttgctgtgtgtcctgaagtcctagctggccgtctctgagctccagcccatgccgacccctgccagttgtaggaaggggattctgtggccacggaagtgaaagtgaaaagcccaggccgtggcgggaagaaggattttcctctgcagtgggagtccctgaggcatttgttgggaaagggcccgggcgctctaggcagcctactggggaaggatgtgaggaaacatggagacatttccctcccttctcctcgccctcagccctagagcagctccccggaggggcagggcccaggattatgggtcaagggtcaggtgacaaatccaaggggtggagacgggggtggctttctcggtctctgcctctgccattgccactccattgcgctttcacgtggcctcagaagttggtcaggttgtccaaccttactctcctatgttgcagccagaccggaggcccagggacgagtgcagtgaacaccccggcccctcagaggcccaggctgcgaagggagtgagcctcctatcgaggggtgcgcctgtgcccggcattgagagtgcaccctccctaccccttcattccagtggaggcttctcccccggctgtgtgtcctcggggcgcgaggaacatgcgagtagtggtgttggtgtcatcggagacactggaggcatgggcctgggctcccggcagggtccatccccggtcaaggaagcccctttcccccgcgcgagggggtgaccgggaggggagtcgttgcggggggcagtagcaataggggagaggcggagccggctggcttcttctgcccaaagtgggggttgggggttctggctcgcgttcctctcacggcgacgccggagggaggaccccgagagttggcccggggtgtgccagggagtcggtgcgaggccgtcagggcctgaacgtgcgggagtgtgcgcaggagagacctggctaaggccgagagggagagtgagtgtgaaggagcgatcccgggggtgagtgcgcgcccagccgccctaggggagcgggccgagtgggtgtgtgtgtgtgtgtgtgtgcgcgcgcgcgtttgcgagacccgcggccggggctgcgcgtgaagcacggggaccacagccgtcttgagggcgcgcccgagaaagggtgaacgcgagggggccacgcgtgccagtgcggacgagtgtgccagcgggggggcagagcgcgtgccagtgctgggcgagtgggagtgggggctcacaggcccgcgcagggcgagcggaccgcgtgtgccaggagcgagagcgtgccaaggcgggggcgcgcggggcccgtggcggggaggggtcgtggcgcgcggccgcggaggcgcggggagacaaggcaagagggggaggggagcgagggcgcgcgcggccgagcgggcgcccgcggtcacatgggcgagagaaggagggagggagcgcgcgagggagggaggaggatgggggggttaaagccgccgagcgctgaagagccggtgcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcggtgagtaccctgcggcggagtgcgcgcggccggaccctcagagcccgggctgaccagcagaccggcggccctcatgcgtgcgggaagagtgaggggacacccgtgggcccacggacgggggcgacaggaaagttcacgagaaactttgcctgcaaactcgggggcgggggcgctggaggagcggccccccacgtccgggcgctccgggggttgggcgtggtggtggtggtggggccgactgtggactagagggaggtggctccggcggtttgtcctagtgtccctgttctccccacccctcagctgcacgcgcggggtctggaaaaattcctgggtttggggaggttcgtagtggcctttgcgcgcccaaaggtggcttctttctcgggcagaaatctggacttcaaagcgcccggggatgcgaaccgacggttgcgcgtctgccagtgcatgtgtgtccgtgtgaatccgcgcgcccgcgcgcgcgtgtgtgtgtgcatgtgtgtgtcggtcggcgtccccatggttttctcttcagtccgcctggatgtatctccatgtagtgggtctcctccagtgtgtctctttgtaagtcttcctggcttgtgcgagtctgcctatggtgtatccccaagtgtctctttgtgagtctgctcgtgtgtgtctcctccagtgcggctcagtgtgagccagtctgggtgtccctgtgttgctccgagtagtgtatctccgcgtgcgtgggggctgggccgtggggaggtcaccagacggacagctctccctctcggctcctctcctctcccgagcctctcctccagcgttagctcgctcgcttgctcgctcccttgtccccctcccccctccagtagcttcaggcgggcaggactatttcacgccttgttgaaaattcaggattttctttctttccgtctagtctctctttttgagaagcgtctgtgtgtgtctgtgtgcctggcagcttgtctgcaacattgggtgtgtgtctgcatgccgctgtaggagtgtgtctctaacactagttgttctgcctgtaatacttggtgaatttgtgtctgtgtcactgggagtgtttgtgtggctgtggtcactgaggtggtgcgagtgtgaaatgctgggtgtgtctgtgcatctgtaattgctgtgtgtccgaggggcctgaaacaccaggtgtatttttgtgtatctaactctgggtgtgatggtgtgtcattacacgtgtgggaatggggcttgaaccattgcagattcccagggatgtagggctagcaatgacttgggggctagaagggcctaggtgtctcaaactatgcctctctgtctccactgtcacaacccacacaaatcctctcagctggtgccaggggctcctggtcagcattggtgagatagagctaaggttcacactgtcagggctgatactccaactgagaccctgagcctacacaaagactaggagtttaaagttcatgcacaggacttctgggggctctggaatccatactcagatgcacactgggacacttcaactccttctagggtctaggggcttacattcatatggactgacacttacgttgtggggctcatatccagggatacacttcagtcctggagtttccacatagactcacattggaactctgctcacactgggacccacactgggactgtaggctcatgcttagattcacggtcttaccctttagcttagatctacattgagacctagagctcacacccagaatctcactggggtcctagggctcacactggggctcacacaaagaccctcatgctcactccgattcacacttatattctgggactccgagttagtcagactcgcatggggaacatggggctcacatttgaactcaaggactcgctgaggacactggggttcatagtcagattcacatttccaagctggggatcacattgactcacacggggaccctggagctcactcagattcacactaggacctttgggttcacacttagattcatatgggaactttgggggttagacctccatgggtaacctggagctcacacatagactcataccaggatcttggtaggactcacttgaagtcctgtgactcactcagattcatattgggatctcagagctcacactcagactcacagtaggattctgatgttcacacttagacttacaagggtactttgggactcacactcagacttaaaaagggataccagtgctcacactaggactccatataagccaccttagctcatactcagaagcccttatgaccagggtctcacactcagacttacactagaactctaatgcttatgctgacttgtacaggaatgctgggactcacaggctctctcacttcagtcctggagctcacattcagacccactggggtttacagtcagatgcgtgctgagacctgggctcatactcaaacccgtacttgcatcttggagttcacacttagatggacattagaccgtgacacttagattaaactcacactgtcatcctgggctcacattcagatccacactaagattgtggcattcacaatcccagtggaacttaggactcatggtcagatatgcccatgctttcctttggtttgtggtgagtatcggggcacttgaagtgaagaacagagactgctacaggatctgtcccctccaaaggtgaggaggagagaggacacacatttggtcacgtccctcacaatgggctgtgggctaatggaggggagtggtggtaaaggctaacccagtcagatttcgctgctttccttccataaggagactagactcttggcaggaagatctgagtggattgttggtacaggagtaatgtgaacctttagatttctccgtgtgccatgtcaatgcatacccatcccccttgaatagttttggacatcccttctgtggtagagaagggccaggtgggggaaataagactcctgtcctcccaagacatctcccccgccccatacacacacacatctcaatcattcttaggatgggaggggtgtgaagattggagggagcagaccttggctcctgcgactgctccagggtgttgaatctgtgattgtaggagagataacagcctcagatctgtggggagaaagtagctggaggaggagacgggatcccaccctctcttctcttctctgccctggctggggaggggtagggaccatgttttgttgtgcgtgtctcacagtgtctctgggattgcctgttgagcccttatcctggctccagggcatgcctaggcttccccactctgttccccaaaagagcagtagccctggggggcctaggatgcagccagccctgggattctaactcccgtggagaccctgccctggactttgcgtgctctgctgctatgaacatcagtgggtggggctgcctgagatatgctgtcttcccccatgggagcccacacagtagggacatggccctgcggtccctcccaatgctgagatggctgggctgtaactgctccccgtcctgaaggggacacacgctctccagccggggtgggaggcttggaggcaagacacccctgctctctgcccccccatggcgagttgaagtgtaaatgaatcggaaacatatggagtggattttctttgaaatgcagatgggttaggggggaccatgtgtgcttggtttggggcgtcctggagagcaaggagcctgagaagtgagaactgacccctcctccagacccaccattgggtgggggtagtgggggagacctcagctttgtaaactcctgtggccctgggtgaccaaacccacaagggctctcagcttcctgtggggaggggctgggaaggcaagtggtccctggggatggagagcactgaggtcatcagtcccttttacctctgcagagggcaaagagagtcccaaagcacagagctgtgcccggttgggggtcaccagagctaggcactctgggggccaaggggtggaaggaggagctggagcaggcgttgaggaagagttagaccctgtggctgtgggcagccagctcccaaaagctaagactagagctacagtagcaggaactgaaattaaactatggtagtgacttgtgttcagctcgagggcccgtcttgggcttaggagcaaactgaagagtccttagcctgtaggaggacaggtttctccagaccccagggtagtcagtgtgccccaccatatatcctacctgtactttccccacgtgacacccaggaaggttgcacagtagttgcctctgagctctacgtgactcaaggactgggtctcccttgctcaccctgtacctgcctgcccttggcacagacctcgtacaccagaggaaggcattcttgtgtgaacagtaatacatctttttctgtctcattggaccgaatgctccctgtgggcacgaccatgtgcctggctccctgtacagtgcctggcagggaataggtgctcaataaatgttgaggcatgaatcactgagtgggacagatcatgaggagagggaagctgctgggatttgtggtttgagacccagcatcccctgtcctacacccctgtttggctcaaaggaagactggtttgcaggctagagtagaggaaggactttccttcactcagggaaggagtgcagaggataggctccttccttggaaaggtctggaccagaggaggctggggcagagcaatcacaccgattctgtggcagaggtcagaggtcatcctgccccttcccagcctcaggattttgtagaaagtaaggtccttttttccctatgtggtggtgaacacgtcccttaccctctaggtgtgagtttcttggacaagaagaaattccctcgggggaatggaccccatctctgaccctctagctgaaggaatggaccccatctctgaccttccaaggctgggctctgaggctgtgtagctgttgtgggcaccacagactgtctgtattggttattaatgcctgtctgagaacacggggttcggatcctaaaaatactctgtccagccagagcccaggagttgctggcgtgggccagtgtggcagtggctgcatcttggtcagatagagacagagaggaagaaacacacatccaacgccaggaaagactgggagagtgtgtgaatatggggaaactgaggcagcataggtgagagatgcacaagaaagagagcctttgttttatatggagcaaagatttataaaattactggtgccagttagtcaaattatggcaacatttagggtaatctgttatcctaaataactgcagagaatttccttctaagagagtctggagatacaactgatgtcagacataaaaaccaagtagtcagtaggatccatttcaagaccagcttcaggatgttccaaaataagagtgtggcaaaaaacacaaagtgttcccaactacccttttctgagccactgccctcctccttacctcttcagagcccctgctctcagccagagtcccaatgaggggcttaagactcccttttatagcctcccccaacttctaaatcccaggtctttgcgtagcccctctctccagaagggagctgcacagtggttccaaaaaggcagaggagcccagagtcagagggaagatgccatgtgacctcggcccatgagctgacccttgtgggcccctccgtgaaattgcgggatggggggctgggccctggcccaggcccggagagaaggcggttttggcacccatccaggcccctgacgtcaatgactttccaaataatggaatcaatattgggggctgggggcaagcgtgaaccaggccccaacgattagaaacagatcagcacaaccccgcagctgattctgatagagctgccttggcgagcttgggtgggaggcctggaaggaggtggacttgtgggggtggggttggggggtgctcaggaattggcaggcggagccacctggtgtccagagcttgagggtatacaagtgggcagagattcgggctgtctgggattggaatgatggggtgaggacccctgtcctggtgccttcctcctgtgagcctacagggttctgaggctaggtaaagtttgtggatggagacttagccagctagcgataaagagtgggcaaggggatttcatctctctgcatcccagatgtgggcccctaggccatattaggggtcacaggttatacccatgcagtggaaaagttctgagtgagacctaagtaagacgactttttgcttggaagcaaagggcattaatccaagatagggagatgggtatccctcctcaaattgggagtatggcctcctccaccagctcacattctctcagcctcctagaggacagcaggtgaggatggaggggaccatagggtttatggggggctggtctggcagcagctgacaaaaaacaggaagaagggctgggggagcggctgtaattatggggcatttattattaatcagatgaaattgctggaagcagctggtgtaatgtgcgtagctatacagactctgcatgctccccccacaatacgcacacacacatacgcacgccacacacagcctgagccttgcttgctttcacagtctgtttcttgtgaaggtcagatgggtctatatgtgtctgtctgcatactggagtgtatctgtcggtgttttttcatgtcagcctgtaccctcctctactcctattgtctccttttccagctatctctctcattctttggcctaatgtgtccctctctgtctctggcttcccctcagtcttcctccctttgagcctgtcttggtgtggctgtatctgtcactatcaaccaccctgtctctaacatcttattttagtttctggctatctctccctgggtggtggtgtctctgcatctctgggcaggattggaagacatggaatccctttctcatggtatgtgtttaggcacctaatcatatctttggcagatatatctgggacctgttttcaagggagcagttggaccctgaggatctcctggggtcttatagaaggtgaggggtcttttgaatggctagagtccatagaagcaacagtggctttcaagatatccctgagttcaaggccagctcctttaccaactaccagttgtatgactttggccaagctgcttctgctctctgagcctcagtttcaggatctgtaaaacagaaacaggattacctccaaagcttgtgttttttttttttttttgccatagggtttcacttggtcacccaggctggagagtgcagtggctcaatcttggctcagtgcaaccttcgcctcccacgctcaagtgaccctcccacctcagcctcaggagtagctggaaccacaggcacatgccaccacgcctggctaattttttgtatttttggtagagatggggtttcactatgttgcccaggctagtctggaactcctaagctcaggtgatccacctgcttcagcctcccaaagtgctgggattacaggtgtgagccaccatgcctggccttgaagcttgttttgatgattcagtaccaaaatgtaaattaagtacttatcacagtgtctgggtaaccaaggaccctgaacaagtgatacctgctgttattattcttgggaaagacattgtgcaggtgggtgagagacctgcacaggcaaattggtatagcagcaaggttatggaactagatacggactcaaatctagactctggaactgatcagctctgtggtattgggcaaggcctccttgaagctcaatctccttggttatcaaatgtgaagaacaataaaacctacctcatggagaaatcatgaagattaagtaagataatgcatataaagtgccaaacacagttcctggcatataatagatgctcaataaatcatagtggtgataaggaagggggtgttacgatggtggttatttacaccgtgcctgtgaccctgtgcctctaggattgtgcatgtgagaatgcatgtgatatggaggtgcctgtgtgtctgcaaactgattgtataagaattgtggattgtctgtgggtgtgtatctgtgtattgtatcaggccactgccttctggcaacctttgtccctgtggttcagaacctgaagtcagcaaggggtgctgggaggggtctgtattactctcaacttttcttcttccagacgtttagctgctgcctgcctcagtctccccttctcacagtggggctgtgagtatggaatggcctctgagttggactaaggcctgtggctcctctgtgacctctgatttgtgccctttgcccttctagactctagccttgtcacctcatcttgcccccttggttttggaagtcctgaagagttggtctggaggaggaggaggacattgatgtgcttggtgtgtggccagtggtgaagaggtaggtgctggggcccacgtggggcagatcaatctcagggaatcaggcaggtgtagtggggctgtacgtctaggggacatgagtggaggaggacctgagattccttcctctcttcccctgtcctttctttttccagaggttttgggctcagcctggctgaggcttttcatgctctcaaatagaaagggaagagacttatctgtggtcacacaggcaagggcaacaccaggttaggaaactgggttctatactaagggggtgctgagtcccagatatgggagtatgtttctgtttcagtatcctcagatttcctctctgccccccagacatctctcttatttgattggaggagcagctaggctttaaaaagatgggatggcaggtcagaaagtccagaatcttctgaggccagctgtggggccgagcctgactctccctgtctctcattcaggccaggcaaggcccctggattggcagcttgggggtgggggcatccaaggcatcgaggcactggagcggaacggaagggcctattgtccaaaacccgccagaggcccacaaaggccggccgggcttttcatctcagctcccaaacagactggccattttcccggctgggggctgaggggggactaacccttcacaactaggaccaggttgttgttgagggtggagtggggtaccccaggctgacacataaaaggggcttaagatggagctggggcccaggagaggaggaagggaggcctgagaaggctgtagagagttaagcttttcaccccactgttcccagaggacccaaggacatggggtgtgtatctgatagaagttcagactaggatggggctaggagatggatttacagaataaaagataatatttatggggggtaccttgggaggagtctgatggcttatttggaaagtgtgctactgggctgagagggcacgtaatcctccgcaaactgggaacaccttagggagccgggacaggagctggagaagagaaggatagtggtcggggaaagaatgggctccctgcagcaagaagaactgaggccagacagcaggaaggacttcctgccagtgaacagtagctcagatgccctgaccctcttcctggggatctcagaggattgcctcagcgagcaggggagctggagaacaccccaggggctcaggctgaggcagcttctgtgggggccaaggaggaggaggccagagagggaggacttggcagttctgttcaccctcccccagcagcacctccagcaccactttaaaaacagctttttaatttaacaaagtggatgaaaaacggtttttggaaataaagaatatctgctgtctcccaggctagcactcagcccttgcagagagcctctctctgggcttctccctgctgcccatggttcctttcctccctgtctctttttgtttgtttgtttctgctcctcagccccccagcttcctttggcctcccatcaccctctctctctccatcaccctctctctgtccatctcagcctccgtgggagcctcgccctcagtgtcttatctcaatggtatctctgcatttccttctgtctctcctctcccagtctctctcttctagggcccatctctctttcctgatttgtctctgtctcccagcctgtctcaatctctgtctctccacccccctccttctcccccaaccccagctctaaatgggtctatttaaaacgcccaacgctgccaagtcagaaaagcgtctcctgataaagcgcattaggcggagggagggaggagggggaggagggagcggcgggcggacggattgatccaagcccgtaaccccattaatcaggcagcgtggatccccctccctcccccgttccagccccttttgagctaaaagccccttaaatatttatcacccctcccccacaggggcgaagggaggagggtatggcccttggtgtgagtatccccagctgtctggtgcccccgaccccatgcggatgtgcatttgcacgtgtgcgtgtgcgtgtgctcatgtatatgtgtacgggtgtgcacacctgacaagcccagggtccagtgaccaacctgtccgtcaccctctgggcagcctggtccctccctggagaccctaggagtctggccctgctcctgtccctcctaaaggcggatctggggtcctcatcccaaatgcagaaagtaactggaggacgggtggcattgcactgtcattcccagagggcaggatggtgagcctggggttcagtttccagattcccccaaattcccagcactggaagtaacttggggaatagagttggggccccgtgctcctaaagtaaggcaacttggaaggctggctgaagttcctgctttatcctcacagggcagaataggacctggaataggacctgggggtaggctgggagcctcccgtgccctaaaaaatgtgggaaagtgagctgggccttgaggtgtggcggtcaccccgggaggaggaaggtagccgggagctggggccgggtcccacatctctcaccacttgctgatagccccaggcagcagaggtcagccctgagaccagcagtggtctgcccgagttggcctgcggcaacttctccttgggaggggaaaggaggccccggccacccctgggtgtggagaggggccgggaccggagcggggagggtcccttctgcctcccctcccccagcatcaagtgccacatctcctcctgactcagacaattagattcaaaggatgacctcactgcatgccgtccctcactctccctccgctagctcgcttgctcgcttgctcgttcgcttgcagcgcgctccttcctcccctcctcccggcccgcttgcccggtcgctcactcggggctcggccctcgtcgctcaccgcgcggcccggcccctcgcccacccgcccgccgggaccgctgtgggggttgcttctgcctcccgggtcgttccggctgcccgggccccagccccgcagacccgatgcccgcaggcgggcaggcggacccacggagcgccggaggcaccgacggggcgcctgcgtggggacccaggtcagtggccacagggccggaggacttgtcacccccgccgccgcgacgcccccgccccgcgctcgcccgcccgccagcccgcccagcccgcctcggcgcttcccgctcctttctcggcccccgccccccgcggctgctcggcgcgctccccctgccaagctgtctctcttcttttctcttctctgtctctccccccagcccccctgcctctgcagccggtgggagggactgggacttcctgaggtcccagggatggggccggggcccattggctgcaatcggaccaggcctctgagaggggagggggctctggctgtgtccattggcctgggggaggggaccaccgcctgagtggaaggggggctacagagagagaggcccagcgtgtgggggtgacatctagacagaggggatgagctcctgatatctttcttttctcacatcctgtgggcctcttgcctggtttcatttgatccccaaagcctggcttcatttgtccacacctcctagctaactttagtccccactgcctgatttcatttggctcccaccacctaccttctttggggccctgtcacctggtttccttacaccctgctgcctggtttcttttgtccccactgcccccttccccgaagtccctatcacctggctttatggcattacccctgcctggtttccttaggtcctgcctgtcttccgtggagtcacgtcaggctccttttaggatggaggcatcagggccccagctacacctggagtggcaagtggcaaggatgtctgcagcattgccgatctttcctgggctggggcctggccagcacagcctggattccattctgactggacagcgactccgcgtctactcctccagtgatgggggcggggctgcagggtccaaggacaccttaggactctcctcctcagtggttagttagaggagcaccgctggctctgcctgctcccctcctgctgctgggcatctgccctacctctctgtgggctgacagtgatgccagggctttggtgggggctggggggctggagtggaggtctcatctccttcccttctcctgccctttctgcagccaggccagacatctgggtgcccgctagacagttatgggcacatagaggttttgaagaggccttgggatcacacagcagatagctaggctgagagctgctgccgatccgcatcgtggggaagagagggtgatgagggaaggcagcaagggcctgggaagtcggctgatttctgggcctttctggctcttgctgattccagtgccaccatctgtctcccccaggtacttccttcacctctcctgtctggaatggatctcccttcattccctaatgctgttgaaagcagggtttggggaagaaggagctgcctggggaataatcatttattttctcactttttagggaccaacgaagtatttcctttccttttctttcctgccctaggcatccctaggctttctgtccctcccctcaggcacggctaggcaacctgaggtgctggcacagtgtggctgttcagggtgtgtatgtgggtgtttcccattgccggtgtcggggcgtgagaggccaagggcgactgggggccctgagcttctggaagtgtacaatggtgtctgtgtggaaggttgactgttcggagtgtgtgatggtatccatatgtgagaccatggctgtgtgagggagtctgtgtgtgtgagtgtgactgtaatgtgtgcacgcacaccagcgtgtacggggctgtgggagtgggtgtccatgtgggaggccctgatgtgtggccacgatggtaggctctgaatgccagtgtctgcgagaggctgcctgggtgtgtctgtgaagctctggccctgtgtgtctgaggaggcgggggctttgagagctctgccgggtgtagtgagagcccaagtgtgtgctctgtctcggggtgaagtgagcgctgggtgctctgtggcctgagtggctggtgtgtgtgtgagcacgtgtgtgcacgtactcacgcctgtgtttacccatcaggaacagattgctgtggcttccccactgtgaggaggggaggaaaggggaggaaggatggctcggtcttgcccagcagaccaggaggctcctcagaagtagcgtgcatggtgcatatgcacgttagggggcagagagaacagaacacagaagacatttgaagcttcttttccccccacccaactctggctctgtcagaacgaccatcttcaggttttttttgttataagccgatgcatcacatgcactgctgcccccaccccccggggtgtgtgtgtgtgtgggtgggtgggtgggtgggtgtgtgtgtgagcttgcttgcatgggcctctgtgtatggattcaagggtgtgtctgcaccatagcagtgatggggccaggggtgggtgtggtaggagatgctgaggcaaataggtctttgtcctaatctccaactctggaaagccattctatccatccttgtctccacggagggccctgccttgcagcctccttcctgtccccggcgtccgcttcgggcctttccttaccccacccccctgctaagggaagtctcagtcaaccctattgctctgcccatcccctgcctttcgttgagttcttccagctgtctaatgtgctacagcgttctgtccctacaagaggagcagtaccccgctccccacagacttagcctaactggtgtgtgtgcctttcctgggtggagggggcttcctgattcttctggaagccagaagagactggactggggttgggggctgggggatttggcaccagtacctcaggttctgtgaagctctccagagcctatgtgtccaaagggaggatacgaacttatctgccccttcctcctctccattcaagaggcagggggctggaccagatgacttttgagggtgaaagcccaggccttctgcatctagagggctacttaagcacaggcctgcatgtatgtgcatatacaagcccatgcccaggtcaccaggcagcatgcggggccccaagtgggcctccacatgtgggcacaggctggtgacagattcctctctccccaggatgcctccccagctgcccagccaggcccatcatgggagggccccaggctcccccaacaacacgcccgcacacacgtgcagcagggcacgcacatgctgatctcagggtccccacggtgcaagaggctgggaatgggggttttgagcactgagtccaggccgctgccaaaatccatcggaatcttgtcccctccaggaccccatctccggctgtggaggtcacaacagcaggtgcggataccaacccccccaactcactcaattgggccgcctccttttccacagcctcagccagcgtcgagagctgggggaccactccccctgcctccctcctggccccttcctactggtgcttggcttattctgcccccttctaaggaggaggacagggcctaagcttgggtagggtcatttcccctgaggactgaggcttgcccttggcgtgggtggggacatggtagcccaggaggaggtaaagcttgaatcctgaacccaggcacagcttggagccctatgccacttgaggtggggtcactgagagagctgagaggagaggcaggtctggattcagagaggagggaaaagagaaggggctagagatcagagattcggagacaggagggagaaacaccatagggagtgggaacctgcccgcccatggctagccggccccagcccacgagctggcccctgacctaggcccgcccttccctggtgaggggcctgccgggccagctgccaggggccaggcctccctcctcggcctggtccccccaccccccaagcctctggaccgctcaggcctctgcccccgcccccaccgcccacgctgtccaggctgcctaggcctggtgggatctgggggcctcccagcctcagcccctcctccctgtcctggagcttcccgcctgccctgactatctcttccaggctcccccctcagccagtactgttcctccctgcccaccatgtccttgtccctgtctttgcccccgctctgtctctcatttccttctccatctccaagtctatgtatctctgtttctctgctccaacctaattcctctgcaggtctgaggcttctagagtccccaggcgtttgaatcagtgagtccatgctgtgtcctgcattcttgcctcattcctgagatgggccctctaggctgctgtggggagaggtgaaggagatgaggctccaggataaaaggtgccttttcccctcactgtgggattctggagtctgggctgtgggagtcagagcggggactggaagctgtggggagtcccctccgctctgtgctgggccggatgcccttcatcagatggatgttctgaacccaccctgacgcctggcaatggggggagtccatccggtgaccttctttggatttcagttccctgcctcggagttggagtagtaaccttgcttcgaggtcacttgccttgaggcccccctgatccttcattgtccaggccagactgagcctacctgagcctcggcgtgcccacagcaacccaaaccctgaagtgcgcaacacactattacagatcaacccgcacacacaattacagctgagacgcagttagtggtgctcattatcccccaccctgacctgatggcggcagggcttccccagggttggccttctacaatctaaactgctgtaattctgcagggataaatagaggctttccaaaactcacacctccttcccccaggttctgccctcagctgggcatggggtgaggggaggggtacagggcaaccggaacattgctgggactggcaagacggttcttgggtcttgggtcctaagccagattcttaaactgggtaacaggggttcctgacctggagcctgtcgctgtgtctgtttgttaccgacggcggctgtcagacttcagggctgccagtattgctgtggactagtatcattctgtgagactgttactgagtctatcaacattgctgtgtcactgtgttgatgtcaccgtcagtgtgactcgatgtgactgagtctcattgcatctttgattctgaggttaccatcactgtgactgtgtcagtgtcaactggtatcattgccgcgtttgttggtgtcaatgtatgtgactgtcactcactgcattattgtcatcgtggtgactgtcaacatccctgtgtgtcattgtcaacggtacaactgtgtcattttcaatgggtgttgttatcattgtgtaatggtatctttatgccacagtgggacaatggcagtaagttggggccccagaatttgactcttaatgtgttacctgtgtgggagtaatgatgacactagggttctgtgctgggagaggtgcagggacccttgtgctgacaaggggctcaggggcttttgggcgctaggctccttccttgcttatggggtaccccctctgttccctcctcattctggggctgacctctttgaggggctgagaggaatcctgggctaatttgcagagcccttatctggggctctatgggatttatcctgcaaatctatctcagagccatggggtgtggacttggaaaattcccaggaaagatgctctttgccctgggatgggtggcctggagtgagccagggcaggatggaggtgtgtcctggatgcctctggcttcagcctcccaaactgggcattgggcccagttgggagtctgaggaaagggggaagtgaaactggcctggggctttctggatctgcaggggcagggcaggggcaggggcaggggcagagatggggttttacccttgtaccctaggggttggggtcctagatccccagcaagaatccttccagcctccaggaaggccctgttcttgcctcacattgcattgaccaccatcccatcctccattgtgctagaggagctgggcaggccacggagatgctctagggtgggcagagaccctgccaggggtctcctctcttctctctggatctgtctctccctctgcccttgagtctctgcccatctcctatatgccccatcttttcccctgcgtctcttctatttcttcctatctcagcctctccttgtccctctgggtctccactcagagctcctcctctctccctccctcttgtctctcctccctgagtctctcccttttctgggtgcccccaaccctgcagtgtctgtcttggcaccccatccccactctgcagcactcactctcagcagcacccgtctcccgtggctgcagccccgttggcccagggcccggcccttacagtaactcatcaggctgatggaggcgactttgatgaagaagccacccctccccccgcgggggcctgagtgtgtgtgtgtgtgtgtgtgtgtgtgtatgcgcacgcgtgcacgcatgcacgtgggagtgtgtgcttgtgtggaccaggaaggagctgggagtagaggccacccattcctcctctccctgaacactcccatccttggatctaacctcagccactccgcctgctcttctgcctgcccatgccctggttcctgctcccatgtggtgggcagtggcctggcactgaggcggaggatcttcctggctgtgaggagaaagacatggacagatggcagaggcagtgggggagggtgtgagggcgactggccagggctgaggttggggaaccaggtaggcctctggctgctggtctcgttttctctctcttacaccagctctgaattcaggcagtcctgggttcatttcctggctgcacggcttgctggctgtgtaactttggccattgtcttaacctcctaggcctgaggagtagctgaagagtggtgaggggctgagggtcagaaggagccaggccaagtggtagctaaggctccaggagtcactgatgcgcaaagggtagctggggccacttaggacacagagagatttactgtgccagggaggggcagtcagggcacctgtggctgtgacagggaggaaaggaaaagcaggctcagaggaggggactttcctggagagggtcaagggtagcaaaaggcaggcaggagccctctcccacaggaagccccaggaagtccattgctctccagcctctccgcagctgcttcaggctgatacccacatttgtctctgttatgctatgtctgcactgtctggagctgagtctctggcactttctcggggtgtatctggcactgcgtctctgtcagtttttctggctgtgtgtctggctgtttctctggcagtctttataacggtgtctctggcagtgtgtctgactgtgtgtctgacagtgtctctggcagtgtttggagtggtgtggatacttcctgactgagcatctggctgtggctctggctcttctctcaagctgtttttctgggtgtacgcctgtttgcgtctatcagtttctctggtatttctctgcttgtgtgtcagacggtttctctggcactgtttctgacagtgtcttagctctctggctttgtcgccgacggcttcactgcctgtgctccttgctcgtccttcggcagtgtatctgcctgggtctagctgagtcctttacagtgtttctgatgggtcctttgattgtgtcgctgttctctgaccacctctctggctggttatctggtttcatctacctgtctctttggctttgtctgatggtccttctaacagtctctggtgtatcttccactgtgtgtggagctgtttctttggggttctgtctggtggtttggggcagtgtccccggccagcatctttgctgtgtggctggctggaatctcggagagtggccctggttgagtgtctggtagcatccctcagtatttctctggatctttgcttctgtgtggttgatagttctctctcttcagactgaaggtcagggggtttgttacatttgcagcccattctgcaggaaataattatttccctgccatcaagtgtaggtgtgtgctgggggagggggagagaatagttggactcatctcaggaagcaggacaccaggttggggggcactggatccatcctggcttctggggccatgtcctgagtgcatcctgtgtacttgcatgggtgcatgtggacactgatgcacgcctactgggctgggggtcccaggctcctaggggcacatggctggggtcaagggtgggccggggttcctgacaaggacttacatattaaaatccttcattttctcttgatcattggtgtacaattacggaaaagccacatctgacctgggtcatgtcccactgccctgactcgactgctctgagcttctcagggcccagtggcaaggctcaccacaggggtgtcggggacagatgacggatctgaggggctcccgagcatccaggtttcaggctctctccccaggagcacagcagggggcctgccattcaaagcaatctggagaagtacagacctccaattgagttaaaacattaccctttcagtttatgatgtttatagctaattagctaacctcaccagtaaagttatttttttttttagaaaaatggccctggcattaccaatattctgtaactcatttgcagttgacaacattgtgtagccactagtcttatcgaacagcaaaccaccataggttgccttctaccatcttagcaaacctttgcctacagatgccaataatgttgctttctgttgcctgaaagaagatcttgagccccattaagaagggcattttggggtcaagatgctctcaccttaaaccaggcttcctaagctccctgcctgcatgattcccacctcctactccgtgtcagtcgggttgggtgaaagcagagcgggtgagggcctctccagggccctagggctgggatttcccagtcttgcctgagaacaggaggggctccccaggacagtcctgcctgggctgatgctgtcccctcccccaccccggtttctcccaacagatggctgctcctgtcccgtgggcctgctgtgctgtgcttgccgccgccgccgcagttgtctacgcccagagacacagtccacagggtgagtgctcacgggagccgcctgctgacccccctctcagagctgggcatgaaccctcactggcatagctgcatcctgacactacccaagagtcacacactggcattgtcacacatgaccacccagagggacatggagtcatgtgacactgatatgcacagtcctccacactcacactagggtggtcgaatgctgacggtgtctctggcttgagatgatctgtcttcttactagggtggcatagggtacaggcaggtgggatgggagttgacgggggaggctggggcgggacctgtatattgtatctgggtgaaaggggatctctcggagatttgtggggtgcagttggaggcaccgattggagacagtgggcaagactgcaggtcaccttctaccctcagcttcatcccagacggaggatggggacagagaaggtggactgagaatgagacgaagggacaggctaacatgcgggagagagccagtgcactaaggaagggacaggttaatcagctggaatggccacacgggggagggacagctcagggctcggccattggcagcctccctgccctccctttacctatttctccagtgaggggcaaggcctgcccacagcccacaggacaaggagcggtgttaacagaggccctcttaacttggccacctgcccctctactgcacttgaggcagcacctcaaacagcaacatcagcccgaggtctgaactcaaaactcaccttgaaccaggcttcctaagctccctgcctgcatgattcccacctcctactccgtgtcagtcgggttgggtgaaagcagagagggtgagggcctctccagggaccaggcatggagcagaccctggtggctgggctctgccaccctcaaggctgtgggtagtgagtcgaggcttatatggcctcttctttatgagatcatcagtgagacccggagagatcctggccagccccaggggcattgactgggcatccctagggcctgccagtggtctctaccttgtgtccccatggtcctggacataaggccacctctctgagagtgtgaaactgtgttcttgtgagggtgagagtgtgtccctgtttgagtgcatttctctgtgtggctgtatccttgtggactgttcctcacgtgtgacattgtctgtctatgtcaccttgcctgtctgcatgccctttgtggggctgtatccttgtgtttgagactgtaccccacatgtaattgtgtctctctgtttctctttgtgtgtttgtattaaactgtctccctgtgtccctgggcataactgctgtgcctttaggtgatggtgcccttcttgtacgtgtacatgtgatctcgtatcaggtgttaccatccctgaagtgagacagtgtccctgtgtgactgtgaacttgtgtgtgactgtggccttgtggatgactgtcctgcatgtccttcttctttaggggtgactgcccttgttcctttgtgtgtggcaaagtgaagttgctttgggatgcccggggggactgtttctgacatgtggtccccctgtgagcctgtgtgtgcaggtgtgagggagccgtcagctctgtccctctgtgttctccatgtccatgacctcatcccgtctctgtctctcatcctggcttctaacaaccttttcacagctgattcctttggagcatttgtcaccgcgtcagggccaagaaccccatcctccccctgctgcttgatttaatttctgaaatggacagcacatcagtaggggcacccacggggcgggagcagagctgtccagagacaaaagattaaatcactgccatctttggagcagttgcatggctgcgtgtattgccattgttgtgttattgtagcagttgtgacactgtgtgcttgtcatgtcctcttacccctccacctctccattgtggcctgtcgttgtcttctgccattgtgttgtcattttttcgttctgccctgcctttacatcatcggtctgtcattattgtcaggttgcgtttctactttttttgtgcagcagacaaggtgtggtggggaggtgttatcccatagccattgtatgtaatgtgttgttcggttgctgtgtcctcgtgtggtggccgtacctgctccccaggattaagggccacactgggtccacgttagcgttgagctgcctggtcagtgttgatgtgttgctgctgggaccatgatggccacgccccctccccaaaggtcagttttcagcctcctcctcaggcagctggatgcaaagtctctgctagggggtgcagagagaggggcttggcatgtttcctggaagctccaggtttttggaagggaggctggaggggggctcagtggctggagctggtggactgttgggggcgctcagtggccggagtcttggacactgggcctctggtcagggggaggcccctgtttagtgtctggtccagcctcacagctgtggcctccaaggcccccagccaccgcccttccgcccgttcatcgtctgttcggctggtcccaggctccacagatgagtggtcagggctggctgggtttcctgcttccttcttctctgacagggacagagaggggcaggatagagataggcagcgagggagagagacccggagtcacagagagaccctggcacagcgaggacgacagaggcagcaaaccgggacagatgttccagcgcagagcaaagcagggctgaggagggggctgcaatgggaggagggggtggccagtgggtccaagggggatccctacacccctgcagtcttggtggtgttaacaagcctaattaagaggccactggcccaacttaattggctcgttaacaggaattgcctctaaaaatcccccaactcagcagggtggctctctggaggggagatgtaagcgagtgttaacgagggatcccgcagccccccaccccaactgctgccctctcccccttcccttctcctctcccaccctcactccgcagatctggccaagacctgggaagtgtctgtctctcaggctcagcgggtaggatgagaagggggtgtcctgagattcccatctccctatctctgtgtgcctgcatcttaaatctgcctctctgccctgatcgcttcccccacttcgtgctgcctgtcgacaggtgctcgcctccacccttccatttccagtctcctgggctctgtccatcacgcctgggttgctgaaggcagggctggggtttgcttttggctctgacaggccgctcctgggggtaggagaggaatggtcagagtgctcactccatcccagcagcaccgcaccccccaagcccccaacctgccctaagtagttcctgccttgtgaacttgacagctgccaggagttccctagggttccctgctgcccattctcccttctcctgctgctgcctgagccctggatggctgaggggcgggttgttgtggggtggcaggctgggaaggcagaggaaagggagagagacaggaagagagatgggggaggtggggggtagagacaggacagaaagagacaaggatggggtggggaagagaaagagataaggagaccgaaaaaggagtccaggagtggggcccctcaatgccagcttgcctgggtaataatggacgtcagtaactgggctgggcctgtgggtggcaagagatccgggtcatgggggtcaggaaactttaaaaaacccagggactggagaggaactgggttttctctgagaactgacccctctcagcactatgcaaactctctgtcacatgcaaacacacacacacagaagatcgcccattcacatacctagcccctgtacatgctcactcacattcacatttggagacattcatatacccacacacttgcacaggcatagaggagctttgaacactcttcatctccccaaacactcacacagacaccgagcctctcgtcctcactcatccatcctcacaggctcttgtctgagcacgctcgcctgcgggtgctgggccgggctgtgacctgtgacttttgccctgtgcccccaccccccacagaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggctgtaagtgttgcccccacccctcatccagcctccctccttccttgagacccagactcctagcccagatcaagtccccttcctgttagggggacatggagaggggagagctgcagcctgacccttgccctctgattttgtcctggcccgctcttctggcctctgagcccagtcttacccactgagtccagacccctagacaatttgcccacacatcccacccccgtggaggtcttgggtatcctaaaaccctattccctctgacaacataggcagagagctggtaaggcatggctcacctgggacatgagtggggagagaccctcaggtcacggatctgagctggaggagcctcactgtgtctgctcccacaagggctagtcagagggcctcagggagggaagtgggatatgtggttatgcaggtacaggcaaggcgctccaggaggccccagggaaggaggaaggcatcctggagtgggaagcgaatggagacttgggaagcgaacggtgatttagaagacgcattgaaacatcatttctggcagagagctgggtgtgaccgtaggcctcagcggctgggagggcatgtaaaggccacttgggctggtgttgatgtggagagggagctgaaggaagggacggggggcagatcatgatcctgcaagctgggcagtgacatcttctgggtcatgttcttaaaagatcactctgagtggagggaggcaggttggatggagaaaaaccaaggtaggaaggagactgttactggatgcaggagagaggatgaggacctgggaccagggcatggagctggggaagctgagaaggcgcagttggacgtcgaagaattggtgatggattggaggtgggaaggacaggagagtagaaggtgggaggagtcaagacagctggaggaatccatgactgcaacaggaagaaaacggaaggaaaagataatgtgtgctgtttgaacagtgtcttagtttgggtttccctagaatcagatcccaagatgagaattcttatgcaagtagtttgtttggcaggtgaaggaaataccgtgaaggaatgggaaagtgacacacaaaaaggaagttaggttagtcagtaaagagtgagttatccagacattgcctcttggcgactgaggttaaccaccgaaggtgcagatgcagaacgtgcacctgagttgccctgcctgagggtgagggagctgggatgtgtatacactagctcctgcccatcagtggttgagagattcacctggggtgggagggaggctctttgattccccagcacttttgccctgatgtcccagcaggcaaagcaaaagaaagctcttaggcgaataactgcagaatttgggagtgagaagtattaatagtatgggcaagggatcggcggctccctagacatctgctgcagacctgttcagtgggatccttggaggacaaccgggagttgatggctggtaaccagtgggtctgagcgtctgggattcggggagaggcctctgctggagatggatatttgtggggggttgtcagcattaaggccatgggagggtgtgagatggccaagggagagatcatggagtgaagagagaagaggacccagaattgagccctaaagaccatcagcatttaaagaggtcgatggagggaaatgagccacaaaaagaaataagaaggagccagcaagaaggtagagggaagaccaggtgagtgtgatttggaagagggattttgagaagtcagaatgacaaggccatcaccattgctgagggtgaggtgggcaggcatccagatcccagctggaggtacccaccaacagagtgaatactctgaacatagttccatttcttcatttcttttctcctgagccaatgattcaagctcctctggcctcattttatttgggtatggttcaccccactgcccaaaagtcgtctccttattccgtagaagctacctagcagatgtttaagggatctgggagcagacacttgcctcgctgtcagaagactggtgtagaacactgtgtaaaatgttaggctgaagggttgttcagggtcttccacaaaaacgctgacccaccagtagggcttaaagaggtgtgaaaatgtattttggtgggaatgtacctttccccatgggaaggccttttttttggttattgtttaatgtgtctaaactgaagagatggcgttcaaaacccaacattttagttgcaagccatgggtggagtgacccctgttggccagcttgagaaatgcaggaccagcctaacagaattctccttggcgcactatggggtccatcagaagtggagcactcagcctagccccaggccctttcagagggaaaagggccatttactgagtgccatggaaaaaggatgaacccaacttggcaccggtcacccacatccctgtcttctcagtttgggcccagaagtcctcaggatggacaagactgactgtgatggctgggccttgatgaccctggacccccattcttgatgatgtgatcttctttgagaggtcgttggaggggaattgggtcttgaagtaatgtccatagtctatacccacgggacatgcccacagctgccctgttgtgaccagggcccagaccttttatatagagtgctcactgccctccaggccctgctgccagatgaaggctggccatgagttggctgtagcattagtttcaggtacttatctctcattgcattatttccttctaaagacctggtcagaggaacaggggatattaatcattatcgtctcagtcactttatattagtaacaagagactggctttggcaacactcagtatcaaattatccttcctgccagctctcagagaacaggacagagttacccctgatttgtgggtcattcaaaccaaaaattatttaatatttatcccaaacacatgcaatttgtctctatttacaagggaacttggtcttaacagtattctgttggaagtctccttaaccaggctaatccctgaactgctttctcctgatccaccttcttgctctcaagtggatcctcacgagcagagccctaaggactcctctcctccctaggatgacggaaggaccccccacattaggaagcaggatcacagtgttgcttttagtagcatctttttatttacaagacactgctgattctgtatcgttctgatcttaagctaaaacaaaccagagattaaaatgatttttaaatggacagttccttctccagttttttaaaacttttatttgattggttaggatggaagctctgggtcccctggttcagcactgctttccctgcagccctgtttggctggaaaggaaagagtgaggagagggctatggtcaaagaagacgtctggggagaaatcacaagtgggaggtcgccggggcatttgggagtccagaagttggaatgcctcaagggatgccacgagataaggctgagccaggcctgagccttgagtgccaggcaggaggcggcgtgtgggtggggcgtgggtagggctggagtggaagggtcaccctgccccaccctgcctgatctggcctggcctagggtgtgggcagcttgcccctcctcctgtctgggccggcgggcaggcctcatgcgtgccgggggctccagcccaggcaggctggcgagatgagaggaaaaacatgcggtttggtgggctggacatggaaaaacaagccaattaggaggaaaacaaacaaaccctgggccagtgggggcacacgcacacatacacacgcgcacacagccccgcgtgggacccagggacaccctgccacaggctgacagtcacttgggtgtctcaagagcccccacaaggggcaacccagatgccgtgtatgcccagagcctgatactgtgacctgtgtgcataagagcatttgctcacacactctctttaacatgcactcacacggtgttcagttcatacgtgtgaacatgctgtgaattctgggcaccctcccacatgcacagtttgcaaaatacattcagcctcactatgctccatcacatatgcactgcctcatgtatgagctctagctgtcactgtgttcagacacaatggcacacttacaggcactctaacagagtaccttggccacacagcctagcacatagagacagtctcgagattgaacagcctcaccctgagtcacgtgcaaacacagtcatccagtcccacacagcctcccatcctacagttacacaactgcccagagtctcacagccacacacatggagcctcacagttacacacagccttgcaatcacagcgtcttaaaaacagcttttcctccaactcacaacacactcacaacaggcatcctgatctcacactgtcctacaatctcacagcacccccacctccgcccacccggcccctcagctgggctccagctgcagcaagtcactccttttcttccttttgtttttctttcctccttttccctctgagaaacctggtccctgtcaggaaacccaagcccttccctgctcagggcccagggccaggcaggagtagccagatgacagacaaagcctccagtcagccccccaacccccaccccaccatgacctccccagtcagggagaggaactggcgtgagggggaggttggaaggggacgcggtctgaggggggaggacagtcggggagtgggggagcctggtcagtggggaggctggccaggggtgggggcctgtgagtacagtgccgtggcccgctctgccctccgaggagtccggggcagcagggagcggactctgcacactccgatccccaccccacccccagcggtggcaggagcggggagtggaggcttctcggccgacctcggaatgtcctttcctcctggggtggctgccaactctggcttggccaacaggcccccagaaggcacttcctgtgtccttggccgccccccaccccacccccaggcagagttctgcacccgtgggcagacagggaagagacactaaaggcacacaggatgaacatggaacgacatgagatggacgcagggcccggaaggcttcccaagggaggcacacagtggaaggcagaatgcaggttggccctgtggggtctcagctggaccccgctttccctgacaggcctggggaatggagctgcctccgcccacagcattgcaccctccacctggtgccctggagttctgatgcctctctgccccctcatctcttctgctgcaaagctagatctggatcctgggggttctgccccaggcccctcccagcatcacacatactggacacgcacacgcaatcacacagagtcactcacagtcacgtgcacactgtggatggaagcccactgttcccctgtgtcaccatggccactctacaagcatagacatgcactccccttcactgtccctggcttattgcgctgcccccctcccatttcctgtccacctgtcaggccgggggcgggggaggggggaggcacaggagggaggtgtcagtgtccctggagccgcagatggacattccttgctcgggtcagatcacataagctgcctccttccaggaacctgagccgcctgtcctcacgccttacccaatgcctgagggtgggacagctgggctaagtgctcacggcagcaaaaaagagtgcgggctagacagcagaaaggacttcccaagtgtgtgtgtatagggttacccctgtcctggggtttagctctggcttactgtctgaccttgagaggtccttatccctctctgggccttcctattccagagtgagggcagctgcttaccatgtaaagggcttcttaaagggtctgcgatggagatgctgggggctggcactaaggtgaggtacacacaaagggaacagcagcttcctttcaacaggcacttgtacacacacacaatcatacatagacatgcagattcacacacatccgcatagctgctcctacggatccctggtcactcattcatgtcacatagagacatgcatgtagcacgtatacccctgcatgcagacatctacaaacacagatacgcatacaaacagctgcccagtgctgttcctgtgtagccaccaggcctgtcctcgtgtctctgtctctactgagggaagtctggggtgtctcttctctaggaagtgcacccgatactccagcagtcggaggacccattcaagactcccctcgtctctgcagcacagtcttcctctgggagtggacacaaagtggcaggagatgtggggctggggccgattcccccagacatcacctccatcctgtgattgatgagttgaggcccgcagccccctgctccccacggttcctgcctccattgagcaggtggagggggggttccgtgtccgcacagcccttgtttttctttaattaaacatctggctcttgtggcctgggaagcctcagaccctcgctgacagcctccccgccacaactttggcatcaatgatgggttgaggggggagagctggggctctggggcccacctgtccccatacagtgcaggggactgggagctccaagaatgccctgaccatactgtcctcacccccagtgccgccgcgggagcctgtgctcagctgccgctccaacacttaccccaagggcttctactgcagctggcatctgcccacccccacctacattcccaacaccttcaatgtgactgtgctgtgagtagctgcgcctgtgacccgggtccagccctgacctctgacctctcccccatcccaccaccatgccctctgtccataccccagccctgccttgggcttgacctttcctcaacctctgccccacctgacccttgatgttcgtaacagtgcctgggtctcacctctccccaggcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattggtacgtgtggcggttggggggacctgctgcctactccagtgggaatgtaagtggatgtgtgccattggtggggatgtccacatgcatgcacatgtatacatggcatgtacatgcctctgcacaggtatgtacagtgcacatatatgtgcacatatatgcatgacatatacacctgtgaacgtgtaagtgaatgtcctttacctgaagggccgagagacctgtccagcagctctttcgatcatttttctggctcccagaacatgcagcagggggaagggggggcaggctgggccagacccttgtgcagctgcagcctccaccgcacccccccccaactctaatggcttccttacggactgtgatgaatgaggtgtcagaacaggagacaggactgggacagatactgccctccccctgaccccccccatcccagccagaccctctacctgcccctgccctattccaggcaggctctctgcctgctattcccccgccccagccagaccttctgcctgcccctgtcttctccccagaccccatggctggatccctagacagagtatttctacataagctgggcccttaggcgctctcatcagatccccagcctacctccagatctgcaacacctgtggactgtcttttacccttgacccaggtcttagtttggaactggaaaagttgaagtgaaaaaccaggcttgggggaatgtgtgatgctggtgtaggagggggtagtccaggtgacagtgggggtgacagtggtaactatggaggcatcatattgtcttagttactgggatgcaggtcagtatgaggatagggttgggatgatgggatgatgagatgaaatttggaatgttgatattaagagttggtgacagtgactgtagtgacagtcattagtgatgatggggatatcagacttggaactaatgagatagttgtctatggtagttatcagaattgacaacagagaagaggcacgctgactatgatgttgatgacaatggttggcaatatgagagggtcaacatggtggctggagttgacaaagtgggttgttgccagtgattagtgtagtaatgaagctatgtctcctgaacagtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtgagtgccctgcccggccaagatcctgggtgcctgagttagaatcatgtgcagtgagtggcacccatatcccacgtggcagcagctccagtgtgagacctgatgcatcaggctctctgcggggaaaagggacaggtgggcctgggagaatggatggagctgaggcaggtgtccttaggggttcccagtgacccctgttagtgcagcgggaacacatatgtctttctgtggctccctggggtcgtggagagaaatgcagggagggagatggtgagggagggagatggcgggggaggtagatggtgggggagggagatggcgggggagggagatggcaggggagggagatggcgggggagggagatggcgggcaggacaggcaaggctccctttccttacctcgctctcagccctgaccaggcatctccctctttacactctggcccaggctctgggcttgtgctggccccaagggacaggaacgtgcctgtcctcaagggctcacagatgggcccaaggggtcaggatcaggcagtggggtcaagcctggtccagcatgtgagtttaggccctgactggcatcaggactccaaagtcagacccagcttaggggtcagcttgaggctgtgagtcggaaggtagcctggctgggaaccaagcagtggacaagggtcagtatggggtcagactatggtctggatcaagctacaatagagagctctggggaacagccagaggtctggggcagacttcgggttctcttgctttgagggccctgggcccatagggtcgtgggcactctgtgtgacccatgaggcctgtgggctaggagtggggttgagagggtgctccatgggacaacccaggctggttcctgggggtcaacttgtacccccacctcatctaccaggctctaactccagctcctcatgcccctatccagtccggcctttaaagtgtgtaattcgattcctgggtgcctgtcccccacaaagcctgctcatgcactcacatgttccctgacagagtccggagtccctcccgcctggccagctgcccgcgcctaatgcattgctaataaccagggtctagtttcacaagcccccctcccccgctaacgagctacaggcagcagccccgcgcgtcgcggcgcacacgccttgcagtggacctggcacaccgcccaccacacacacgggaacatgcacacgcacgcggctcccagcgggaaccgtacaccatacgtgtgtgcagctaacatgccgagaccatgcgcaaaactgacccccacactgaggtgggagaagcaaagtgtgcaggctccgtggcgagaacatgcgtggcctgtagtgcatcctagccccattctgtgactcactggcactggggttggttagatttatggttcttttcagctgaagttttgctgtgaacagagtctattctccccagtccttgaccttggggagaggcaggtgtatgactgggagggggcgagaagggcagaacaaagaaaaacatcatttggattttcaggaggaaaatacagatcaggaattgcaaaagaatgggccctgggcaggggctgtctcagcatggacaagagggaggcaagtactgggacccagcatgggttccctgcagctcctgcgatggcctggagggcgtgtctggcatctgctccagcagaccacggaggactcccaggggaggccaatgtcagtgactagggagttcctgccaattgagaagcctttctcttgagaggcaggatgaagggatcactgataacctagcaagaaggatcctggtctaggatatgtggccccgaggagagcactgacctcctgggggccacattcctggaggtatggtgcccaccataagcccacaatgaggcggcaatttgatctgttccccgtggctccctccctgtggggagagactgacgtggagatctgcggtctaatcctggcaggagggagacagagccgaaggagccgtggctactcagccagagggtatctttgccgagcagaaagggactggggtgccagaggtggaactgggaccctggctccaggagaagagggtctttgggaccctccgatcttccagggctgagattaggatttactgagcccagggtctgggcccaaaaggtgtctcaccatgaccctgacctttaccaccgtatcagggccacaggctgaggaggaactggaggggcttcctgccccgcttggacccaccgcacatgcccagacacatacacacacgtgtggatgcactcacagcctgtcaggtcagataggccagaccccagttttctcgggggaaggttggaacagggaccaaaaaagccctgaagccagacgtggcccagagcggccccctcctccgcccctgccggctgcccctgtttacgaggcggcttaatgaggcagcgggtgccactgagatgaaccagagcccagcctgggcctggaaggggcgccggacaggcaggctggcctggagggttgggggagaccagcaggatggggccagcggggcgagagtggggtggcgatgcctccaggagggaatggagcagctgtcctgcgccctgcagctccaggggctgtcccccacccctttccgccccagcagggtgataaccacactgaggccttcctaaggggaggctcagctggggccaggctggtaggtgccttgggcatctgggaacccaggctctgaccagaagccatggtaatgacagtgctagctgaagtgtgtttgatgctgtcctcatgccttggtcctcattgtaaccctaagaggtggatactctcatgaatgccgttttacagatgaggatggcaaggcatgaggatgttaagtaacttggtcacctcactactaagggatggggccaaatttggaactcaggtagcctagctccagtcagtgtgtcaacctcccctctctgtagcttcctggtgggagaggaggacagcattaccatctcctctcaccccctgcccttgccacctccaggctgggactgtggtcgggattcagccgggctaggggctgtgagagagcaggggcaacagcagagttgtaggcacagggcaaagacctccttattctcccctgaggtgtttctggtctccttaaagatgtcattactctccttcagggacaactcccctcctgtggagtctcctccctaagatgtccccagtctctggcaagaatattctccatgtcctccttctcctcagggaagtcctcactgcccccagagccctttactctcctctcctcagaggcatgctcacttcctctggagggacctcaccctcctggcccccaggtgtgtccttacccccaccccatggtctggctgcaggtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcgggtgagcttgctcccgcccctacctcctggctttgctgtcctggaggcctgtggtagaacctgtggcctggttctaccctgctgcctccagcctctgctcccgggggtagccacacttctgcctgtctgtccaactcctgccattcctggtccttgctatctggacatccttggtaggggtcattgggtggaggggttatctgtgagccttgggaaacaggatctgcctgatgggggaggcagtaccagtctgatgcaggaagcagaatggtatgtctcatgagcccccagatctggatgggacccagccctggccttgccctgagtttcccccatgttccccagagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctggtaggttgagtgaggctgggtggcagagggagcctgagggaacccccactccagccccctccctgacaggcccctgcctgtctctacagagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgagtccttggaacagacccactttgggagggtacccctcttccaaggaccccaccccatccagggctggcggaggaaagaaattgtggttggggaaggtggggagaggtgttcagctttcaggccagtgtagctggtaacagtgttgtctacttcttggggggtagggctttcctggagcacagagttgctgccagggaaaaactgtgggaaataagggatcccacgggggtatccagtcagtcctggaggctgccgaagtcctggctggggcagaagcctttcaagggtcacctctagaactgccttccatgagtgctcaggcctgagcccagtgcacagggctagggatgatggcagaaggggaggggcaggcttcatccttggggccagggggtgtgcgtgatccctgccatccaagagatagtccaggggtgctagaaggtcaggcctagggctcagccaggccacaagggctcagagcacagagtgtcctgggcctaggcaggcaggggggctgcctgaaggaggaggctgcttggagtgtgaccagggacgggacctgggcttcaggactggaatgacagagtacaaggcttactcccagggctgggttatagtcaggactcagtgtggagctggagagggtggggctttggctttacaggatggtcagtctttggtccagcctcagatactgcccacacccttccagtccccaaactggggctccgggatccctctgacttctcctcagaggaggacacttggctgtcccaggcctgcttaggtccagaccccacttatagaagccgccttactgagcataagcaggcatttctcagctgggaatgcccagggctggggccaggtaggcaggccatgtgacctgggggcgggggtgaaaggggagttcggagctccaacctggggagccaggttttggcctttctctgggttcctggagtaagaagaggtgggtggagtcaaagtcaggtccacacccacacccacctgtgcacagatgtgtcctcctgatacactccccgtggcaggcactgagcactacaccgctacagagccaccagccaccctgatgccatcacacactttctcccagttcaaacccttcacctccaactaggctccggaaatggataccccttgctgcgatcgccaggcctccttgggatcgtgccctgggagggggattggcagtgcctcaagcaccgatgagtctggcctggacaagacacagtcccagaggtggggcctggtgaggggcttcacagtaaaatggccatctcttctccaggttagaagagagaggagtattctaggtgggagacccctgaaagcaaaggcctggcgtcaaggtgaagcctgtggcttttcaagctgaacagccccagctatggaagcacagggctcttcattcacaggaagaggctcccaggatggatatcctgagaggtggctgtggacctgctctgtaccctgaaccctgagttctgcctgggggtctggtccctgtgaggtgtggctcagcc

SEQ ID NO: 17448 - DNA, 58014 bp, Human
ttgcccagtctggagtgcagtggcatgatcgcggctcactgcaacctccacttcctaggttcaagtgattctcatagctcagcctcccgagtagttgggattacaggtgtgcaccaccaagcccagctaatttttgtattttaggtagagacgggattttgccatgttgaccaggctggtctccaactcctggcctcaagcaatccgcctacctcggcctcccgaagtgttgggattacaggcatgagctgccatgcccagccaatgaaacatttgttaaactccacttttgctatggctgtctgataagttaagcaaaagcatctcaggtttttcatctctgctttgtaccttgcaggaaacaaggtgaggcacaagtgctggggatgagatttcaagcccgagcccgagggccacctgtgctgccagacacaagctgcagagcataaccagctacgcagtttgcaggccaagggcaaaataaaaacacggggccccttgttcgagagttaagaatttcaagatggcaacagcagagaattaaaccaagtgcagggcccttttgatgtgaggcccacactggtgctgagtggggaaaggcacacctgaggcccatggagccctactgctcctgcaacatgcaggacaaagacaactctattgtcagtgacctgactccaggggaatggcaagaagtgaagaacatcccaggaagaaagaggagctgcagactgacatagctaactgaaggatgagaattgcaatagctaacaaaattgagaatctaggacacagagaagaatggtaagacatgcagaataacaaacaggtggccatgggtagacaaaaattaatgcaggtactagaaaaagattcagttcttaacagagaaaggtctgttcaacagacccttgttgaacacttgtgaagacactgcccagtttttgtagaaaggtgaagaactcagcaaaacagccgttgcctgggggaagaggtgagtttaatatccaggttcttcgttgcttttgtggaggtacatgagttcatggatttaaattttgtctaaccattacagcaattcctgtggccgtgagaggcacaaaagcctgacacgatgatggaggcatttgcccagggatattgtcagtgcagtaaagaataattttagttcagacgctcatgctgtctcccctttgccatcattttgttgaacagcagccataaccccagtgtcaaaaataagccccccgcaaaggctattgccattaatagaggcgccagtgatggaggagtcctgctagacaagcaactccggagtctgcagtttcctaattcaatattaacaacaatgctgtcctcttactggcttctccctcattttattttgcgtgaaactgtggataacgtaaatgcccaagcgctttctattcagtcctcaaatgcaaagcagacccttgctaataatggtaataatccgaatgggtttaactgcagcattgtaagaaaaggcaggcagtactcttagactacaggggtggatctcatcatttgattttcccgactccgccaggaaataagaggggccttggcttggggagaggtgtgtggggaggcgtaaggggtgggccccccggaaatcctgctgcgctgtttaaacctaaggtgacctaacggatggcgggagcggccgcgcgagccttggagcagggcgcggccattggtgacgcacgccggggagcacggcgcccacgtttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgatttttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatattgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaggagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacagcttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgtccatgtgttctcattgttcagctcccacttatgagtgagaacatgtggtgtttggttttctgttcctgtgttagtttgcttagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgagatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctgtgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggcttttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcaaaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaatttttgtatttttttttggagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccacagctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactacttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcagttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcacattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatcctttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagatatcctttgttgtataagagaacaagttcagtgggcttcttttgtttccttccttcagtgtctcacaactcaaattaatgttaccacagactagaggcaaatgtgttacctagactgccttgaacagacaatttagtaacagtacccttttatgtggccatcaacaaagaaataatcagctgggcacagtggctcatgcctgtaatcctagcactttgggaggccgaggcgggtggatcacctgaggtcaggagttcaagaccagcctgatcgacatggcgaaaccctacctctactaaaattacaaaaattagccaggcatggtggcgggcacctgtaatcccagctactcgggaggctgagacaggagaattgcttgaaccctaggtggcagaggttgcagtaagccaagattgcgcaacttcactccagcctgggtgacagtaagactctgtctcaaaaacaaacaaataatctacctagttgaggattaaagagcaaaggactttgatactgtgtctgctgcctagcagtttccaaaatggcttctctaaagccatctcatgaggagaaaagaagattaagttccttttgagtgtccttagtgtgaaaataaagtcactgcctcattcatcattttgttaaatttgtgatacccaagttagtattataaaacctttgtttgtcttaatcctttctttaaagtattactatttcagaattctttgatatacccaaattctccttaacctgttgcggacattgaccaaatggtgattgatgggtgtaagaaatacatgcgaaaaacgtgtggcgatgtcttagacaatcttaaaggagactgctatcaggtaattgttttctggataatgtagttttaagtgaactaataatataagttattgatcagaattgtgccttattaaaacagcttttagtatagttggttgagaagataaatacatcatctgtctcttcatatgagttatatgtatatttgtatttagggtgcacacgtaccaatgatgggaaagcaccaactccagattctctgaattaaataaaattaattcttttttttttttattatactttcagttctacggtacatgtgcagaatgtacaggtttgttacataggtatacacgtgccatggtggtttgctgcacctatgaacccatcatctaggttttaagccctgcatgcgttaggtatttctcctaatgctatccttcccctagccccctacccccgatcggccccggtgtgtgatgttcccctccctgtgtccatgtgttctcattgttcagcttacacttaggagtgagaacatgcggtgtttggttttctgttcttgtgttagtttgctgagaatgatggtttccagcttcatccatgtccctgcagaggacatgaactcattcttttttatggctgcatagtattccatggcatatatgtgccacattttctttatccagcctatccttaatgggcatttgggttggttccaagtctttgctattgtgaatagtgccgcaataaatatacgtgtgcatgtgtctttatagtagaatgacttataatcctttgtatgtatacccagtaatgtgatcgctgggtcaaatggtatttctagtcctagatccttgaggaatcgctacgctgtcttctacaatggttgaactaatttacactcccaccaacagtataaaagtgttcctatttctcctcatcctctccagcatctgttgcttcctgactttttaatgatggccattctaactccagcttgggctgcagagcgagaatgtctcaaaaaaaaaaaaaaatcttaataaaaaaaaaaaccttaataataataataaaaaagaaaccttagtagtaaaaatcaagtagtacacaaagctaaagattgcttttacatatgtacaaaatttccaagtaaaataataagctaaatctggcaaattaagtctatattatgctcaagtaggatttagttagaagtgtaaagatttcaattttaagaaatctgtcaacttaattcgttaggtgaataatttaaaggaggaaaataacagatgacaaagaatttgagaatatttagcagtcattttaaataaaaactaatgcagtatagccatgtaaaattagccaggtgtggcggcgtgtgcctgtaattccagctacatggaaggctgaggcaggagaatcgcttgaacccggaaggtggaggttgcagtgagctgagattgcaccactgcactccagcctgggcaacagagggagactgtttccaaaaaaaaaaaaaaatatatatatatatatatatatatttccatctaacaaatctgtacatgtacttcctgaatctaaaataaaagttaaattataaattacttgaataaaataaaattgcaatagagatgaaactacctgaacgttaatagaaacttaggttgtggtaaatagaaaaatagaaaatataatagatagcaaaagccatttccactgaaaataggaagaagatgaggatgcctattatctttttcaacattattttttgaggtagctgagatagtaaagtagatgaaaacagtataaatctaattatttgtagatgatgtgaatactagaaaatccaggaaacttacgtaggaaattatttgaattaatgagaatttgataaagtgattggataaagccagcctagattttttctctatactaaatgctaactcatttaaataggatttccttcccacccatttcctttcaaagtaatcaagtgttaaattcctaggaatatatttaacaagaatggtattgtgagactggtatgaattatgttaagatgttattgaaagacatcaaagtctgaatatgtggagaggcatgctgtatttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcagtgtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaatatggtctaagatacatttcagttgacttgggaaaagcgttagttgagttagtgtgtgatgccggtataagaagttatccatctgcatgagaaccaagttagctaacaatagaaataggaattttggtgacttaggctctaaatgtaaaaactaatacatttaagacaatttagagtacttaaccttggagttcagaaatctcttaaagataggacactcaaactgttaatggtattataatgttgtcattaccaagccaaaagtcagactagaagaaagactagtaacaagcatgacagggaattgatcccttgaataatgcagagtccctacaacttagaaatgaagttagctaaatttaaaaaggtatagaggatatttactggtacttctcagaataagtcaaataacctgtaaaaagtaccacaagacaggccgggcgcggtggctcacacctgtaatcccagcactttgggaggctgaggtgggcggatcacgaggtcaggagatcgagaccatcctggctaacatagtgaaaccccgtctccactaaaaaaatacaaaaaaaaattagctgggcgtggtggcgggcacctgtagtctcagctactcgggaggctgaggcaggagaatggcgtgaacccgggaggcagagcttgcagtgagcccagatcgcatcactgcactccagcctgggcgacagagcaagacttgtctcaaaaaaaaaaaaaaaaaaaagtaccacaagacggtcaaccctgttggtggcccaggaagttcttgtgaaaacattagcaacagacttcacaaaatttagtagaggggcaatatctcatgctggggaggttgtggggagacaggtgctcatatgcattgctggttggcgtgtgaattgctatcaaaaccggaacacacggcttctagccggtgtttgagcacacagcccacagttaaaaaggtgtcactacaaggttttattatagctgtgcttgtagtgaccaaggcttggcaatgacaacagaaagaatgtttttagtggaatggtgtattttttaaaatgtgtgttattacctggagagatgttgggtgaaatgttcaagttccaaatgatgtgtgggattcaaattttacaaaagagaacatacatttgtgtttgtgtgcaagtattcgtaagaatctgtgtgaacgtatggaaaaaatatgagcatatcaaacaggattaatacatggattgaaagcaacggtggtgttagtacctcctatatttttccatagttggacttgtatgatgcattgaggcaagttataaaacaataggacagaaaagtcccagtttcttaaaattataactgtgaggctataagaagaatgatgagaaataacatgggataggttatcttagggaattgtggtgaactttttttaattttttttgagtcaaggtcttgctctgtcactcaggctggagcacagtggtgcgcgatgatcatggctcactacagcctcaaactcccgggctcaagcgatcctcccacctcaacttcctgagtagccgggactacaggcagataccactaggcccagctgatttttcttttttttctagagacgggctttcaccatgtcgcccaggctgctctagtactcctgggctccattgttccgcccacctcaacttcccaaagtactgggattacaggtgttgggccactgaccccagcctggcaaactcttaaactcttggtttctgactattatatttaatttttcttttacttaatgtatttttttttttgaattagaaaactaaaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagcatatatggtaagcacttaatttttgctgttaacagacatagatgaaagttttttggttcctgtagcagttgctgtggatagctgtggatataagcccatacttggcgcttttttcctccttcctttactattgttttttgtttaactacatccacatgttggctcactcatctattcctgttctttctggaaggttctaatagaagactgtatcccggtactgaagaggtacgccaaagaagggagagaatttgattatgtgattaatgatttgacagctgttccaatctccacgtctccagaagaaggtagatttttttaaccaagatatttatgatggaaatgtttctcttggcaccatgtgagggtgaaaggatcctagagattgtgtagttctctcacgtttttgaaaaagggagttaaattgaggtccatggtggaaagatgactggatttggcttcaattcctgttctgccactcaatgagtgaactaattcagtcatttgaaacaaaaatgaagtaaaatgactcattacattaatgagacagtaaatcatttgacaatttatttaaattatgtgattttcaacctgtattggtacaaactggtcacttatctaagcaacaacatagataattccctttctcaaaccagatgtttgttccaaatcacagctagttcgtgtttttttctataaactcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccacatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtctttcgctgtagtatgagctgctgccaccagatggagacacagactgattttcttttttcccctcccctcatcaacatacacttgatgacaaagctctggctgtactgtgaactcctgccaccagatggaagcagattgtggtgtttttctcattctctaggggattctaaacttaaactttaaagattacattaattggggttaaaaatatacatatatatctcctattgaaatccttaacaaaattttgaaaatgacagcaaagacagctaattgataatccagtctcttggtacaaaattccttgatgcataaacataagataagcacttatgtagcattgcactctggatctctgaattattctgagtttacaggaaaatcccctccgccattttttaaaaaaagtactgccagcctggacaacatagtaagactccatttctacaaaaagtttaaaaaattagctgggtatggtggtgcatgcctgtagtcctaactctggaggctgaggtgggaggattgtttgagcctgggaggttgaagctgtagtgagctgtgatcgtgccactgccctccagcctgggtgacagagtgagaccttgactcaaaaataaacacagtattagtatactgtatttaaaagtcaggaagaggccaggtgtggtggcttacgcctgtaatcctagcactttgggaggccgaggcagttggattatctgaggtcaggagttcgagaccagcctggccaacatggtgaaatcccgtctctactaaaaatacaaaaattagccaggcatggtggcagcagcctgtaatcccagctactcaggaggctgaggcaggaaattgcttgaacctgggaggcagaggttgcagtgagccgagattgcaccactgtactccagcctgggccatagagcaagactacatctcaaaaaaaaaaaaaaaaaaaaaaaaaaaagtcaggaacaggtagaggttttcactttaaccttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggttttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagccatgatgggtactttttaagcagagcatatggaaattttttcttttcatttttttgaggtaagttcttggtctgtagcttaggctggagtgcagtggcacagtggcactcattgcagcctcaacctcccagactgaagtgatcatcctgctttgccctcccaaagtgctgggatttcaggcatccattgccatgcctggctaatttttgtagagatgaggtctcactatgttgcccaggttggccttaaactcctagattcgagtaatcctcctccatcagcctcctgaagtgttgagattactgccatgagtgaccgtgcccaggcagaattttttcttttaggtttctgcaaatacataaaaggaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaaagcaagtgatttgactcaggatgtgttgatgtagttgccacagtgcagttttttttttaactgccaggtgacacgcttaggaggtaacccagattcttggcatgcccacccgctttgcccaagtgtgcagcttagaactggagtcaggttggctgggtgcggtggctcacgcctgtaatcccagcactttgggaggccgaggcaggaggatcacgagatcaggagataaagatcatcctggctaacgtggtgaaaccccgtctctactaaaaatacaaaaaattagccgggcgcggtggcagacgcctgtagtcccagctactcgggaggctgaggcaggagaatggcgtgaacccaggaggcggagcttgcagtgagccgagatcacgccactgcagtccagcctgggcaagagggagactctgtctcaaaaaaaaaaaaaaaaaaaaaaaaaaaaaaggagtcaggttaagggtgggatgaaaatgttgtgttttacaaaagctaaatgttcccacccaaaactgctagctgtgagttcgtgatgtcattggttttactgtggctgcctgaaggcagccttgtcagcatcccaggaagctggggaatgcatcgtggagggacgtgggaatcaaagtgggccaatagaatttgaattggggaggaagtgttttcatggaacctaggaggcggatcctgggacttgaccttcctctcttgtctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggtaaaaaaagaaacagcttgctgaaacactgaaactccctccacttaagagagaaaatcattggctaaaatctgttaaaaccaatatggccaattagaatttgcatagaacaagcttgctgatgtcacagcctaagtttccaccacttgcttcatgctaaccacttccccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtggcccaggctagagtacagtggcttgatcactgctcactgcaacctttgcctcccgggttcaagcacctctcctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttaggccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgcttaattctttgctattagatttttattctgcatctcccatttgtttctcttaaaaagaaaaaatgtcattccatttaaatagacaggaaagtgaaatgtatcatgttacttttttggggtaggtgtctatttgtggtgtgtgttttcttctttgaaacttcttgacaatgttgggaaagaacaaattgaaactttcctattttcttaccacagtctgtgtaaggaagtcttcccatataacctctataaagagagagtgtggtgtcaattttaagatggcaaagccatttactgtgcaccttggtggcattttcattctatagcttccccagtggtgatgtgttctaaaaacaactgggcagttttctatttgtgaatcttaaattacacgtgtggtgtttatatgctcttacggtgaacttgatgttgaaaccaaattacatgctggcgaagggcactttggccatggccatatcccactgcaggaccctagatgatgggttactaaacaggctgacactgaaggatgacgtcacgttgagtgaatgtgctaagttaaaaccaccaaggccagctctcagaatagttctaacctcttgcccgtgactagctggctggttggttttgaaagccattctcaggagttcttacatcacaggctgcctttatttgtaaataattttcatcttgcattatacttggctattttgaggcaaattaatagtaactttttttttttctgaattggagtttcgctcttgttgccccggctggagtgcagtggcgccatctcggctcactgcaacctccacctcctgggttcaagcggttcttctgcctcagcctcccgagtagctggggttacaggcgcatgccaccacgcctggctaacttttgtattttttagtagagacagggtttcaccatgttggccaggccggtctcaaactcatgacctcaggtgatccacctgcctcagcctcccaaagttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaagtaaaacacagaaagaaaaaaggaaatgagcattatcattggaaatttgtgccgcaacacagctgtgggctgtagtctgcagatgacggcttccttatctgctgttgccaagtccaggttcctgtgacggcagggtttttttgctgtcaagggagcaactgctgctgacctccagtgaggcctggtcccatcaggctggggcagagcccgacggggcaaactgcctgctgagaccagatggccagcaagaggcaatgagaaccctctagatcctccatgtgaggaggggagtactccgcctgctgggtggccgtgtccctccacagcctgtacagagcttcagcatctcctaccaactgtccacctttgtttagggttcccctcagcatttttgtcaggcctgtgtttgcatgttgggagatttgagaaatcagttgataacatttgaggcaaagtcttccacctgctagttcttctctctccctccttccttccctctcctttcctcctctgaccttttttccctctcctcctccttccctctcctcctcctgccctctcttccctcccccttctctcccttgtatctcccgctaccctaactttccctccctccctcctttcccccttccttcctttccttctcatactaattccctaaaacttgtgagactttggaagcagtagtgttacctgagagaatatttgtgttcctttagccttctgttgtctactcagtacctccttcagacctcccaggtggtgaggatgtccccaggctgcagagtggccttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaaaaaaaattttttttttgagacagcgtcttggtctgtcacccaggctggagcgtagtggcctgacattttttttcttaaatgagtgaatgtctactttttctttttctttctttcttttttttttttttttttttttttttgagacagtcttgctctgtcgcccaggctggagcatagtggtacaatctctgctcactgcaacctctgcctcccaggttcaagcaattctcctgcctcaggctcccgggtggctgggattacaggcgccggccaccatacccagctaatttttgtattttttagtagagacggggttttgccatattggccaagctggtcttgaactcctgacctcaggcgattggcccacgtcagcctcccaaagtgctaggattacaggtgtgagccaccacacccggccgcctactttttctttgtattagattgtcatggaagaagatgaagaagaaaggagttagtcatgttgtaattagatagacttaacttaaatttttcttgtgcacataggttaaaaatagcattagtagacattctccccatcccctccaactctactatagtgctttgcaaagctctgtgtactgtgtaagatataaaatgatggtactgttactgtagaacactgtttgggagtcaatagaattggatttttttctgctttataaaagaaaccaggtatatgtacctgctgtctggatatcgtgtttttaataactgggcatgactttgtacttgaagactagcttgaggctggggcagcagatccactgataaatctgttgacacaagtcctgcaaagacctgagaggtggaaatgagtggatcaggttgtgccaggccatgggagatagattcaggagacagtaagggatgtggaataggaaagaaaggaatggaaatatctgtcttttcatttagggtgataatagtgaattttgacccaactcacttctttgtgttggagaaaggatgatgtatgttttgaacatctttgttactgttttaaaacaaaagcatgcaaactgaactctgaaaactgaaaatcccctctgcttttgctgacttttaaagaaatgttataagatctagcattgttgttttactttaatggctgtagtgttatatagtattacagtctcctttataacttaaactggaatatactgtagtatcctatagctgctttttaattagagacaagacaaatatgactgtttaaaattccatttaacacatcagcagatgtcaa

SEQ ID NO: 17449 - DNA, 26050 bp, Human
cactgtgaaaagtccctgtgtgaaatgtcagcaacaagtccaggacttttcctgcaaagggcatgtgcttttggaattggtttgctctcccagatcagcagagtaaatcttaatagcatttcagattttagggcacagggaaagattctctgtgactcaccaaagcagcatgtttgtattccgtgggcaatgacattctttgaatgagcacttaaaaaacaggtattttttttccaactgttaaacaaaataagtaaaataaaagcatctgtaatgtacctcacagatagttataacgatcgctaatgtgtacagtaatcaccccttctccttgaggaatatgttcaaagaccctcagtggatgtcagaaacgaaggacagtactggatcctacacacactatacgcaacagtaggtcagatcaccgaggcagctattaagtgactaaggggtgggtagtgcatacaatgtggaaatgctggccaaagggatgattcatatcccatgtgaagtgggatggcttgagatttcatcacgctattcagaacagtgttcaatttaccactgatgaattgtttatctatgaaatttcccatgtaatttttgcagaccatgattaaccactggtaactgaagcctcaaaagggaaattctggatagcaggggtggtactgtagaccctatgtatagaaataattaagcttatattccacctatggttttccatgcagcttttacatttaaatttacgttttatatacttgaataaaatgaattaaaattagaaaaaacaaagtttagccacaaaaagtttattattgtaatatattttgaaaaatggtttatcaatactgattttagccttttatactgtatattatgatcaaataattttcaaatggaaaaaagtaatccttttataagctgttggtaaaataagaatcttagtagctgattcatgccagagtaattacctctttctggccttttctctgctcctttctttctctccctcccaatttctttctctcactctgtctcccctttgacattctctcctacattaagaatcaccactttgtttttactgttctcattcaaaatttttattttagtatatagaagtctacctgatgaagagaaaatgttgatatatgtgctttttaaagcatattaaagagtattggttatggaatttgtagacccattaaggatacctattcagatacagataaaattccagttgccccagttacatattaaaaacttttttttacaaaaaagaaacacactttcttcctaatataacagtttttttttcttcattagacgcgttttcaaacattggtccatgagggaaaagtaataatataggaaattcttagtcatgttaatattttccatttagctattactgacagatgctattctaagcgacttacaggcacaatatcttttattcctcatatgaagaacaagcattatataaagaaaatattaatacatgcattttcagaaactacagcccaagggctctcagaccataaattcagagcaaggatttccacccagagctgtctgcattaaaatgcacacttgttcccactctatgatgctgaaaggttaggagccttggctgtccctactgcccaggtgctacaagtccttcatggggctgttctacgcaacactttggaatgcagactcccttgagcgagcacttgtttagcatagtttcaccagtggcctgtctgtctaaagtagtcggcgaatattaaaatagtcctaacaataaaataacactcagtcaaccgtgtagccttcttccgagtggggaggagaatagctcactctccctagagggcctaagaaagatcagtttacaggttccagcatggggtgggacccttcctccttcccccgtcttggcactggcacttggtctggtgaccaccactagcccacagttgggtcagaaaacgttacagaactcctctctcccccacccgaaacacactcagcccttgcactgacctgccttctgattggaggctggttgcttcggataatgacctccaggaccccactgttggttacagcctgtttgtattattcttactgcaactcaagacacctgcagcagggcgtgagaaaaagtaaaagaccagtattttcacattgccaggtaccagaaacacagaagactgacacccgccacttaagtggggccagggctggtgtctgcccatgttgccatcctgatgggctgcttgccacaatgagggatcttcttcaatacatcgcttgcttctttgcctttttctctgctgggtttttgattgtggccacctggactgactgttggatggtgaatgctgatgactctctggaggtaagaagatagcagcttcttttcatgatccaggccagcccaaattttcgctaagtcccaactgccatgtacaacattcagtatctttactaaggctaatgataccaaaaataggcaacatggactatttattgagtctttacattattagctcatttaatcctcatagttaatttatgaggtaggtcttgttatcccattaaacagatgaagttactaaatagttcctccttttttcacaaggataaatttccacaagggtaattaagtgatctctgctactgagacctccagaaattcacgtcttccattgctgcatatatcatattgagtaacatttcagtaccacccttttttctaagataaattttttactcttgatgacagcattaagaatagtgtgatagactttttttaaggagtgttaataatctaaaacgttgagaaagaaaatgcaaggcatgcaaaacctacccaattaacatgcaagaggaaaaaacattatcttaatgatttccaagtaaaagaaaaaatgttgagggagaaaatgtctttccagtgcatcccaatgtacgggggacaggcatggatttaaatcctcccttaaaatgagttgctctagggaactgactactattcaaaagatgagtgagtgggttcacatttgaggattttatttttctcgctggagaagctcagaaagaagtaattttgaagttcaaaaccattacctgtggccataggaatctgagagaggcagaactgagtaaaaaatcaaatcttcagaattagctgctgttcattaatgaggcttaggaaaacacaggtaagaaaaagaaacaatatttcaagagctcaaaaaaaggagtatatagcaaaacaatttgctttttaatgtgcatcctgaagggaacaatttaccctagcaaatgctataatgtcacctctataaagtttaagaaagatactcgactgagtttatatatttttcttctaattttctttattaaactctcaaattggagttccaaatggaaagtaataatgattctattttgctgtgcattatttttgctgctcgctttttcttgcttttaatttgcctctgacttgaacatggcatttcaaaaccaatggagttaggaatacctctttaatgctagaaaattacatttccaaaaattgtgatagaattgaactactgtaaaggatgtctgctataagtgagcccagtgatgcattttatctggccatgaatatatgcaaagaatgaaataaatgccctttgaacagtgctcagggaaaagtgcagataaaacgttctgctgtcattagtttgccattatctagatggccagtggtaggtgatgaatacagaaatatgtttaacttgagcataattataattatgttttttaaaatacaaaaaaatgtaaaatcccatctaggggcattgttaaaatattttctaaaacaatttaaaagtctttctgcttaagctgacataattgctaacttcatttgataagaaatagttttagaaagggtcaaaccttgctgagagagagattgagagtcctggaatttaaagtgtcttctttcattttagtataaccaaccaatttgccatctgtcccatgaaagaatacttctagttaaaacgaatggaatgagcagtccaggttacacacctcaagtaaacccttgctaaccttgaaaaatagttaatatttcttagcttccttcttatttcccatacttaaaatgtattgctataatattcccaagaagccttcacatttaaaggaagaggctgggcatggtggcttatgcctgtaatcccaatactttggaaggccgaggcgggcagatcacaggtcaagagattgagaccatcctggccgacatagtgaaaccccatctctaacaaaaatacaaaaattagctgggtgtggtggcaggggcctgtagtcccagctactaaggaggctgaggcaggagaatcgcttgaactagggaggaggaggttgcactgagccgagattgtgccactgcactccagcctggcgacagagcgagactccatcttaaaaaagaagaagaagaagaagaaccctgtaacaaatccggctcccttctctttcaacaatctctttagttgtcaatatttttaaagagacaataatctcttataataattgctacttcaacaggccaggatagaaacttatattttccacaaatttgaaggttctgatgctagctcaattgctcttctcttttcttgccgccatcctcatttatatatcacctttggtccatataacaactcactttatgtttttatttttatttttttatagatttggtctcacgctgtcacccaggatagagtgtactggtgtgatcatatctcactgcagattcaaacttctaggctcaagtcatcctcccacctcagcctccctagtagctaggcctacaggtgcatgtccccacaactggctaattttaaaaattttttgtaagaacaaggactttctctgttctctaggctggtctccaactccaggcctcaagtgatcctcttgcctcggcctcctaaagtactgggattataggagtgaaccaccacagcagctcactttaatccattgttggacaaaagtcaacgaaacaagtgttttgttttgttttgattttttaagaaaaaaaaggaataccaatagacaatttaaataagaaggagtattatacttttccagtttttttttttttttttagtatatttggatgatgttggcacgggatttagaagaagagttttgtggttcaattcagtataaaaatatatacaattatatcatataaaaggaatgatgctactcctactagaagagacaaagataaagcaaaaattgctcctgcctctcaggagtgcacatttaatgaggggaaaacaaagatacacatgaaactataataaaaagcataaataaattcatattttgagcaagaaataaacgaagtatcattggggaagaaaatatgcgatgattacttcctatcagggccatcgaagcaggtctcatgaaagaaaaggcatttgagcaaagccttgaaacgatgtaaagcatttcaaattgtagaaatggcagcaggggcctttcagataaggggacagagtggcaaaagtgcaaagagaggagaagctcagggcttgttagaggactaaagtgggcaacacaaagaaggaggcagaaaaagctcagatattctttttgcctaccacactctacctatctcaaatgaagttcttcgtattaggtaaaaatgctaggaaagaaaatagcacacagaattacgatgtgcacaaccctacatcagtgactagaggccctcagctaccatcctgctcttgtcattattgattcatttgtgtctctgagaagactgatagggagaagagaatttgggttttgagatttttcaagcatatgtttgcatcttaacccttattaactgccttctattaagcaagtcacatttcttgtctttggctcagttttttcaattgtatagttgaactcagttgtttctaaggtccttttcagtctttttttttttttttttaacatcatgtctccatgactgtctgaaacttcagagagttggacactcactaatggactggtggtgtctggcacttctccagacatttccattgggaatctagtggaaggatcctccatttttctgtagcttcatacactctcccttccttcattccaacttctctttttccttcatttccttgttccttccttcctcttctttattccccctctctcttttcctcccttttcttaactctctctctttccctcctatatccttctttttctttctttctctttcttcttcatctctttaccccttcatttctctctcttttctttctaccttttgtcatttcacaaataatctctgacaacttctgtatacttggcaccatggtgggtacatggttatgaagtaggatgagacctggagcctccctaggctactgccagtgtagtgagtgggacaaataggtgaaccgacagttatagcaccatgtagcacacactatgataatgaaaaccctaagcgagtggctcacttggtcttggataaccagtgaaagctacccaaaagaagagatatctaaactaggacttgaagaacaggtgagtgaagcaggagaagtagagagtattccaagctcaggaaatggcaggaactgaggtcaaggtacaagagcgttgtatgtttgcggtattttgtatatttcatcatagtaagaatttccagtttagagaaaagaatacaggggttgggtcattaagagttttgcataacatgtaaaatatagatcttataccataggcaagggtttgtcgctgtaagcaatatgtacatgtattttagaaagattaatcattctggctatctgtggggagagattggaagggtaaaatgaggtatggggagaacaactaggagacttttgttatagaccagaagggagacaatagtggtctgtacttcagtgacagcaagcatgaagaaatatgaaataagggaggctctaaaaatgtcaaattgatgagagttataattgactgcatgtggggaagtaggtgatgaagagacacagtcaaagatgaaatctgcctttctgatctggggcaattggaggggtggtgatgttactcaccaagagtttaaatgaatgaaaattagtatctatacagaaaccttcatggagcaatgtccctgaaccatcctactatttttttctgcttagcttattatacaatacttagaggtaggaacacaattctttacaatggagatgtttatagatttaactttatatcagagggacctgaggttaaatcccaccttaccaggcagtggctgtatgaatttagacagactcttaaatagctataaaccacatttcctattcagtaatgagagaataacaatacacacatcataagtttcttgtgagaattaaatgagcttgtgtatctaaagcatttgccacagcagcaggcagatatgaatcagccaataaatattagatacattattgtctatttgcagtttattggtttgtttttgttctggagaaggagatgacattttgcataatgttcgctgaacagagaaatataaggtttaaattctattcctatttttggtattgcttctcttggagaaattttgtttcctcctctaaagctgtcatttgcctttttttttttttttttttttaaatcagaatctctctctgtcgcccaagctggagtgcagtggcatgatcttggctcactgcagcctccacctcctgagttcaagcgattctcctgcctcagcctcctgagtagccgggactacaggcaagcaccaccacacccggctaatttttttgtattttttgtagagacggggtttcaccatattggccaggctcgtcttgaactcctgacctcaggtgatccgcccacctcatcctcccaaagtgctgggattacaggtgtgaaccagcatggctggccacccatttttatatttacatctatttcctttttgtctgaccagggaaataagacagataataagtcaaatagtgaaggttatttatcaaatgctcacatttacaaagaaaataaattgagataatagcattgttaatatgttaactacaagatatgcaattcttaattatttacactgaaatagtttcttcacacagtagttactgatctctcaattataaaaaggaaaaagtgttttcacaagaagatttcattttcagttcatctttgttaattatttattgagaacctgctatgtactgagcactagtatgattaaaattttattacctcaaaacaaagttgctcacattagtatttattttatctgtataatcaggttctcttctgggatttctatttgcattaatattacaattcttttaaatataaagtaaatattaaaattattatatccagcatgcccgttgattatatccatttttaaactttccaattgatttcaaactctttcagcagatgtttgaggctacaaatgttctcttatttatctcatgatttcctaagtacctagcactgatgtacattaatgtgaactcatgatgcatttgctcacatgagttgatagagcgcctagtaacacacttagcatacctgttgaaagaatgaatatattaatgatatgaggtgattattgaaaatctcacattgaaccttaaataagaagtatgtctgtaatgaaatgatcatttttttaaagcaagatttcgtatcttgctacaatttaaatattttcaggatatgtatttggttcatttttaaaaataaaattggaatacaaatctgattcttgggatatctaataaggttgatgaagagtatattctggactagagaatgtggctttttgcttagtgctttaaagagagaaataaagaaaacagagagaaaaaagaaattgataatttgtaataatttactcaacataaattgtgatctttatcactgggcaataatcattacaaagttgtaatgccatacttttaaaaggaagacattttaacgtatgtaaccatttaaaaatgttaaaatgaaaatatttagaaagttcagatatataacgtaggtcatatacctgtgaagagcacaaaattttatttttctactaagttggcattacccatttcttatgatttatacctttagccagtgctccacaaataaccagaactaaaacaaataaattttagcaaataaagtcatgtttttctttcgtatcttataaatgtaagatataaagtaaaaagaaaaggcaacattgattatgattattttagtcttgctccctcatctttattaaggcctgtattgactccatttaggccctgggatagtaaaaaatataatataaaatgtaaaggtaaaatgttcagagtcttggttggaaaatttaaatgcattttatgttaaaattgaaaatgtttccaattttagtagtcaaacgttatttactacaatattattaaaacttttgcgtcttaataaatataagtaagtactaagtaggtatctaagtaggaaagtcacatcttcaaggttaaaatatattagcacatggatagtaaagtggtgtgaaaattataaattcttacaatttgtatatgcaaggtggttttttaaaataatatatcttaatagcttattttcttttagttgtctgtacatttataatcttaatgcatattgacaaaaaataatcttgatagcggttaaccaacaataaacatttacaaaatctgctgtgtatatttactctctctctctctctgtagatagatacatagatagatagatagatagacacacacacagacataatttcctatgttactagagaagagataaatgccgaacattgttgaatgtctctaattctcaagtattttttagtgtttctaattctcaaaagatacataaaaagacaaggcaggcaaaattgttgctgcttatatttcaagattgataacaaaagagaaactgggaaaaactaggttagagaagtcttaatgggagactgctatagagtccagaataagaaatcccaggattaaggaactaatttatgtcactgtaactcaagttggaagagtcatcatctctatggtttcctaacacttttaagtgacatcctactcatttttagtactgtggtaaacactttccagagccagttgagtaaacaaggtccagaatgacaccaaatcaatgtaagctcttcagtctaaatcataattttttggcttctggatttagctgtttttgtttatttagtcaagtagaaattgcacttattaagtagcaactgtgcatataataaccattttctgctccaaacttccaatgagagtatatgaattgattgacaaattgagattttcttatcctcactaaacatttattaagcacctattatgtatcaagagtaagagactgtatgctccttgaagccagctgccatgtttgtctttattatcgctgtatctccagcattaatatagtcggcatgttgactagtaaatgacaggcatttaataaatatagtttgaagaataacagatgacctataattgcacatacaaaagataatgcaatattttaaatgctataataatatggacaaattcctgtgggatttcaggatagaaagtgataaatgccagctagagagacttgggtggtgggaggctaatgaaaaaacagaagtctttaaaatggggcttgaataataagtagaagtttgacaggttgagagcaaggagttattctcattagtataattagtatataccaggaagagaaaactcaaatgccttaaggaaccaagtagccagcgttcacgagagaggcaggttgggtaggatctgtggggaacctggtgagcctgagctccacctaaatgggagcagccactcctttcttgccagttgttgctttgtgagactggtgagttcaggtacccagaatgaccaagtttctaagggaaccctgaaatctgaactgttctgtaaaatctctacacatttttggcaactaattaagagattttttgctttcctcatgcttgtgacttctactttattattgtaccttaaataaacctacctctctccatttagcaggtaatccactcttcacttttgggaacaatagatattcattgaaacaatacaaattagcattgttttaacgttatttatcaatatataagttgcatgttagaaggagaaattttaaatttataatcctctatttcagacaactctgtcagattaaaagttattacttaacatttgcattttttaccctttaagaaaggttaactatgatatttgaaacatcagtctgcttttttaagaaccctgtcttaaaattttcaagaatttagatttgcttgctttttagtttctaataagccattttacaacagaggaataagtaaatgaagatgataaatcataccagagagcattcctaaatataataaaaaacatgaaaaattgtaaccttgtcttttgtgcacaaaggcacctttaagggtgtctccagtgagtgctacattaacacagaagtttagttaattacagccactattctcacgtaccttaactgagtgtgaataccaagccatctaatagtgtgcccctgagcattaatacctaatgaaattggattccttgttttctctaatgagctcattgcttttctaaatatggtcattgcaggtaaatgatcaatagccttgaaactgataccactactgaattattttggcaagatggaaatactcttatttgtgtaaaataagaatttttgaatatgcatttcagatcactttctaaataatgtcatgtatgacaggaatgaccatagtaggctagtttgtttcagtggctggcttatacagtaagaaattgtggagagtcgctgtctgatttacagcacagtgccttcaaacttgtatcacctagcttgagctaaagtgaactggatgcagcgtgttcctgttcattaagacactacagggcagtcagctttgagaagatctgttttctgttatgatatagcagttctgtacaaactgtctctaatatactaatttcctatagttgccgtaacaaatgaccataaactcggtggcttaacaaaagataactttattctctcacagttctggaggctggaagcttataatcaagaagttggcaaggctgcgctgcccctgaaagttctggaagaatccgttcttagcctcttccagcttctggtggctgtaggcattccttgacttgtagctttatccctccaatgtctctgcctcagaggtcacattgcatctttcttttgtctgtttctctcctgcatgtgtctcttataatgaaatttgtcagcccacctgtataacccaatatgatctcaaggtcctcagttacattttcaaagatcctttttccaaataaggtcatatactggtggtaagaatgtggacatatctttctgagggcctccatctttctccaccttcactgtggttagttagtaaagcctaacacagccactactcaagtcattatgatgtttaagcactttactaccactatttttatttattgagcatatcatttatattgcgtgtgtatttgtaatttttaattcttataaccatcctatgattatctcccgtatacagataaggagattgaggatcaaaaaaggtaagatcttccccaaggttacaacatagatagtaagagtttcaatctatatttaatatttaatgcatatataaatttaatttacgtgtaatgcacatataaatttagacgtccacattatttagaaatttatatgttgaatttcacaagatagctgtttatcattagattttttgatctctgtgttacacaggatgagataatcctccagaaagtccaagaattgtttccaacttaaacctaaggaggagcatgccaaggtgaagttcgcagaataatagccttgggatgagatccaagttagggcttacttcacccaaagctatcatccaatacccaattctggattactttattttaaaatggatttggaattctttttaaaaaaatgtttttaggctgggcacggtgcctcacgcctgtaatcccagcactttgggaggccgaggtgggcggatcacctgaggtcaggagttcgagatcagcctgaccaacatggggaaaccccgtctctactaaaaatacttaaaaaaaaaaagtagcctggcgtggtggcgcatgcctgtaatcccatctactcgggaggctgaggcaggagaatcgcttgaacccagaaggtggaggttgccgtgagccgatcgcgccattgcactccagcctggggaaaacagcgagactctgcctcaaaaaaaattgtttttaaacatttgtaactgtttaaacaattttttagcacatatgcatcttcttaaatggggtacctagtgatgttttgatacatataatgtatagtgatcccattagggtaattagcatacccatcatctcaaacatttattttttgttggaaacattaaatatccttttttctagctatttgaaattatatcattattaacaatagccatcctagagtgctatagaacaggggtccacaacccccaggccacagaccagtactagtccgtggcctgttagtaactgggctgtgcagtgggaggtgagcagtgagcaagtgagcattaccgcctaatggtggacagaagctccaccttctgtcggatcagcggcagtattcgattctcataggagtgcaaaccctgttgtgaactgcacatgcgagggttctgagttgcatgctccttacaagcacctaatgcctgatgatctgagctggaacagtttcatccaaaagcatccccaaccccctacccactggttccatggaaaaattgtcttgcacgaaaccggtccctggtgccaaaaaggttgaagaccactggtatagaacactggaacttattcctcttatctagctgcaattttgtatctcttaacaaatctctccttgttccttggcccctacccttcccagccttcagtatcctctgtcttattttttacctcgaggtttttttttctgtttgtttgtttagacggaatctcgctctgtcgccaggctgcagtgcagtggcgcgatctcggctcactgcaacatccgactcagtggttcaagcgatgctcctgcctcccgagtggctgggattacaggcacgcaccaccacgcctagctaatttttgtatttttagtagagacggggtttcaccatgttagccaggatgatcccgatctcctgacctcttgatccgtccgcctcagcctcccaaagtgctgggattacaggcgtgagccaccgtgcccgaccgagatcaacttcttatagcttccacatatgagtaaaaatatgcaatgtttaactttctattcctggcttatttcatttaacattattcagttccatccatgctgacttaaataaaagaatttcattttttaaattgttaaatagtattccattgtgtagatataccatattgtatttacccattgctctgtggttggatatctaggttgattccatgtcttggctattgtgaatagtgtcacaaagagcatggaggtgcgcacatactgatttcctttcctttgaataaatgcccagtagtgagatttgttggatcataaagaatgggttttaaacacactgcaatgctcaggagcacacccacacactgctgtgtttgagtcctatctcctccattaactatgctttcttggggttacttaactttcctgtgccccaatttcctcatttgtaaaatggatgataaataatatctcttaacgtcccttaagaaataagaaaaataataatatgctaaatagtaactgctttatggtatagactctgtattgaataattattaccaactataagtattttacatataaagtagtaatagaggtaaaacattcagaatcgcgatgaagttgcaagcagtagaattttatttggcacataacacggcctcaaaaaatagcatggggcagagagtttcatagtgcatgtattcctgaatattattttattttccaaagcaaagtgttcttatgtttttttttctccccacagcaatttaaccccctcctttgcattcctcatcccaccctgctctgttatttattctttcttggggaaaaaattaagtttttattttccaagataattcatagttaaactttactaaactattcccagatacagaaggtaatttgaatccataactgggtcagaggaaacaattgtattagctctgttccatatgcgtgagctctatcaagaacacctgaaactattttctgttggcatgtttacgattctaagaaatctattgtgacttacggtttgtagataaagtatgagaaggttcagggaactggtaccttctagctctaagtggattcttagagtcatctgcacatcatttccaagtaaaaatggattacagtcgtcaagttgtatgaaattaatgctcaatctgcttacatcctttacatagcttaagcatttataatatatcattggagcaataaataagacttggggcctttatatattttatttattggcatcttttcatttattggttttctttgctaattattttatatttataaacttcatatataaagataatatttttcttcatggaactcagtattcgtgataaagaaacaatatatatttttaatagactcaaggtgtcaacagttatcatctattgttatatatatatatattttttggtgagtaaatgtcagcacagtgacatgaaatgatgtttttccataaccataactcaatggtggaagcagccacagatatttaaatatatttagctctggttttatctcttccagacgtgacttatttctctacccccacccttcatgaggaagtggattcatttcctggcccagaaaggcttcaattgtcagtgcttaagggaaaatattctaatacgcattgtttgttgtaaatgaagttctgatcacatgtgtaaccacttactttgctatcaaacacaaccaccaacttctctttttgatcaaggggaactgaactgtgcctgcatgaattgtttcacacggtgtcttctctaacatctaggtgagcacaaaatgccgaggcctctggtgggaatgcgtcacaaatgcttttgatgggattcgcacctgtgatgagtacgattccatacttgcggagcatccctgtacgtatgccttagagctcactgcttgccaggaagggaaagggacagaaaactgagttcaggtttccattttgtgctttgttttctattgtactatattaaggttcggtccagtttgtaatggttagaaattgagctcatctcggaaatgtgaattgaaatatatacttcagcacattttctcttttctcatatatttgtaaattcattgagggaaaaatattatcttattaatctctgctgtccctcagagggccaggcatagtgcttcatactcagcaggcttacagtaaatggttttttaatcgaaataaactctttagggtgctgtaatttcattattaaactggacgggttagggggaaagcatttcagagatgttttaagctatgacttagttcaaatagaaagtttacagttatttcagttgaaggttagctaagaaagagagagtggcagaggcagaaagaggcagacagccagagagagagacatagactatggggatcagtggaagaaaaaaccaacacatgtgacgcactgttacaggcaatattgaagctggctcccttatcttccttacttttagctttaaattatagttaaagccaggtgcagtggctcacacttgtaatcctagcactttgggaggccaaggcgggtggatcactggaggtcaggagttcgaaaccagcctggccaacatggtgaaaccccatccctaataaaattaccaaaaaaagttagctcatcatggtggtgggagcctgtagttccagctagtcaggagactgaggcaggagaatcacttgaacccagaaggcagaggttacagtgagccgagatcacaccactgcactccagcctgggagacagagcaagacttcatctcaaaaataaaataataaataaataaattatagttacatgtcagcagagcccatgttgctatgaataaagaaatgtcttaaatttaaaaatcttactgttgattctctcaatccttctccatagtgtttatttgtttatttataagaacatcgaaccctgctaagaaacatctgttctgttatgaaagcaaagtggttttagtctctttcaaagcaaatgatgggtgatggcaccataaggcaacttcttttctcaagataaataaaaaattaagcccttggaatgtgacttttcccctgaacctctatttcagtccagaggaaagcacttaaaaacagcagcactctaaaattcttcatctgctatttaaaagttgggtgcgtggaacatttttaaaaacatagttcataaggtctttgttttatttttgttaaaaaggattttcttaattctttttcttttcccctctctgtgctaacctagttctacctacaaagaaacactatttgctgaataggaatggacattttgtctattctaaaaattcattaaaatggattttaattcataagctgataagaaaatgaaaaattaaaaaaaatttaaaacttttaaatactgttatatacatttatgcaagaagaaaatataatcactcataagctcactacgtagagaaaaccactgtttatatttaatatgttcctttttcatctttgacctatgtaacctattaacatatgggggtagagaaataagtcacgtctggaagagataaaacccatatggcctaatatgtaatattggccaagaagagtcatgatttaaatagctgaaagagaaaatgatctaatttccagaaattaccttctacttaatagcacaaactaactctccttcttctaaagatctccttatggcttcttctatcctgaactggcaaaaagaagtcttgaaatattttattctgcttccctgtgtcaaattttagccaattattatttttaaataaaaaaaaattaaagtgattatttattcaatatttattaagaaatttttgtaggacagatatgctaccttcgattcagcaatcggctacaatatttgtgaatgagacattttccagagtaggaggcaaaaaggaaaacatttatttagtttccactatctaccaggatgctctctgctagcataccaacaacaaaactaagtagtgaactgtggttaaacaagcaataatgtcaataatctcatattttttagttttatgaaaacattaggggtacttatgttcaagttcatacaaagtctgacttttaccggaggggtgtgttaatgttacctacttgtctgttttttttgctatgtctctgtgagttaatatggttccttcttctgactctgctttaaccatatgccctggtcttccagtgaagctggtggtaactcgagcgttgatgattactgcagatattctagctgggtttggatttctcaccctgctccttggtcttgactgcgtgaaattcctccctgatgagccgtacattaaagtccgcatctgctttgttgctggagccacgttactaatagcaggtaccggtctggctggactagcaacaggggtagggagactctgctaagggcttgaggtgaaggagagagttgtgctgaagctgctcattttcggattatatgtggcttccctttctagattgaaaaactaaaggtcacttctaccagccctgcatactttagctttgaagtcagctaattagtcttttgttaatatctcagaacaaaatatgaagctctcaggccgggtgtggtggcttatgcctatattcccagcactttgggaggccaaggcaggcagatcacttgaggccaggagtttgaaaccagctggccatcatggtgaaaccctatccccactaaaaatacaaatccaggcatggtggtgcacacctgtagtcccagctactcggcggggctgaggcaggagaatcgctcgaacccaggaggcggaggttgcagtgagcagagatcgcgccactgcactccagcctgggcaacagagcaagactccgtctcacggaaaaaaaaaaaaaaaaaaaggaaataaagaaaaaaaaaagctctaaaactatgttttggccatttaaaaagttacataacttcaatttttaaaataatttatcttgtgattattactgaagttaaaatcctaaagtaagccccaaacttctacctccttacctatacccaccaccaccaactccaccaattctttttaacaataaactaacaattgtgccaagtcctatgttaaacttgtcccacgtactaacccatttgttcataaatgtaacaataaacagatcatattgttatcctcacttaagatgcagataaataattgaagttctgaggactggtcaagcatatttattagtcaagcatgactaataaacaacatatcaaaaagcactttaagtagtatttattagtgaaacagcaaaaatgatactttattcaggtctgtcttcaacttcaaagcttagtcctcttcttttgcaacataatgtcttcttcttgtctgttagcaggaaaaatcttgtctgctaacaaagcgaatataagtggcagcctgaccaggcagtgtggggtagtacatcgatatggagtttggaactagaaacacttgtagatatgtatgtgtgatatattcacccgtgtctctgtttcctgatctgcaaagaggcatgaggctaaggtagtaacatgtagcctgaattgctatggtgaagatgcaatgtgggcacagcaaactgttagctgactgcctaaccctttgtatgctcagaacttgggcctccctgacttttgacacagaaatgttaagtcaacgtcctaataatcctcagattgtattataaagttacaaaaatttagaattcttcccttctgtaagtcatttatttaattatcccacctactgacagcatagaactttttaatatacaatgtaattcatttaacagatttaaacattatttaatctaattatttacggctatataattttgttcgagaatatttttgagctatcatcagtaaataacccatcttatgtaaaacaacaaaacaaatagcatttaaaaaataagtcactgaagaaaatcctgataggaatgactgaagaaataactaaattgaaagacaaagcatgtcctaagctttggaaactttagaattagtgtgctataaaatttatttttaaagtctataatctgttttgaaggtttagaaagggaatttctaactgaaaactgcagataatggcattatagcaatgctattgcaatatatactgcgttttctaaaggttatgtgtttattatctggcttttttttttttttttttttgagatggagtctcgctctgtcgcccaggctggagtgcagtggcgtgatctcggctcactgcaagctccacctcctgggttcacgccattctcctgcctcagcctcccaagtagctgggactacaggcgcccaccaccacgcctggctactttttgtatttttagtagagaaggggtttcaccatgttggccaggatggtctcaatctcttgacctcgtgatccgcccgcctcggccccccaaagcgctgggattacaggtgtgagccaatgtgcccggcctatctgctccttcttaaagttcttacattaaacaattaggagaagaatacagttaaatagtgatttaaatagatatcacagactatctagggaaaaaaatgtaaaattttttggagactacatattttattttatttttttagatttgggaaagacaaatatttctctcattagacagtaaaacaactctggaaagtaatctgaagagattgtttgtgaacacatgcatctaacttagcacagagtagcagaactttgaaatgaaggaaaagtaggatccagttatttgggtgttggtgggcaagatcttaacactaacgttgatacagcttcaggatatcagtaagcatacatttacaagtaaataactgaaaatccaactcaagcagacttagacaacatatagattactgatttcttgtaattgccttctgctaggcattgagcatgtggagagtacatattttaaaaacactcttttaattcagtgttttgtcctccaactcaccacatttcttattgcatctaggcttcaacatgcaatttatacctttaaaataacaggacactagtggcgtcatttcaaaccagttaattgtcagagaggctaagctgtggagatgtatttaaagggaataacatttcttggtccattcttatatggtgtgagggtagtagataaagatttatttgaaaataaaaacattttttacttcaattatttgtgtttgacctcaagacactgaaatcagtgactttaaaaacagttttcacatgggtgctgattacgtagctggcatagcttcaaaagggggtacagggagcattaaatacaatgatatttactcacaatttaaaaatcattacagaatgaacatatgctctatgttgtttgtgttagactacattctttttctgttttgtttggttttgttttagtattttcctttatacaatactaacatggcattggaaagacaggagaatcaaagaaaaccataacgatgaatttcgatttacacagataagcactgtgttatttcatttttgcattttctttatgtataaactgagataaaatttaaaaaagatacaagatggaaggcaaaaggaagagacagaagaagtgtccgaagttcgggttgcccatgaatccatgttactgtttttacctctctgaatcacgccagccattttgtgtagtaagcaggtatttttggatttaaattcagaaaatgtcccctattatttgtagcatcctccctttctttcaggtaccccaggaatcattggctctgtgtggtatgctgttgatgtgtatgtggaacgttctactttggttttgcacaatatatttcttggtatccaatataaatttggttggtcctgttggctcggaatggctgggtctctgggttgctttttggctggagctgttctcacctgctgcttatatctttttaaaggtaagaataaaataaaatagcaaatttccttgcctccactatcgtttttcccaatccagtggaaacaaatttcaaaaggaaaaaaatgttatttatttgaattcctacctattgccattaaaaattccaattgttcaagggcaattgaattgtaatactcaaacattattacccagttagttctatattaattgaaaaataaaatccacaactacaagcatgtccaatattcaaatgtataatagttatcttgatgtattacaattatacatatatacatatatacacacatatacataccgtatatatactatatatgtatatatactatatacatatatatacacatatagtatatatactatatatacatactgtatatatacccttgtatatatacgtatacatagtacatatgtatacacatatacacatatgtatatgcatatatgtatatgtatacatatatgtataattgtaatacatcaaaataactattgtacatttgaatattggacatagttgtagttgtggattttttcaattaatgtaacactaacttggtaataatgtttgagtattgtaattcagttgcccttgaacaattggaatttttaatggtaattggaatttttaatggtaacaggtaggaatacacccatgtatatgcatgtatatatgcacacacgtatatgcatgtatatatgcacacacgtatatgcatgtatatatgcacacacgtatatgcatgtatatatgcacacacgtatatgcatgtatatatgcacacatgtatatgtatgtatatatgcacacatgtatatgtatgtatatatgcacacatgtatatgtatattagaattatacatatatgtgtgtctatatatacaattatacctttataattgtatgcatatatgtagatatacatataattgtaatacattaaaataactattatacatttgaatattggacatggttgtagttgtgaattttctatatatatatattttgatgtattacaattatacatgcatatatatcttcacccactcaactaaatgtatatttagtgttaaactgagaagtggactaagatccagccaaatacttctttttaaagaatttaacatgttatgttgggtttctaaaaatatcacctaaaaaactaagggaatacctctcctgatgaagaaaaaaaaaataacaggaaatctacttggctgaattttaaacctaaaagaaactttcagaatgaaaatcttaaattgtcttctaggattcttcttagagttccaaaatgataccttctttgagtatctatattcttgttccttttgaggaagaacatataaaatggtattttataattttcccaagttcactgagttctacttatttttatatttctttcaaacagatgttggacctgagagaaactatccttattccttgaggaaagcctattcagccgcgggtgtttccatggccaagtcatactcagcccctcgcacagagacggccaaaatgtatgctgtagacacaagggtgtaaaatgcacgtttcagggtgtgtttgcatatgatttaatcaatcagtatggttacattgataaaatagtaagtcaatccaggaacagttatttagaattcatattgaattaaattaattgctagcttaatcaaaatgtttgattctcctatactttttctttctattactcttatattttcccgtcattctctctgctaaccttccaccttatgcacacactttccctatattttaagataagtctgctaggatgtagaaatatttgtttgtgatttctatatagctattagagattatgacatagtaatattaaaatgaaatgatacttaaacagaaagcaatttccaaagaggccagggaccctaatctttgaagagatgaagaaacttacttttctccctggcttttggttcactttttgtacttttaacaagtgggtgaattatttgataattttgaggaagattattcttttaaattcaaactagtatgtcaatgcctaccattactctgattatattaaaacagaaaaaggaaataacaacttcgtataccagccactggtgagagttaaagacaagagctgcccccccacccccaaatgtcaaaggcaaatgctaaattgatactggagctcgtggtgactttctacctcactaacaacataagggatctccatattatttcaccactattctagctttgctgatatattgccaaatgattagactacagaatagttcaaccagagaatttactcatttattgattaaacatccaaatactattgtaatatactatgttaaaattcatcaattcaagtgcccacacaccactgaatcatcagcaccaagcaatatattagacatatggcaaaattcaacaaatatattttgatataaataaataaacgttcacgactttacttaaaaaatcaatgttgcggctgggcacggtagctcgcgtctgtaatccccgcactttgggaggccaaggcgggtggatcacgaggtcaagagacggagaccatcctggctaacatggtgaaaccctgtctctactaaaaatacaaaaattagccgggcgtggtggcggtgcctgtagtcccagctactcgggaggctgaggcaggagaatcgtttgaacccaggaggtggaggttgcagtgagcggagatcgcaccattgcactccagtctggcaacagagcgagactccatctcaaaaaacaaaaataaataaataaataaatattcttcataaaatgtgggttttggggaaaatatagaattacatatacatttaacgaagtcgctaatgacatttcattcatattcataatgtaaccatcttgaatttttttaattgtagcgattttaaaaatgtttgtaaaatttaatttccagttttctaattacttgtcagtcacattaataacattagtacctttatggtacccttgcagtacctgaaaagaatatcaacctgaaaagaatatcaactcacccagaaattagttctttgaaaaaaaagaaattaagttgtgaatttctaaagaccttgaaataagtgtttcaaatttaaagaacaaagaatgatgtgaaaatgagattatgattcctactacatgaattaacgtttcgagattgctgtttattacttcccagagtatctttaacagtattctctgaagcagttccaatctagttggagaattaacagcaattgatttaactatctcatttttattaactgtaatttacattaaaaatatttgcaaatcatactcattagttatttgatcattgttctatgcattttaaaattaattttgtgttgttcctctcaatatttgtttttaacatttattcccatttttattttatactattgtctgtcatgctttatgtattccaataagtgtcttgaaatccttgtggggaaaggcaggacaaaaataattagttaattagatttgaaaaatgtaatttttccattttaaatatttcatttgtataagaaaatatttcagagaaccat

SEQ ID NO: 17450 - DNA, 18492 bp, Human
gatctgggctcactgccacctccgcctcccgggttcaagcaattctcctacctcagcctcccaagtagctggaattacaggcgcccaccaccatgcccggctaattttcatattgttagtagagacggggtttcaccatgttggccaggctgatctcgaactcctgatctcaagtgatccgcctgcctcagcctcccaaagtgttgggattacaggcgtgagccactgcgcctggcctgagccaccgtgcccgggtgtttaataatacttttaattcttaaatgtttggaacaaaaaaaagaagaaaatgagattatatgattcacatggtactgctctagtcctgcagcaaattccagtgccttctctgatcagggaatttttacaaaatcaaatgtgattgatacatcttcatccacactgacaggcacccacagaacatccactgagacctagacagtagtactgactgcaggccctaaccctgggatacaacacgaacatggtcttgtcctaaacagctgataggagaaagacagtattcactgtgttaatctcagtccaaattaattgtcttcatctagctcctgtcttacattcttcattgcttgtccctaaatcctagcacggccaagtcctttagttttaagcctacatgaaaggcatccagggagagccaggtggaaatgaaggtggtggggcttggcctttcttcccattcccaccttgagaatttgcacctttccttctctgtcaccaactagcagttgccatggtatataagggtatatcttattttatccttaatatgtttatttctgcttccaagatgcttctgtttttactaaaaccatagaagcttcccctcccaccacactcgcaccacacacaaaaagcagttggaaaaacatttcaatgattcctaaccacaacagcacttctgactaactacaaagaaggaagctttggagaaacatagagggaaactacagtcccagcgagaccgaaaccggaggggtgagatagccagtcacagtaaaagctggaaccagagcccagacttcctcaactccagcccagtccttttgccactggggaaacgctgtttacatgtcctcacctgcgacgaacaacatttgataactcacaaaattaacacctttcagggagagcggggcactggccaggtccctctgataatgaattgctgctctaagacataactgctgtggggaggaggttggtgtttggcggggaagggctgctagcctgcagtttcataaggacaataatacatcaaaaaggacaatcatagatcaaaggggatattttgggtcaacttgatatgtagtggaaagcagattgggaggggagccaagtactggatatgctccgtgcgtgagtgtgtctgtgtgtgtgtgtgtgtgtgtgtgtaaatcatgttgctctctgggtctgtttcccaatctgtagagtgtaaaagtctctgaggctccttgcagagacaagtgatggaacgaccttgacagaagagagcagagagaggaaagaagggggaggaagccaagcaaaggagagagaaatggtgtgatgggggaggagacgcggagttgggtagaaatgccttttaataagatattgggaaaaaagtattaaacctaaaactgcagctcttgaaggatcattttttcatctttgtgttaggatttacaagtacagtgcatagtaatttttggataattggagtgaatgaatgaaaagcgtgaaacgccttacaggagcgagaagatccacgagagaaagcgagcagggacgcagctctggtgcctggtcctgccgggtggtccccacgccgccagccgcgcgttccccaaccgggcgctcccggcgccctctcggtgagccgccctgaaaccgccagggggcgctccccggctgccggggctgaggcgggcggagctgctttaaatcgcggcgcccagcggttctgcgtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagtgagtgcacccccacctcacagcggccgtccagaggccccagtccccctgcagctcccttatgggctcattctgttgtgtgattccatggttatcagtcttcagttgatcaagtcttctgatcatgtgctctgtcataaggaaatgaagagaatcctggtttgaggaaagcgacgcccaggcataagctctagttttgcctctaactccctgggtgacacttctgccactctaggtgtggcttcatcctaaattcctatgctggtggttcgagttgagggagtgaaggccaaacttgaacttgagctcttagacctctcctaggcattccgagatttggggtaaattgaggattggtagagttcagacaagaaaatgggatgactgaaaaagtttgaagcctggtaacttctcaagtgtgcacgcttaaataaataatcctcaagtattagatataactttttaacctttaatatgattttttcatagtaaaagttacattcctactggaaatgtcctatctaagtgtcttctgcttatgcttgaggttgattcttttaatttataagatccagttagtgcagggaggccccttgcaagactctttggagaagctgcttgagattcccccgaagttttaattttcagacccaaggtcttctgtagaggctgacggtgtagtgctatcttggaaagagaaggttggtggcaggtggggaaaggctgacaagaaaggttctaaataacctgcgcaacataatacaaagaaaaaagtaaaggcactgaagggaaatgcagcaaaatagtcatagctgatgaaatcagaggtcagctgggagtggaaggcagtgagagagaaagaagaggtgggtcttccttaggtttccatcttccacaaagaaatttctgtgtaatggatgttcagtgaccccctgtaaaactggaaaggattgtatagagagacatatttctaaggatggtgggaagaaggataataggataattgttttactttgttttttaaattaaaggtttcgagttccttgtccgaaaagtcattaaattcccatttacttagataataatgattcacggctggagtatcttccttgagaaatcacattaattgtcttatatcatgtgtctgttatgccctttaactcacttgaagaaaagatcccttagtctttgcctagatgaacgtgactgcccactggcccccattgcatgctaagggtgaaaagtgttggcattgttcaagtttacttaacttgttttgtctacctcctatcaagggacaacttttaatagtgtatatcaaaagccatatagtttagagttattaaacctgttccaaatctgtttgaacaccttgaatacctgtggcatttgctcagtcaatgtgcatggttgttttgagtgttattatttcagcttttgaaggttctcatatcaggacttctttacaccaaaaccaatccataagtttagtaattatgtgttgctcattgccctcaggggttatatttgtacttataaaatgaaaaatttggtaataattattgaatttctccatggaaagataaatatatttaaggaaacggtgtcaggcattttaggtaccacgttaaggaattggcaggtggaggtttctaaggacaattccagagaggtctcactgtcagttttattcctctgatcaaaatagttccttttcaacatctttaaataggttttcttttaacttcctgaaatgaccaaatgaaatcagattgatctatgttgtaaatactcaaatggatcatccttacacatgataatgtgttaaaatgttttactttcattttttggttaatgtagttattacagtttttaaaactagggtgaaaggactaaatacctacccccccacacacactttagagatgtcttcctatttttttaaaactccagatcagaatccacttttattttacttaaagccatagtttatccaaggtgtggcttaggcctttctctcaaaacccattctcagaagagggacccttgactcacaggtgttctcctctcacctgccgtgactcacgggatgcttttggatagaacccaggaaaccttacttcatttctctgcctgagcagtggtgtttacgcccaccagctgtagagatctgggatggtgattcattggctggttttggtacagttttgttacatgtagagatgaaaagggttatgtgtgtatatttaagcagtatcactcagaaaaaagctgcatttcattaagtgtgtttaggtgaaaagcttagctgtgggtttcccgaaattgtaccttgccgtctttcccagtagagcacacttgtcttcccggccagatgcagggctttagcacgggaagtattaaaatctgttgtttccctgctttatgtagggtaggtcataaaaagcatatgaccttcataaagtatctgaaggaatacagtgtgctaatagtgtatacagtaaatacaaaatgagatagagcaaggcttcttcttttaggtagttcttgccaagcggtttatgaaaatgtaactgaggcacttcctggggaaacaaatgtcacattgtgtattgtagttttataatggctgatacaatttccatttcatccaaagtatgtgattttattgaccctggggattcttgtagctgaaagttggaatatacaaaaagtgccagatacagttgtagtagacttttcttgattcacctgtacctctcgccttgttttcatctaattctcaaacttttaggaagctcgcgccaattttatgtgcttgcttaaatgcttcttcttacttgactttaatagctagagctgtccaaagattgagttgctgtaggaggctgcatggtgggaggtgtgcaagcagagaataaataagcattttgaaggaatgttgtagggaagatccaagcaccagacaaatgggaggttaggctagactctctctcaatctcaccgaaccctgagattctgtaatttgtttataagctcctctagcctgtttaacttgctttgcatgaatccacatgtgtgtaggtgtgcttaatgagtattggtggctgtgagcttccccagcactctcaccatgatgtcaggctcaatcagagagacaaaatcactgacgtggacagtctttgaagcctaagtggagaggagggcacctatttatgcttctccagatgcgttgtgcctgctgaaccgagggtactcgaagggccattggtgttcagatatacttcataaattagttctgactcttagaataatggaagttgaagcaaaaatccaggcttgagatcagaaattctctgttcttactgtggtttggcactaagtagccaagtgtataatggtgagccacttgatctccctggtttcaagtagttaccccacttataaaatagggcagagtgggaggaatggggagatgaatctatgattcgtttatccattcaacagatgcaagctaggccctattcttgctgctaaggatggtgcagctaagatgagttctaagattccttccagtgccagaattctttgttattacttcagtgattgaaggggaagaggcaagtcacatagcttaggtttccttaattggagtgattaaggaaatataatggaggtaatatagaagcatcaacttaattctgagaaaatttcttgaagaaacacacaaacaagaaaggtagcaaaacttctgaggacatcctgaaaagtggtacatcctgcctcatccaggatcattttcactcctgattttgcttatgttctgagttcacatctggtgaccatcacctcatgcaccaataagagggaaatgctaatgattaggacttttatgaaactttgaacttccgtaaaagtaaaagatttaatatggagaaaagccaggggagtacacttctgtgactgtctgtgttgagctcatttaattgcaggggagaaggaagcacaatatttttgttctagtcacccaatcatcagttcatttattcacttaatacttattaagcaactacagatgcaaagggagaattggaatctgcagtcaacatttgaacaacacaggtttgaacagcaagtgtccacttataggtggatttctttcaaccaataccgatcaagaatacagtatctgagagtccaaagcctgcatgtagggagggttgactttctgtatacaaggcttccacaggatcaactgtaggacttgagcatgtgcagatttagttacctgtgggtggtcctggaaccaatcacccttatataccaagagatgactatattttgtttatgatatatagaacctaaggtaatatggctagaaaatagcataaacaatgtctggtattgatagtagattctactacttgtgtagcaagactttcaagctttagaaaaattacatatatgtctgtctttctacacatttgttgattaacctaagtgtagtagatcagtaacttccaactcacttcttgtcttataagtagagatctttgtaagtatttacttttaattctactttcaggtggaaaatgatgagaactccttagggggtctttaatctcaagattgtcagtctagctaaatataattaaaagactgccttctgtgtttactgctgaataatgatgagaaaaaatagtgtaatttttttaatgtttgctaaccaggttctccatagacaactttagtcagtggtcataatattgtagatttagctgcaaatttaagaggtgagaaaaggaatatgtttgttcctaggtttgttctaatcagaccaattcaaagttaatattgcaaggctatacaacatctatctcatccaaattgttgttttatagctttcaaacatcctttttaacttctctgctctgccactcatcattccattagggcaaaaagaaacaaaacttaagctttgaagctcattagatacatactttaaaaaatagatcaaaataagcaaaaagtacaatttgtattatctgcatgagtttctagttatcagtgacctaagctaagtctggcttttagtagcaagattttagcataccaggctctcaagggaggtatttctcagtattatttcaaaaattaagctaaacacaagagaataagtatttttacctatcatattggtacagatttttaaaggataaagacatgttctaatttaaatttattgaaatttgataaatccatgtgacttttcaagtactgtgcttggtgctttagatggaaataggaataaatatctgactcaaatcatccaggagttcatgattacatactttacaaatctgatttaaaacacttctatgatgtgaaggtattcatctgtttccggcttaaaactgtgcaatttagatttgatctgcacataaaacacttgtaacttgtaacacaatagttgcttactttgactggtaacctatcattacctacgccttgcttgtgagttttcgtgctgttttaattctcagctttttgtgcgtgactacatgtgtatattatttttgcattttcctcacatataactatacttaagaatttatccaaatatctccaatgaagcaaagcaagattttgggtttgatgcaaatctaatattggaacatacaaataaattgtataagtcaatagttgccaggatgtaagtgaaaatattactttgcaaaacgacattttaaaaaacaaagcaggatctcatttctatggtttatgcaatttttaaatattgtgttttccattttctccattactttttgtgtattatgcaaataatatattattctatagagaaatgaaacctgataggtttcttagcaatcatagaacagaatatcagtccccagccccttggaaagaacactttgtagatgaagtggcaagatagatttgacacgaatcaaatgtgttttctttgagaacttaatgggcaaaaacttagagattaaaaatgtgaatattaggtcattccaggtgggtgcagtaagggccctggagtagtttatgcacatgtgttccttgcctgggagatcaggggttttacacagtccgactcatgagattgatgcccagttagacttctcttgaagactactctgcgatctaagtgctcagacctgctgggcaagtgaccttctgtttttacttgaagaaaagatcagtgtgattattctataaactggtccagtttggggccccacaacttgaacaaagagaaaaacttggagcaagatcagagaaaacatctaaaatgattaataaaaggttgaaaaagagtatttatgaaaaaataaaatggaggaggctgtgaaatgtaagatgctatagatgcttgaagtgctgtcatagaaatatttattgattgtgtgatctctatgctgacagtaaaaatcatgtcgcccctttctcaagataatcatatgacttctgattatacttagaatagaatccatcttcttaccctaatttgcgaagttctgcatgacatatgccttctgcccaccttgctaaacttcgttttactttgcacatcctatcatcctgcgttaggatgaccagctctcccaatttgttcaggattgagagccttctaaggatgtaggactttaaactttaaagctaggactgttccaggcaaactgagatatgtggtttccctatcctccagacatggatcatctttgttactttcagcatctcctcttcaggcatatctctgcctgaaatattttcctgccaagtgtaatcttaggaccacatctgaaatctgtgttatgtatgggtttagttattttatttgttatttcccaataatgatagcctttgcaaaaaccatccatcagaaagaggacataccttaaccatggagcccttggtactttcctcttcataccacagtatggcttgtgattccaaggaaaaagttgtgtaataaccttacaagcagcttcagttccttcctggtaaacctgtggtccgtggaacatgtgttttgatccagcagttcctctgccacctggaatcttgagataagtgtgtgggtcagtgtgcatgtgtgcccatacatgcttatgaggaggtcagtgtgtgaggggaatcaggaagtctcttttttatttttaaatgaaatcaagtaaaacttaaccttggcttcaaaaatatctctcaaatactgtaaacaatacctttgatactttttagaaagagattatggccaggcgtagtggctcacgtctgtaatcccagaactttgggaggccgaggtgggcagaccacctgaactcaggaatttgagaccatcctgggcaacatggtgaaacccatctctactaaataccaaaaaaaaaaaaaaatttagccaggcatggtggttcgtgcctgcagtcccagctactcaggaggctgtgggatgagaatcgcttgagccccagaggcagaggttgcagtgagcccatatcgcaccactgcactccagcctgggcaacagagcaagactctatctcaaaaaaagaaaaataaagagattactataattttatcatagattgcctggttatagcaaagacagaaaatcagtaaatcaagatttaatgaagttttagaaatatttagcttcaattatgattggtgacctaagttctcaatcttgacaatattaacactaagcctaggcctgattagatattgagatacaaaacctttccaacatctcagccacttttaaagaccatcaaggagtcaattgttccaatccactggataaagatataatttacattttacttatataattgaaatattattccaaacaatactaagtttcttgctcaagatagcacagtttgttaaagctaaaaaatacttatatatgcaaaaaacacttgtcacatattatcactgtcaatgatatagtgatctttaattaaaggaggacataaatctagaatttaaacaaaatcttctaaccagcatagtttcagttcatatttaaaaatctgtgcctttatgccacaatgatggcatcaagtttttactctttaagaaacatagtgataatgtctcaaacttgaccctgtttatttgatcatgagttagtacaccaaaaataatgatgggaaattagaaaaaatggaatcctgagaaacactacattgaattattgtgtgtgctattttacaacatggcagcttaaatagttttaaaaaactagtgatgtctttgaatatgaatctactactatgtcccaaggtaacatctcaaaggttattttgtttagttttaagaaaatgacttctatattcttccccactcctcctattcacatcactggagatacaaatactgcttatccagccatgataatctataaaacatttattttttatcttccaattcatccagtttttctgaagcttattgattggggtgtaaagctggtgactaatatcaaagatatactgtaaaccattttgattacaaatagttaacatccaggatagtatatatgattgttacttaaaattaaaattatcttagcaaggatgaaaatcccttagtaaaaaataaatatgtattagttcagctaaccctattcaattagatcattaattaattttccagttgattttgaatttaatgttggaaacataaaatattggagtggagggatctctttttcatcatccagcctggcatttgtttttctggagaagatactgtatattgggttaccagcggaaacatcagtatgactggggtctctagattcctagtccagttttctctcttccatacaacagtgacatatacttggtcttcttccatttttctcttgttggtccaagcatatttttacatgttttaaaatgttttctgccaggcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtaatagaggctgtgcccccctttcaccttactaacctgttcctggtatgatttgaaatctattacgttggattcattatacttgatttcagtctctaaggcaaactgcaaacatagacctgaagtccagttgactttcatgttctcaaacacaaactaaatgaaaatgtgagagctctgctcacatctgacaggtctattggttgaagtttcaagtggcaactggtttgttagaaccagtctcttccagtgaagaaagttgttcactatttagcaaacgctaaggaggaagttcatgtaattcagataattcctatggtgtctccacagatactatgtggaaaagatggggagtagtgagagaaaacacaagaatatgtgaacccttcaggtctgtgagggatggaaggattgggattattggagaaaaataaggatagcattccagctgggcagatctaattcgagaataaacaggatgtgcctgtagatcaatgaaaagaaaggccaactggagtagaggtggcctgttggaatggtcagtttaaagcagttaggaaaaaaaaaatacagaaatacctttaaatttttttgataaaataatattatattttccatttaaaataaatacgtgttttttaggccaggtgtggtggttcacgcctgtaatcccagcacttttggaggctgaggagggcggatcacctgaggtcgtgagttcaagaccagcctggccaacatggtgaaaccccatctctactgaaaacacaaaaattagctgggtgtggtggtgcacgcctgtaatcccatatactccagaggctgaggcatgagaatcacctcaactcgggagccgagatcgcaccactgcactccagcctaagcaacagaagactgtctaaaaaaaaaagaaaaaagaaaagaaaagaaatatctgttttttaattcaagtgttgattgataagttacattatgtgtcatttgagaaaatcaaagtcagaaaacatggacagcattatttcaaagctttataataatgcctatttaaaaaattatagtgtatgtatacttacgtgtgtatatgtacatacatatgcaatctctctgtgtgtatatatatatctttatatctatacactgtgttatatatgttgataatctccatataaattatacagctataataatagactactatatgttctctatattaggtattagatgcatatattatatatgtagtatattatagtatattattttaaaaaaataacagatataattaatgatacaaatctactaatagaaaaaaactagaatagactttattttcttattttctttttgacagaagacttgtaggggcttttgcttcagtataatatgtcagtttaaccagtaattgaggaagagtatctgtggctttgctaaagatgtggttagtttaaaatgaccagtctctcagtttacccaaatacaaattgactcctctctgaaaaggcatggatagtgtcttattcccaataatttactcttatatcaaaggctgcgaatagtaatctttgtggccatcgtggcatgaagtgtatgaagtgcttggaagacgatgaggatgaaatgcattgcattcttccttcgcttgccttcttgtaactcccacatgtgactgcatcactcctattccagtttcagggacttctcttaggagtaagcatcacaagttcaagaccattcgcatggtctatttgagaagccaaaagcaatagtgttttctgtcatgtctagaggcaattacattggaccatgtttttggctggggagagacagtagcatagaaacatctaatctatctatattgatgaatacttagaattactacaaaaaagttatttaacttttttgataaaaaaatgaagtattttatacatcttataaatgattaagtgaatgattttgactaaatgatttctctgctatcattgaatataaaatgccatgggaaattgagattgggttgcataaattgatctgatgtggcaccctcaacaaatctcaggccaacctatacctatatcaggtattcccttggccaatggggcagtagtaatgcaggtattctggtccattctgagacatgtcctgatctcactctatctagctgcttgcattccttttgactctgcagaaatgtaaattttgagtttgatcaagaacatagaagagttttcatcttccccttttgcaagtaattctacctgtactaataatgacaatagttttatcaaatgtagtttagtatcctaatgtataacagcatatttaaaagagattttgtacaacatacacctgcctaattgtttccaaaaaagaattatttgtgccaagatatcataaaaaagtataaattttgtctaatgccaacctagtatttttttatattttaatagatacttggaataaatcatatctggacttctaatctccctaataccaaaataaaaatgtcaacactattgatgagatttaattcttgcaaaatatgttttggtttaacaggttgtgtatttaggctcagtgttccatggtgattaacagtcttttgttttgaatttctataggtctggctattttagttgccacagcatggtatggcaatagaatcgttcaagaattctatgaccctatgaccccagtcaatgccaggtaacgctattcaggcgtaaaatagtttgttttctgagaaaatgccctttttatattctacaaagtcctgctagtgccatcatttcccagatttgctttcaagaattttatgtcaaacctacaaacaatttaaatgatctctgacttatgtcaaaatgagtttgataattgctttaacaccctgtattgatgacaaaataccttccaaagtagaaaagtttcaagctctgtgcttttcaactgtataactgggctttcttttgtttgttttttcaaatattaataaagatgttaatatatttgaaatttcctttttgaagtgtattctgatgtttacaacacctacctaagattatttgtaactaatgcacagtttatgattgattgagaaaaattatactactataggggttaatgaataatacttcattcccaacagttcatttttacacgtaaagctattatgtatgtttttagtatgttcagataccaccttgaaattttttgttctttcacaactgtaaaattggctttacaaaggtcatctttcttaatactgcaggttgtgcaagttgagctgattcttagctctcgtgtaacaacattctttaatcagagacgaggctcttcatctcactgtcttcacatctttaatgcctaataactacattcagtcaggatgttaaaatataattattgtttgttgagtgcttagatgaatggatgaaaaacctcagtgtttggagagataagatgtgtttctttttatataatcacccacatatgggagaacacatactgcaatggttgtgttggagcccatcccataagatttacagtgtaagaatagaaactgctagaggtcagtaggctaaaatttcgccaaggtaataacaccagtaatgcacaggaaagcactttataaattgccagccattttgcaattgttatttacattattgcatgtgatcctaaaagcagtctattgaggcaggtgggattatcctgctttgagagtaggagaaactgaggctgagaggtgaagttgctatcccagaattgcagcagttgagagtctgcatcaggatttagacttggccttataacttatagaaccaacccttctctactcttccgtattgtccataatcactcacagataccccaccctaagtgtctgctttaatacatctgcctggatcagcttaatccagaatggttcatgggctgcttagaacttttctttacaaaaccataagatttggatttcagattgtataggtgcctgggaccaatggatcatctgttcaaagctctgattatctccattatgctctatcagtttctttatagaatatgattactacttagtgataaagcttcctttgctaagtttcagcctaggaaccatgatccaaaccctacttctaaaacatataaacatgctttacaagtatcctatatatggaaaagtccttggaattatttgtgtaattaacctggtattacatgtgttatttcctgatctactattgcaaattgtcaccaattgcaatataaacattctttggcgtgtatgttcagaaatcttaaagtacttcccaagggatattcaggggttattttcaatgaaaaaaatacaatgagtattgattttttttccttttattatattagaaaagttgccaataattcactgattaacaagcacatgggtttttccttttaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacataca

SEQ ID NO: 17451 - DNA, 36791 bp, Human
tgtttctccttggtgctatcaagtccatggtttgtcacaattcaatccgagcttccaaatctgcagccatttacccacccaaagaccaggggctttaacttttactgttttatagtccatcagctttggttctgtgttaccaaagaaccacagccccatcatgctaagaggatgacactttccctttgagaagagcatctatatatttagaagaaaccattattagtcaattttatctatgagagaaatattaagaatataaaaattatagtaatttgctgatagtaaattttattagaagagtttaaatataactacattagcagactcaataaaaattttaaacatagtgggtcaagtataaatctcattgctatggtaattagctgtgaaatacatagataataaaccattgcagataggggtttttgtttgttttctcacataatagggcacatatgcatctctaggcggaatgaaaaagggccagaaatgctgctaaaattgtcagtttgaataactttttgataggctggcagatacaaaagtttacaagaaacactcgatgtgccaagtaatctccttgcaaagtacaaggacccagatgaaaaatcccaatgatgcgaatcatccctgtaatctcccaaatcccattatgaagtctgattagagtaggctacaacccaattgcaagtgggctttgctgttgatggagagccaattcgtggcaaacattagtaaaaccaagccatttatctacccggttgaatcagcctttgttgaggagtgtgaaactgtgaccagcatcaccaaccagccctctatagacagggactgctttcctttctcctacacttggtttgtgccctgaagttggctctggtactgcattggcatcttgagaaaacctttttgctggtttctagcaggaaagagaggaaggaggccctgactccagggatgtggagggactgagctggactgtctagggagatctgtgttcctgggatcaggcccttgagcacccaacaggcagaaggttgtgaagtgccccaaggaccatcacatctaccgaaaaatggtgaatctgggggacttggtttgatccagtgagccaccaagagcaatacttcccctcagcctgtgatgaggactcacatagtggttggattttttaaggacacatggtgcaggggcaactctgtagttcaggggtcatcaagtttgaactatgagggaccacatggccaatatttacattttgcagaccaagcaagaaaagggaagatattacgtaggaacttacataacaagagagaaaaaattgtcacaatgtttttattgatataatccaaaatacggtaatatttgagtacaattatttgcaactcacatctattaatgagagaaaaggaattcttttgcgggggggatatttctcttaattggagttcaaaggcggtgtctgctatcatcacataaagtgcaaatgttcatgtatgaaaaccatgcttagctctctggtacaaacacagggagctctcgcgatctggcccataggctgtagtttgcagacccttgctatagctgaacaccagtcgcccacactgggtttgcggtgttccggggtgggaagtcgctccgggctgcgaagcacctcgagggatccccccggcccgaactctccctctgtgcccagctaaccgcggttcattggctctccccgcgaggcaggtctggaagatcaagaatgaagctcggagctctctcgcggagcaaggacaccttcgggcttcaggaccacccagggcgtccaaaactgctgccagggctgtgcccccgccccccggcactttccagctccccctccacgcccgctcttcctccctctctgccccctctagctcctcctccggctcctccccctccgctcctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctatcccagcgcgtggccgaccgcctgggcctggagctgggcaaggtggtcacgaagaagttcagcaaccaggagaccaggtgggggccgcgccggcggccgggctagggagagcgctgggcacgcggctgcggggccgggttgggggccggcgcctgcccgggccacctccgcggacgccgcgctcccccttccggggcgggacggtggcaacgcggcctccgcgcccccgcgcccgcgcctgcgaagaaaccgaggcggggcgccgcgcgtcccgatgcgcgccccggctgtgcccccggttgcagggcctccggtcctgggaccgcggcgacccggcggtcccgagccgctcccggcctcccagcggtgccgcccggcctggcgtccccagcccggaagggagacgtctgggcggtcacagaccgtcggggagagagtgggcgcagcgggcgggaaccgcatcgggtcagcgcgcggtggagagacgtcctgggttggctggtcccagtttccgcgtccctacaaagctgaacctcagaccagtgcgtgcgactaaaggtttccccccgtccccaactctggttgcacgctgggtttacctggggacggtccgaacgctgcttcccccgacctgcccccaagggtttgatccaacgggcggaggatcagcgattttacaagcttccctggcttctcctgagcagccagggcgcagaccactgcgttatccagagggtgcagttgtgccaaggtttgaaagactgtgagaaccccaggacgcacgtgctgggctcccctctgctcccactactcttgctgctttaaagatgatggactttcagcttccttcttgttctaggactctgctgtgtccagcaacaacgccgtgattcgactgtaactttcacccatttctcaagtccaggagagcctcaggtggtggccatcctcggaagctgacctggggggctcctttgtctatctgcctgagtccacacagctccttgactcatttcaaattggtctcatttttcccccttcttcctccaatgtctagtaccgttaactgtccacagttactgataatttttatatctttggcaaaggttcaattttaccaacattttctagaaatggtgttggaacagttggacacccatatgccaaaaaatatgaacttccatccatacttttcaccatttgtaaaaattaactttgaagtggatcatagacctaattgtaaaatctagaactataaaatttctagcagaaaatcttgacttggggttaggcaaaaatttcttaaggaggagttatgttaatactgatggggaagatgctatattttggcaagtcagctttttaggatatgtgaatcttacgtgacttcttccaggtggcaaattccagttatggctccgatgataatataagcgaagaaacattgtgaatgagtggcaggtggactttggctaaagaattccactctgcagtgtttaatgcagaagtctgagaggatggtctagggctctggagaaggatagagctaggtttgagtgttgcagtattttgccagtcttgttcaagtttcagtcgctgtaagaacacgagaagaagaatagtttttgttcagaaggtgtcgtcatataagtaaaggagaaatttgttgatgaagtaaattttgaaagcaaatatgttgcccttccaggtactcagtgcagcatgatcttttgctaaggagcatggttaatctagatcagttcactgctaagtcagtgttgagtttctcctaaaaataccacatgtgccactgggcaaaactcactcagacactgaagtatgattgtttatacatttggttcaaatataaagcagactcacttttattttgtttttggcattttataaccatcacttgataattagaaatcgtgggacctcaaaaaccactcagcatgaagtttgggaattgcctatatagctacattttatgtttttaatgtatagagtataaaaggttcactgcctgacttttctcttttccatgaactgtacaagtacagagcttaatttttataaacagccctctctggaccagttactgtgctaggaatccagcttttagctgtgtaatcgtagagaggaaaaactgaagggcaaaatgaagacaaaattgattcagttcatgtaagggccccttcttgaatctgtcactgaactaggatcagaaatctggtttgctgtctcctggccatcaatcctcccattttgcgttttttatatgctactttactgaacatagagccttccaattttaccttcttatccctaaatcatttcagatatgcagggagaggtccgctccagcttcactatagaccatggaaattccatgatgacatcttaggacagcaggtgtctagatgtctctgttgtaacattttactatggtcagttaacctgctggcagaatctttagctatactgtgagacaaggttatgcaaagttatacaaggttatcggttaccatgtaataaataaagagcttaatggcttaaaacagtaattgttgatttggcttacaaatctgcaatttgggaagggctcagtgaagaaagcttgtttttgccgcgtatggtcacagctgaggctggtcacagctgaggcggctaactggggctggagggttcttgaagatggctcacatgactgaagttgttactagcttttgcctgggagcttggttaggaacctcagctcctcttcttgtaggcctctccatggggctgcttgagcttccttacagcatggaagctgggttctaagagcacatgttccaaaagacaggacattgaagccaccagtccattaaggactgggcttgcaagttggtgtatcataatttctgtcatatgctgttgggcaagtacagagccctctcagattcaagggcgggagactagaccctgctccttgatgggaaatgtgttaagagtctgtggctatcttttagttaccatgcccgtttattgttgagtcagtgacgctcttcagcgtttttatttgggggtcaataaagatcctctggcagaatggcaaatggatgctgccttctagccacaattttttaaagacctagaataaaggtagtcatgatcatctttttgagtagaagcaggactagctttaggggaaaagttgccatggtgatgatattctctgtcctcccctggactgctagtcatatgagaactgaggttcctgagtaaaaacaggccaaagaatctaatcttgtgggataaacgtcataagaccaggagttggcaaagtttttctgcaaagggccaaatcgtaaatattttaggcagtgctagcacatgtagtctctgttgctgcggtatcttacagttctgtaagttacggtaatgtctgtcacaggttagcagggctgtattctcttctgaggctctaggggagaatctgttcccgtgccttttccggtttccagaggcagcccacattccttcactattggcctcttcaccttcaatgtcagcaacaaaatgttgctctgaccctgcttctgctgtctccctcttgcatttttaagggccccatgattacaatgggccaatttaaataatccaggataatttccccatgttaaggtcagctgatgagcaacctgaatgctatctgcaaatttacttcccctttgccatataaactcacatattcaaaggattaggatgtagacatctttagggggccattattctgcctaccacgccattcttaactcacaggccatagaaaaacagcctatgtgctgtgttttgtcaacctctcagctatataatactgtacttgatttctgctgtagttcattttgtgctgctataacagaataccagagactggctaatttataaacaatagaaatttgtttctcacaggtctggaggctgggaagtccaatactgaggggctggcatctggcaagggctttcttgctgcatcatcccatggcagaagggtggaagggcaagagagcatatttgagagagagcaatagagggccaaatttgctaatataataaacccattctcaagataatgagcacactctagcaatgatgacgttaatccgtttgtgaggacagagcccttatgacctaatcacctcttaaaggtctcacctgtcaatactcctatactggggattaagctttcaacacatgaactttagggaacacatttaaaccatagcaatttccaaattaagtttatgtcatagttgatgtagtgttcacaaagcagttagatttagctccttagatcttcaaataggagggagcacatagaactctttctatccccctcatcctgtgaggttggcatattttcatccatagtagaaggcgtgcaagaagatgtgtgaatgttatcaaaactaattttcacaacatgtcaacttgaaaaactttatttttattttccttttctttaaaattttttttagagacggggtcttgctatgttgcccaggctggactagaactcctgggctcaaacaatccccttgcctcagtctcccaagtagctgggactgtgggcatgagccaccatgcccagcctgtttttaaattttcattaggtataattggctcttttttttttttttttttttttttgagacagagtttcacttttgttgcccaggctggagtgcaatggtgcgatcccagctcactgcaagctccgcctcccgggttcaagtgattctcctgcctcagcctcccgagtagctgggattacaggcatgcaccaccacacctggctaattttgtattttttagtagagatggggtttctccatgttaggctggtctagaactccagacctcaggtgatcagcccaccttggcctctcaaagtgctgggattacaggcgtgagccaccgcgcccagccttaattggctcttttaagaaaacaatttcattgagtatctgatagcaggagaagagagaaggataattattcatgttccttatttgtaattttaaaatatttcattttgggatgaataaatttacagacaattctgccataatgtgacatatgtattcctaaaaattaccacgctatgcaaaatcaggcaatccaaaaccacagggcttatgagaaaaatggggttagggacataacattcaaaaacttcctcagtgacccattaaaaaatcataggaatgttatatagattgagcatcccttatcagaaatgcctgggacaacaagtatttcagattttttttttttttttttttttttttgcattttggaatatttctattgtacttactggttggacattccaaatctccaaaaatccaaaatccacaatgctccaatgaccatttcctttgagcatgatgtcgacactcagaaagtttcggatttcagaatttcggattagggttcctatcaaaatggtaaaacactgacatgtattacatgctcaaaaaatactggctgggtgcaatggctcacgtctgtaatcccagcactttgggaggctgaggtgggcggatcacttgaggtcaggagttcaaaaccagcctggccaacatggcaaaacctccctccactaaaaatacaacaaattagccaggcgtggtggtgcatgcctgtaatccgagctactcgggaggctgaggcaggataatcacttgaacctgggtggcagaggtcggagtgagctgagatgtcaccactgccctccagcctgggcaacagagtgagactctgtctttaaaaaaaaaaaaaaaattacataaatattatgacagagatggaactttccattgaaaaatgcctgaggtttagggttctctgaaatgacatgaaaagttgtgacaccaaatgtgaatgagtgtggctcattgtcctcgaggtgtgtacatgtgtatgtttgtgtatttctaagtggctccattcagctgggtacactgcagttttctgcagtctcgggataagaggttgtgcataagaaaacatgaaattcatgctatgctcaaattgttccaaataatatcaatcattggaacaaatttgccttttcaaaacatagcagagctgaccatcttcttggtttggacgcagagctctgggaaggacatgcctgagcacacagcactattttctgtttcttcccaccaaaggaatatgccagggatgagctggctctccctctcatgttggacatccagaattctgtacctggaaatacagaaacttccagacatgcaattttcaaaaacttagctgctatttactctttctccagaagctacgcaaggatgccaaccagcaaaacaaggaagtataccaagaaagaggatacagaaaatggcaaatggagtgcaggagagggggcagggaatccccggatggcagctgtgcacaggcagagagataacccaggcctgccacccctgggagggatgcctgcaagacgatgaaatgcagatgggacttgaggcctctgatcttgggagattttgattgttagtgaagggtttagggtggaatctggattcaggattcagaaaacttagcagataaaaaggtaagagaatgacctccagggaaaataaaaagaaaagatgtgcataaaaagaaaatacaagcattcgtttaagttaattgcatggcagagctctgagcagcatttgcgcagttaaaaacgtacagtcaatctttaatgtgaatattgatctatattgggatgatggcgagatgggaagtttacattgcaagtgatggaactgaatggaaatggagttcagtcctcatcttccatagtgagaagtcaatacactttgcctaaaatgaaaaatcaagacacagcaatacacacatagtagctagacttgaaggaaagtatccaaaaaccctatcaagagttgaaattggtggcctctgggcactttctctgttatacgtcttacagaatggtttgaattttttaagcaatatgactgtataactttaataaaaaactaaaactaaatgtagtattttgcagaaaagagttaacattagcaggcctgagacttaggcctgttcgcaaggttggcccttggctggcctctgggagcttacattttgcaagggtacccaccatttcccagtaaggatggctcactgcataaactcttaaacaattgataaacaatgtggttcatgctgaatgcctgtgagtctgacattttggtacgtgctaggcagagggtgcttatatgaccagcccacaatacaaaccctgggacttgagtctctaagcagcttccctggtagagagcccttcacacgtgttgtcacagctcactactggggcattaagctctacctctgactcccctcagggaggagtcttggaagcttgcaccctgtttcccccaacttcaccccatgcacctttttccctttgctgagtttgctctgtgtcctttctctgcaataaattacagccatgagtgcaactattaggctgagtcctataagtcatcctggtgatcatcaaacctaggggtggtctcagggacgcccaagatgcaaatatgcttcgatattaaccgatggcagttttcttttcctagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagaggtgtgtgccctagaaacctgctgtgggccactgtcaatgttgtttttcctcatttatccccttgattagaattatctggaaaatgttggctttttcctttgatgatcaagtaaatatgctttcttattttgtttgttgaagatttggctttgaacctaccctgacattaatattcaaagaaacaggtaatgcatatttttgcaggtattaaaataccattattgtccttgttataatgaaattattgtatgtctttgtggtggtggatagaactaaatacacacacatacatgcacaagagtacaagtcaaactagagcacatctgaatcagatcactggattgtatcaatttcagggtcctggctgtgatactgtgttatagtttcacaagacgttaccacagggaactaggtaaaaggttcacaggatctctgcgttgtttcatacaactgcatgtctatctacaattcccccgaaataaaaagtttaattaaaaaaaaaacccatgatctctttttaaccttttaaaaagaacagaaatagtatcattgaattatgtttttcacaacattagcatcagaggaggctctgtgagtctttagaaaaaaattgaagaaaatgtggttggtctttgcctttcagagcaacagagaaatcggaggttgagaagaactttgaaggagattgtattagttttctaagctgtcataagaaattacataaaccgcgtggcttaaaagagcagaaatttttccctcacagtttcggaggcccagaagtgtgaaatcaaggaatgggcaggggcacgctccctctgaaggctgtaagggaggctgcttcctcgcttcttccaacttctggtgtctccttgcattccttggctgtggctacatcactctggtccctgcctctctcttcacctggcctcttccctgtgtctcttctctgtttcttataaggacactgtcattggatttcaggcctaacctaatccagaatgaactcaacttaatctttaccttggttatatttgcaaagaccctatttccaaaatgaggtcacatgctgaagttgtgggtggacatgagttttggggggatattgtttgacctactacagtggtcaactcccagctgttgtgtgttccgtatcttatggatagatagatgttcagccaggctcagcgagaatcctgccagttttcaagacacactgctgttctgtgatttggtaactcagtgcaagaaaggttttccccaatatgctgctttttatctccataattcatttctgaaacaacacagatttctgaagcagcacacaagatcccctcatatttgaaaaaaaccctttataaatttgaattcatataccaaagtccccctgaattttaatcccagtctcctcaagacatggtttccattccctgtcttgaagatggccagtcagttaatttctcacctaaaatctaattagaagggtccacatactttatctgtaaatggctatatggtctgtgttgcaactattcaactctggttgtacttcaaaaagagcaatagacaatatgtaaatgaatgggtatggctgtgttccaataaaactttatttatggacactgaaatgtgaatttcatattattttcacatgccttgaaatactattttgaatttttttcaaccatttaaacatgtgaaagccattattagctcacaagcagtaccaaaacaagtggctggtggctggtggctagctggatttggcctataggctacagtttgccaacccctgtattagaccattgatagattgcgtgcgcacgtgtgtgtgtgtgtgtgtgtgtgtgtgtgtgtatgtgtgtgtgtgtttatgatctaaacttgaccttgggcagccaaaaccttaggtcacatacactgctgtgaagctgtatcctcccactagctatttatacagacagctccttttattttaaacttgatttaaactgtatttttagctgttaaatttcaattttctaattttgtcccattggtataatctgttgtcttagctattcttcccatctgtgtgtttccacaggattgtttagcatctttctccttgtcatatcacatccatgtcatagaagagctaattttctgccattatttcttccttccttgtggtttagtaaattctcacattgtagctggttttttgttgtttgtttgtttgtttgtttttgagacggagtctcactctgtcacccaggctgaagtgcagtggcacgatctcagctcactgcaacctccgcctcccaggctcaagcaatcctcctacctcagcctcccgagtagctgggactacaggtgtgcaccaccacgcctggctaatttttgtatttttggtagagacgaggtttcaccatgctggccaggctggtctcgaactcctgacctcaagtgatctgcccgccttggcctcccaaagtgctgggattacaggcatgagctaccgcacctggcctgtagctgtatttttaatcaagctctttcactcacaatagattttatattttgtatttggccctaagatattgaatatattgtaacttctttagaaaattactccttttatcattgcacatgccctcctccactattacccgatttgtaaccccattttgttcattaagtgataaaatatcagaagctctacatttttgttagcacatatctgatttgcggtgacctctttttacaaagttgtattttcaaaatgttttcttatttgagttggagaaactagcactgttttttcccaatccttctattgtaggaggtgtgatgcagtccagcctccatcccctagttgccagtagtgctcccagccaccactaacaagagccctatggatttctggaactccagtggctataacttgtgttttgttttgttttgttttgttttgttttgtttgagatggagtttcgctcttgttgcccaagctggagtgcagtggtgccgtctcagctcactgcaacctctgcctcccaggtttaaggattctcctgcctcagcctctcaagtagctgggaagcatgcgccacgacgcctggctaattttttgtatttttagtagagacagggtttcaccgtgtgggccaggctggtctcgaactcctggcctcaagtgatctgcccgcctcagcctcccaaagtactgggattacaggcatgagccatcgcgcccagccggctttaactgttttgtggaactgtgttgtctaactagctagtagcagctttcctgatgttagacagatgtgttttccattttgacccattgtgaaaacatatttcttttctttcttctaccctttctttaatcactttgctgtaagtgtgtttcttggtaataacattgtagctgcttttaattttttatcccagtcagacaattccatgactttctgagcttaactgctgatagaagagaggtctttcatcatcaaccacgcagaggcagggcggttggtaacatttgagagacagtgtgtgtagtggcttaggaagtcatgtggtttctcgttagagaacacagctaggaaagaaggaatcacggtggggtgtattcgtttcctagcactgttataacaaattaccacaaactgggtgacttaaaacaacagaaatatgttctcttaagtgctagaggccagaagtccaacatcaaggtgttggcagaggaatattccttttggaggctgcaggggaggctcctccttccttgcctcttctagctcctggtgactgccagccttgaggccacatcactctaatctctgctggaatcttcgcatggcctcctctttgtctccatcagatctctcgctcactctctcatttttaattttctttttagagacagggtctcgcttcgtcacccaggctgaagtgcggtggcacaatcttagctcactgcagcctcaaacttctgggctcaagtgatcctcccacctcagcctcccaggtagctgggactacaggtgcacaccaccacgcctggctaatattttttgctttttgtagaggcagtgtctcactatgttgcccaggctggtcttgaataggaattctcctgggctcaagagatcctcctgccttggccttccaaagtgttaggattaaaagcattaccaccacacctggcatctctctttaaaggatacatgaggtagcatctagtgttcacctgaataatccaggataatctccccatctcaggatcctcaatgtcatcacatctgcagaaacctttccaaataaggtaacatttacaggttccagggattgggctctgatatttttggggccaccattcagctcacttcaggaggccttaaaggaagtcactgatgtgttaagagacgaatattttaaggacactttgagctttgagatagtacatatcatttatcatctaggccaggatgctttcaagattgaaagggagctctatggataactgtgttgggaaacaggtgtctgcctagactgtcctgggcaagtgacatagggccaccctctctatagcctctggaggtggccaagacacataagctgttctgacaccattatttctgacatgtctgtgtagtcagtgtgactcattatagtgaggagacaattttgttctttccccaaacttctgaaaggggaattcttaattcttaattttatctagtatttgaggtgtgcctttgctttatttttttaagacagagtctcgctctgtcacccaggctggagtacagtggcacaatcttggctcactgcaacctctgcctccggggttcaagcaattctcctgcctcagcctcccaagtagctaggattataggtttgcgccaccacacctggctaattttagtatttttagtagagacagggttttgctatgttggccaggctggtctcgaactcctgacttcaaatgatctgctcacctcggcctcccaaagtgctgggattacaggtgtgaaccaccgcgcctggcccacctttgcattttttaaatggctgataatacttttcctaactattccttccttaccttggatcacgtggcttggctttgtactgagaaactgtactttggtgaggggaactgggatttagtaagcacctaagagagatggccagagcctgtcagcatacttcatctcttagaatctcttagacaagtgctactgtttaccagtacaggtgaatgatgaggagaccaagcatgattggggtggggggtgagggttaggggaaatgcacttctacctttttgcttcatttaggaaggtataaagccatgtggcgttagattgtgatgagaagctgtgacctacacttgatctctcatcccagaaagaaaatgctcctgcacagccgcaggaggagctctgggcagccctccaagactttctgttgtgctgtttccttcccttagggctgtattacctatgacatctaatgacaatgaaattctgtgtaattgctcttcttggaatgccttgcaaagaagcccagaaaaaaaaaatctggaagcttttaaccagattcaaagctggttttgtttttttctgtaaaccttgctgctgctttttaagcaagccctgcacatatgtaacattttatttggggttttctttgtatgtacaagacaccagggacagattctgatggtgaaggaatggtttcataaattaggacacatccatacaatgtaatgttaacatagaaaaataatgatgatgtaatattaattgtaaaagacatggtgccaagtggtctgagctctggcactgagaatcaagtaggctcagatttgaattccagcccattatttactcagtttatcctttgtaaaagttacttaaactgtctgtatctttagtttccttatctgtaaattaagtacgacactagctactatttatgaagtacctaccatattatgatacatgagtgggcaaactttttctgaaaagagctggatgtcaaacattttgggctttgtgggccgttgggtatctattgcagcagctccactctgccattttagtgtgaaagcagccattagtcaatgtgtacatgaaggggtgcggctgtgttccagtaaaactttatgtgcactgaaatatgaacctcatataatcttcagatgtcacaaaatattgttcttcttttgattgtttttcaaccgtttaaagacgtaaaaaccattgttaactcacaggttatgcaaaaacaggctgtgggctaagtttggcccatggattctaatttgccggtccctgctatagaagacactcaataactgctggttcccttccctggtaaaaacagtaggttgggccgggcatggtggctcacacatgtaatcccagcactttgggaggccaaggcgggcggatcacctgaggtcaggagttcgagaagagcctggccaacatggtgaaaccccatctctactaaaaatacaaaaattagccaggcctggtggcgtgtgcctgtaatcccagctactcagggggctggggcaggagaattgcttgaacccaggaggcagaggttgtagtgcagtgagctgagatctcaccactgcactccagcctgggtgacagagcgggactccgtctcaaaaggaaaaaaaaaaaaaaaggtagattgtgggcaagactgggaataattacttctgaggcgggtaaaggacttgtagtttggggatttcttttttcttttttcaaaatcattttcaagatcatgttctgttttcaataagattttctttttttccttttttgtagcagagaaattgagaacagtttttcctgatgtgaatttctacagtcttgtaatttttttaaaagcctgtcaattttacacttttcaaaaggtgatatttgatgccttgaataacatctggaatagcctgggactctgtcatgattgggctgacttgcaaaacatttgacttttatgcgtttttcactaagggagctgaatgttttatttttggctactgtaccttgacactacctttgtttcagtgctgtacttacttttctttgtataggctagcaagtcagttaactagtaaatcatttttcctgcaagattcagttgggtatgagccaaactctgagacacagaacagaaaccaaatttgtaaacaaggtgtgaagaagaaaatcagaaagcgtgaatttaggaattaccctgtggtttggatcctagaagttaagaaacactggatgccactgaggagagatgagaagggaggattctttttgctggcatcttagtctgtgctactgtaacaaaataccacacactgggtaatttataaagaacagaaatattctttggtgctgggcacggtggctcacgcctgtaattccagcactttgggaggctgaggtgggcggatcacctgaggtcgggagttcgagaccagtctgaccaacatggagaaaccccttctctactaaaaatacaaaattagccggttgtggtggcgcatgcctgtaatcccagccactcgggaggtggaggttgcggtgagccgagatcacaccattgcactccagccagggcaacaagagcgaaactccatctcaaaaaaaaagaaatattctttgaacgtgtgtcctgggaggggggaaaaaaaggacaaaaatatattttctcatagtcctggagactggaagaccaagaccaagcactagcatttggtgtctggtacgggctgcgtcctccagagggaagaatgctgtgtccttacatgatataagacagaagggcaagtttgcaaaatgctgcctgaagcctcctttagaaggaccttaatcccgctctcaagggagcagccctcatggcctaatcaccttttaaaggccccacttcttaatcctatcacattggcaacacctgaattttggaggtgacctttcaacccgtagtaactgattcgacaattgtaggaaaagcacaaaattgattagtattgcaaatcaggttctattacaaagcagttgtagcaactgatttgctctttttattatcctggaactttgttacactaaataattctcacaattagtgaggctaatgagtaagccttggacatttagtgttaatagagattctgttagtaaatatttattgaagaactactgaatgcagagtgtggagctgtgttctgctgcgaaaattcgattttatcccaaaggcaacatggaatatagtacgggggagttaaatgatgaaaacatgagttatgatctataattagtggagaagattgaaaaaataaaaaaacaagaaaaatatattttcctataatctcacattccagaaacatctgttaactttttagagtgttttcctctcattcttttctttctgttttgaacatacatgcataccttttttttttttttttttttgagatggagtctcgctctgtcgcccaggctggagtgcagtagtgccatctcggctcactgcaacctctgtctccagggttcaagcaattctcctgcctcagcctcctaagtagttgggactacaggcgcccgccaccacgcctggctaattttttgtgtttttagtagagacagcgtttcaccatgttagccaggatggtctggatcttctgatctcgtgatccgcccacctcggcctcccaaagtgctgagattacaggcgtgagccaccgcgccccatatatacctatttttgataaaatatatatttctttttaaaaagtggtatattagggaaaacacaaataatctgttaacattttcaatgtaattccttcctgcatgtgtttttacatgaatatactgtgtgtgtgtgtgtgtgtgtgtgtgtaacaaggatcatttgttactattttgaatgaaatctttttttaagcttttattttcttttttgtggctgatatatagaaatactgttgtttacaacaaaatgctgaacgccacctaggtctaatcatgtgtctatataatttcttggatttctttgatgtgggcagttgtattgtccataatttatgatgtggaaaccaaagctatagaaaagttaggtaattttacaaagaacataatatcagtaaatgacactaagtatgaaattaaatagtaactattatcaatccccttacagtattcattctttgaccttgtttttttccatttgtaatagtgttagcgtccaactgtcagctcatgtccaaatgtcggctcatgaattcctctttaatagctggacttcttttagcctctggctgtgtgagggtctcttgacctcagtgatctcacatgtgccactctgtccttctagaacactattctcctcgcctttgctaaacttgccttaaaagtgatttcctcagagggaccgctaataatgatcttgtttaaactttatgcccttcctactactatcatctctctctctcggtaccttttatttctacacacttaccatgatttcagttacacagattgtgacattacatgtacatatgtttaactgtttgcttctttcatatttgttctctatacccagcgtcaagcacttagttttgcagtagtatatgtaaatagtaaatatttgctgaataagatggaatgaatatatcttttgctgtcacaacatgtataattttctttttgatgcttcgttgattgcatctatgatttatccttctcatgtacgtcttagtgggaggaatctaacagtatccatcttttcctgttataaaattaatgttcttacttgtagagtcgtgccccaatttctgcaaaacttgtggccaatatgctgtcggtggctggggcggatcacatcatcaccatggacctgcatgcttctcagatacaggtatccgtgttttccttctgcaaatggttaaatcaagtctgttaaattaaataatcttaggtaacattacttgtgtttgagtttatatatggctactctcttggatttttgtctttactaaacttgaaaatataatttgatattagtacttccagtctctatcaccaccttgccccccagtcaattttggaggagtggggatggctttttggtagtaagctctatatagttccatctcagcttatggaaaataattagaacggcagtcataatgtacactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgtttaaaaaaacaaaagaaaacaaaacaaaacaaaaccctgcaacatgacactcacttctccctttagggattctttgatattcctgtggataatttgtatgcggagcccgcagtcctgcagtggattcgggaaaacattgccgagtggaagaactgtatcattgtttcacctgacgcagggggagccaaaaggtatcatgcaggctacaccttgcagatttctccatctgctgattggtttttccttttccgatgtattagataaggaagcatgctgtaaattacttaaagctttattttgctaatgagcaagtaagtagaccgcaggcttcacttccagagcagaaacccatcatctttgttaatatttcgtcattcaggaaagaagaaaatacagagacacacatacacaataggtatatattggtttatttgttttcagcaaagggtagatgtgtttgaggtttttttaagttatcgttttctgattataaaagtaatgagcctaattggaaaataagtcttttaattaacagcacttggaaatggtagccaaaatagaacaatttttttttaaaagaaatctctgtacatagaataccaagaaggaaatatctgagaccaagaaataaagcagaggcggaaagccatgtccaggtggcttgggggatgggcatcagatccagcaagagcctggtggcttgggttttaatactcacctggaaacccccataaagaagggagttaaagccaggcacggtgatgtatgcctgtaatcctagcaccttgggaagccgaggcgggagaatcacttgagcccaggtgctccaggctgcagagagctatgatcacaccactgcactccagcctgggtaacagagtgagaccctgactctaaaaaaaaaaaaaagaagaagaagaagaagagaagagggctgaaggccagatttctagccaaaagccagggggaaagcccatctttacctcggcctttggtttaggggaggaaatagtcacctatgagaagtcaaaccacgagcctgtgccacattcagatgtggagtggaatgcacacgaaaatgtgctccaggctgcagagcccctgcagagggagaatttcacaatcctagctgctcggtgagtgctccctgctcaacctgacccgatgcctgatccaaagttagaaaaccaagagaacacagtccacgcaggcccagcatgtgcagacaacagggcagcaggcagccaatacttggggataagataataattactggactatcaaataagtaagtttaaaaggaaactgaggtgaaggagagttaacaacaacctggtcgtaacagtacggcagtgatgaggcacccagtggtgtgagaacgtggtactaagtagcacctctgaagggcttcacagagatactcgaggcgttaacaagcaatcagggtacagggtgttcagaatcaaggatgagcacaataagagaatgctgcaagctgaggcttggtgacccaatgaccttgtagagctttgcagatgctatctgggaagaaaaaaagctgggaagggagttttattgtgtaggtagagacctccataagggagaagtaggagagacttctaccccccagtccagtgaggaagcaaggaagctctaaatgtgcactaatagaggagtgatgagagtgacaagtgatcagcctttggaatgtctgacatcaaaagcctgtccctcatttggcaccctcatctgcctgcagcccagctgaggacctaggatctaacacaaaagcttagaagtagcccagaaagttgtcttaacactcttgcagggaaacacaggccctgattcttagaagagccttgttcattctgctcaaagctgccttccaacggctgctggggttcccagcacagaagagaaggaacggaccatgcagctggagatcggcctctgccagcagcaggaagtggctgtggccagggaggagacacaaatatataaaagacgggagcagaaagttaacttgcaaagaccctaggtgggcagtcacggggtggagggcagcgctgtgtcacgtagcctattactgtacggtgtgtaatgttcacaaaaatgcccttggccaagaatcaaggttgaatgacgctgagagtcctctgcaaaagattgtgagcaacattttggagtcatatctactagaaatgcttgcagttgacttggaaacttctgcaagtcacatggaatctgcattcaaatgaggcaaatgcactggcccagtggaaggttagaggcaaagaatccagccaaaggggtacaggagcgagcgtcagatgtaactgggttataataacagctttgttacaatgtaattcaaatacgtacaattggccgggtgtggtgactcacacttgtaaccccagcactttgggaggccaaggcaggtggatcgcttgaggtcaggagttcgagaccaacctggccaacagggtgaaaccccgtctctgctgaaaatacaaaaattagctgggcttggtggtgcacgcctgtaattccagctattcaggaagctgaggcaggagaatcacttgaacctgggaggtggaggttgcagtgagccgagatcacgccactgcactccagcgtgggtgacagggcgagagtccgtctcaaaaaagaaaaagaaaataccaaaaaactccaaatacgtacagtttacccatttaaagtgtacagttcagcagtgttttacatattcagagatttgtgcaaccatcactatctaattccagagcatttttatcaccccaaaaagaaaccctgtacccattagcagtcactccccatttacttccccccaccttatccctggcagccaggaatctactttctatctttatggggttatcttttggagactttgtatatcaattggtagtatagaacatggcctttgtgtctggcagatacctttgtaaaccagaaaatgttattttggcagctactcagcccaaagaatagtagattccacaaatttgtatgaccatctttctttcctcccccaaccttgtttttatatacatagtctaagaatatcatacatgctcttagcagaaattcagacagtacaaaagtgtcccatccctgttctttaaatgccaccgttatttccagtgtcagaattgtgttatttaagcgtatatctgcctatttatttcacgcaaatggcaatgcgatgtacacagttcttcactgtgcttttctgaaaaactcacttgctgtatcttaacaatgattccatagtcgtgttgtgcagctgtgcaatattcccttgtgtgcatgtaccacagctcctgtgaccagtcaggccccctcttccccatttgtaggtgccgttgtttgcactcttaaatgcagttgtgaagcaatatcgttgctttgacattttgtacacgtgtgctagtaggatacgttcctagaagtggaattgccgagtcaaaaggcatgagccattttaggtttgatgggcagtgccaaaatatggtcttttccaaaaaatataccagttgacattccatcatgtatggatgccagtgactttctacacagccttgctcacacagtgggttatcaggcagtttacttccagatcaggtaggtgatctatggcatcctcttcctgtgagctctggttgctgtgggtgagggtagtgccctcaccagggtatgttgattttccatgagatgggtctctattcaaatcttttgcctattgttctcttggctgggacgtttcttgtggattgtctacagttttgcatagacgagatcacagctgtttctcatgtgtgttgcaaatatttctccaagttttttcatttcttctcctattttgtatttttattctctgcaggactttaaaaaccttcttacgtagtcaggtttattttttcttcacattatggcttctgagtttatgtaggagtcatccttctcttaaaatttgtcttctcccatgattctgtatatttttttcttttttaatgtcccaagtttacttccatctgaaatttattttggaataaagaatgaaataagaatccagcccccccacccccgactctactgtctagtttttccaaaactatttattaaataatccacctctattgatttgatatggcatctttcatcatatacagagttccccatttcaaatagatagctatttgccaactcctacttttaaaaaaatgcagaataaagtaaacagaataaatggctggggttgagatgctgttttgttttgttgagacctcctttcaagcagtctgcactcaatcacccctgctccctctgccaggaaaatcaagctttttagggaagtacatttcagaatttttgtcacctcctttctcttttccaagtgtttctgctacacattattgtcatcctcatattctagcccccaactgacagtctcctcagaacagccttgcgggtaatacatgacatatgcagttgacattatctgtgacttctttgcttgatgcaaaaggtcatagttagcaaaataaaatactgtaaatttctgtctgaccaattggagcttgttgctttagaaaaagctttgaagcttgactcgttccgggtaaaactgaatgttgccacaggaggtcactcttgggtaggctttgtagcttggttgggttgaccacggaaagaaaattaaacctaagaaacctacctaccactgctgagatagcaagtgtcaacctaaaagtggtatgggaagagggtaaaactagataactcagatttaactttttttctgattacataatctttgaagatgctctataggaaatttggaaagtagaaagaagaaaatcttaacactttatatctcaaccagtgatgccactatgaataatttggtgtactatgtatctgtctctcctgggggagctgatatggcacatgcacccacagagaaaagattgtaaatatgtgcccagaagaaatccaaaactgtatgtatataattttcgttctgcctttttctgcctaagatttcagtgtggtatgttgtgtcaacatcatttgttaggagtatgtattaggtctccatgatatacaaggaaaagaagagttacctatagctttttcaggaaatcatagcgttctaacaacccaggaagctgtttgcaggggtattttctcttatcttcttcttctgacattaccattggataccttttagtggctagggctccccactcaagtgagatgtctgtgtcccccactgccaagaaccacagagctcaccttctttcccagtcccacttccatgcctaccctgctgtctgcttgtgagcaggctcgtgagaacaggcgccacctggcagagagatgaaaacaggttctgctttaacttctccggtatagaacttccaccacaaagggcagtgcttcccagtgctgggctgtggattggtatcctgtcatgcccaaatctgcctagtcgttaccaaataagcagacggtaatgtatgtggacattttgtgcgaggtgttcatgtgtcttgggaaaacctgtctcatgttcccagaaagtagctttccttacctggagtttgagtggcttttatgacattggcatgtagataatagaactgtacgtgtttttttgtttgtttgttttttgagatggagtctcgctcagtcgcccaggctggagtgcaatggcgtgatcttggctcactgcaacctccacctcccgggatcaagcgattctcccgcctcagcctcccaagtagctggggttacaggcagccaccatcatgcccggctactttttgtatttttgtagagatggagtttcaccatgttggccaggctcatcttgaactcctaacctcaggtgatccacccacctcggcctcccaaagtgctgggattacagctgtgagccaccgtgcctggctgaactgtaggtgttttaaggtgatgatggagcaaaatttttgttggcctttaaattaatttttttaattaaatctttaagtaaggaaactgttgacagctagacaagtttacaaacaaagggtatctgctagggctactgtggttttggttgcatcctgaagaatgagtgttttaagggtaggatgagtgttctaagggtaggagaaacatggacctcaatatagtaatgattccctttgcttcaaggacgttgatgtcttattctcttatctcacagtctctgtgtttaactggaaagtttggtcccttttcttttatgataattgacatagttggatttatgaccaccaccttactatgtggtttttttgtttttgagacagagtcttgctctgttgcccaggctggagtgtagtggcgcgatcacagctcactgcagcccccgatctcccaggctcaagtaatcctgccaccttagcctcccaagtagctggaactaaaggcgcatgccaccatgcctggctaatttttgtattttttgtagagacggggttttactatgttgcccaggctggtctccaattcctgggctcaagtgatctgcctgcctcggcctcccaaaatgctgggattataggtgtgagccaccatgcttagctactatatgctttagtttttccttctccacaaagtagacattattattattttggttttgtacaatcaacatttgtttagatttgtccacatattgatcaatatctttgcttacctttctctgcccctgcccctcaccacatctcaatgtatctgtggtgattttccttttgcttaagttgcattctttaagtggttatatgttagaaataaattctcaggttgtatagtttggctgaaactatctttattttgctctccttctggaaaggcagttttgctgagtatagactcctagcctgagagttattttctcatatcacattgaagatatgactccataacttctggcttccattggggaagttgaggacttggccatccttactaggtgacttgtctttattctttgtctcttttaagctttctgggtcttcaataggtttgttaagattgtttgggaattcatttgttgggtttatgggatccggggatcctcagatccaataaacccaacaaatcatcaggaaacagttgtcagaagacatcattggtcctgtgtttcctacggaaataaaaaacaataaatattgcactgaatgtttgtggtttggtgtccctgaataataaagaaggaacatatttgcaaaaagttgcatagggtttttttatgcagaattttgtcagaagacagtggtgctgccatgtttttctttgagtgcaaatgtacattgctaagatttttttaagatggcatgtgctttgaaaagaggatattgcatttttaagagtttaaaaatcttatgagtgagaaatattaaaaaatcttattttcccctctttacaagaaataaaagatgttcctcataaaaaaaaaaaaaaaaaaaaaagggaaatattagccgaataggttatacagagttaccatatgacccagcaattccactctgaggtatattccccaaagacttgaagacagggactcaaacagatacttatacaccagtgttcatagcggcagtattcagtatagccaaaaggtggaaccaacctgagtggccatgaacagatgaatggatgaacgcaatgcgctgtatccacccaatggaatgttattcagacttaaagagagatgaagtactcatctatgcagccgtgtggatggactatgaacagtttatgctaattgaaagaggccagacacaaaaatgcacgtattttatgattccatttatacaaaaagttcagaatagagacagaaaatagattcatgcttggcagggcctggggggaggggagaatagggagtgcctgcttaaggggtgtggggtttccttttgatatcatgaaatgttctggaactagacagagataatagttgtgcaatgttgtgaatgtacttgatgccattgaattaatacactttaaaatggctccaaggataaattctgtgttatgtatattttaccacaattgaaaagaaacactggctgggcacagtggctcatgtccgtaatcccagcactttgggaagctgaggtgggcggatcacctgaggtcaggagttcgagaccagcctggccaacatggagaaaccctgtctctactaaaaatacaaaattagccgggagtggtggtgcatgcctatcaccccagctactcaggaggccgaggcaggagaatcacttgaacccaggaggcagaggttgcagtgagccgagattgtgccattgcactccagcctggtcaacaagagtgaaactgtctcaaaaaaaaaaaaaaaaaaagaaaagaaaagaaacactggttgtgttgtgaaaatcctcagaaatagggaggggagcctggagcacctaactgcccttcccactgccttctcagccccagagagtgtcccctctgtccttcatcagagcacgcgaggagctccattcctggtcgtcatctgaggatgacacaatgagtaggactaggactttaaaactagtgtgtggaggttatatcctccatgtactgcgtcttaagttgggccatgtgtgtattggtccccaaagcattttttcagctaaattgcataatgactgttattttaaaaactggaaaaggaaaatcttaatgttacattatacctgtggcattgtcttgaaataagtttcaccatttaaatccactcttcacaggaaaatctgaaatgccccaggctcaccagcaagcgaggcctgcccactttctcttcctgttggcagctcagctcctcctgagctagtgatttttttttttaaagagatgggatcttgctatgttgtccaggctgtattcgaactcagacgcaagccatccttctacctgcgactcctgagtagctgggcctacaggcacgatgccatgcctggcaccattgatgtctgagcatttgccttagatgagcagaggagctggactcacagtttaaagtctccttagaccttgaatgcaatgaagcccatcctgactagcctacatattagatggctgtattaaccaggacttttgtccccactatctgtgccacaaactgggcaaatagtagttcctaaataacttactttaagttgtacctgtcatggttttaaaatgctacccacaaatactaacaaactgaatatcaaattcttacccagtagttctatccagtggccagggtgccctgacggtcattcctagctgccccaattgcaaggtccgccattagcacatttctccctgtggattgctaagtgcctgccccagaccatgcctgggctgatcaagagaggcctgattcttgcatcatctctcgggtgtggttgcctgctacattcccaaaatacaactttaaaggcgagatctctagttgactgtatgaacatgttcatttgtgcctttgccagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagtacgcagggcggtggggaaagcgttaggacttctcactaggaaagggaaacacatcagcttttagaaattgggctcttttttcctgattattgccggtcttggcagtggagttttagaccaaaggagattctaggcccttttatctttatacttctttctctggtagaaaagaaagcacgggccttttcgttttccagggtgagcttgtagtgtacctggaaaaaggtcaaagaaggtgcttccctttgcactgagcacgacaggaaagatggtttttcgggcttcttcaggccctagcttccttccatttggctttcgtgccagccttctcagccacatgggtgtctggaggatttgtagagctgctgcccagtatggaagcccccacccagccacacgtggccgtggagctcttggaatatggccagtctgacttgagatgtgctgagagtataaaaaggccactaggttttggagacttaatatgaaacaatgaatatatatctcatttacatatatgtttttatgttgattacacatcaaaacaatgatgtttggctatattggtttaaacaggtggttctcaaccaggagtgattttgctccctgggagacatgtggcaatgtctagagacattttttgttgtcacggctgaggggtgggttgtcgttagtgggtagaggccagggatgctgttgaattttcccataatgcgtaggacagcccccgtgacaaagaattatcctggctcaagtgccaaggttgatagtccccgatttaatggaatacaaagtgttttgctcatgcttgagtgatcctatcttaggttaataaatgtgagtgaaatttgttgcatttttcttttacggagcacactttgtgcttttaccattcatactaggggagagtattccaagaatatttgcatacccttaatttttatcttctgctgttctacaggctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtactgtctatacaccaaaggcagccaagcagccaggcacctactttagatccttaaaaatagcatcatgtcttgtgtgtgtgtggctccttgctaaggcacatgcttggcagaggcggcagcttctcatgacggcaggatataaatcatattagatccctgaaaaaggccaggaccagcagaggtcaacgttcgctatttagaaatagagagtgaagaaaatcacaatggaaaaacagtcagaaacgggttgtgctaaagctaaacttagaattatcatatgatccaataattccacccctaggtatatgccccccaaatttggaaacatattcaaacagaaacttgtacagacatgttcatagcagcactattcacaataaccaaaaggtagaaccacccaatggccatcaacggacaaacagatggccaaagtgtgctctgtcgctacgatggaatactattcagcctttaaagggaaagaaatcctgacacatgctacagcatggatgaaccttgaaaacatcgtgctaagtgaaaaaagccagatgcaaaaggaggaatattgtgtttccgcttctaggaggtacctgagattggaaaattcatagagacaaagtagaatggtgcctatcagggtctgggggtggggggggcagtggggcgttatctatcatttaatgactatatagtttttgtttgggatgatgaaaacagtttggaaataaacaatggtgatagtttcacacattaggaatgtaattaatgccaataaattgtatacttaaaaatggttaaaatggcaaatttgatgttatatatgtaaattttcaactgataagaacagacactatacttgatcttagccagatagataaatagatagatacatagatagatacatacacactcacacagtgaaaaaatgggggtgggagcagcaggctgagctgaggatcttcagagctttgctccttcccgtccctgctgattggatgccgacgggccagcagagagctggtaatcatatagatagcaattggcctgaaataagtcaaaagggtttgaggcccattttgcctctatgtcgctgtgaaccttggcaagtcatttcattgctccaaagcctcggctcccatcagcgtagcatgaaggtgcatcacagtgatctgcttcatgatttctgattcctcagagagaaaagcaatttgcttgacacaaagcagtaagtctggaaatggtcaggatagcgatgtcatatattttcatgcctgattagcagtagtttaggatgggagttggcacactatggctcgcaagtgaaatccagcctgtcatctgtttctgcaaatttttatcagagcacagccacgtccattcatatatgtattgcccgtggctgctttcacgctacaatgggcaagttgagtatttgtgacagagaccctctggcttccaaggtcaaatatgttaactatttggtcctctatagtttgctgacccctgagttagatgatcacagttgtgctcttaaatgacgcagtcaccgccttttcagaaacagaaagaaaaaccttccgtataatgattaaacttaatttaaaacaacaaatgcccctggaaaaggatgtctctggttaacagtatccctgaaaagccttctgtctctgcattgaaaatctcccttccaggatcccatatgggtctggttcaacgggttgtaatttgaagacataccccaaagctgtctgtcctctcaaaagtgtcggaagttttgatagcaacacatcatgtatgctgcagaaattgtttctcagctttccagcttttcaatgtttaaagaactctaactaagatgtcctgcttcccttctccctttgtttttctcattggcatttaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttcctttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttcatagtttgtatgtatcattgtggagtaatatgttttgacggagtgatgtgttgcagtacctgaaaatgtttgctactttacgattataggccagcatacaaaattacagaaaagccagaagttaattgatgtcagctgttttccattttgaaggtgtttcttcctgaagaacttaccagcaatcgcctttcctcaaagcgtaacagctgtgccacataaggtgtccacgttgttaattccacatgtttcctataaaattaaagatggtacagtgtgttcacgcatcagagtagtgatgttcaatatccatctattggagcaaaccaaacttaaatgtaggctgcataaaacttgttcatattcattgatttcagaagcaccgaggaggattcctgtccccatagaacagcctgttcagtgatacttcaaactactctcgtgagcgcaaagtcaagtcataattacgttcccctggtgaagctcagctgtaaagtatgtgtaacactaagaatggcaacatggtgtcttgaagtcacagtgaaatatgaagaattacatccaggtccatctgagaaaaaaggtgatcacagtgtgagagaacatgatagaatgtactagaaaggagggaagtgaaggagaagtgaaagccaaagacacttcatcagctttacaattgcacttaataatgctgccacacctcttcagagacgtttcatttcctatggcatgtcctatctaatcccctagctgaactacaggggacagggaagtagtgaagggaaagatggagtactaaggcgtgcagaggttggaatcacgctggggataccaggaagggctcggtgatcaccattagacggttcacgtcggaattttccagaaccctatggtgtgttccagtgtggactgacgcaggacagcagagggcgtttggtacatgatgtgtttgagcaaggatgtgccagggaagatgggagttaggggctgaaacatactcagctatcctgtatctaaattgcgtgaaatcaacagggctcctccttctcattaccaatatttatcttcctgatttatctccctgtgccccaggaacacatccctccaccttttttctgcccctgctttccaagatcacatcctgggtggtttcctttattgcagtctttgagctctgtttcctattctgaaagcataatgcccaggaacacagacttcaccacttaccggagtttaaaaaccaacagcaacaacgaccttgggctggttgcttaacccctatgcctcagtttccttacatgtgagatggggataataaatgagacgttatgtgtaaagtgtttagaattgcttggtttgtacattaacttcagtttttagagtgagcctcctgaaactcccctagaaagaatgtaaggtatgaagaggcaagattttcatgcattttctaggtgttcatcctagaggggaacacactgccctcctgccattttagaagggctacattgtcttggcatgtgactgcctcagtgaagggtagcatttaggtgacaaatagttgcatgttaaaaaaaaaaaaaaaaaaaacttgattatgctgaaagtagtggttctaccagcatgtcccgtggttccagcgctggttttgcccaccacattaacatttttttcgcccgagggccagcactaccaagtagaatatgcatatgcttttaaggctattaacctgggtggccttccatcagtatttgtcagaggaaaagactgctgtaattatcatacagaagaaatgcttgacaaattatcggattccagcacagtgactcacttactcaaaataactgaaaacattggctgtcactgtgatgaccggaatgacagaggtacagagggcacgctatggggcagctaactggaaatacaagtacggctatgagattcctgtggacattctgtgtggaattgctgatactactcagaatgctacaatgaggtctcttggttgt

SEQ ID NO: 17452 - DNA, 29977 bp, Human
cagtctgaaaaggctacatgttgtatgattccaactgtaagatattctagataaggcaaaactatagatctagacggtggttgcccagggctgaggagtgagggaaggaggaatgaataggcagaacatggcaggttattagagtagtggaagtattctgtatgatacaataatgatgaatacatgacattatgcatttggcaaaagtgacagaattatatgcacaaagactgaaccttaatgtaaactatagactttagttaataatagtgcatcaatattggttcattaattgtaacaaatgtaccacattaatgcaagatattaattagaggagaaactggttggggagatggagaataatgggaactccctgtattttctgttcaatttttttgtaaacctaaaactactgtaagaaataatccattaattaataataataataaatgtacagattcaccaagagtgtacacttctacttccactctctttgttgatgtatggtgacagaattttgacatacattcaatttgatggatcgagtttggtctttttctttttttgagacgtcatttcactcttgtcacccaggctggagtgcaatggcgcaatcttggctcactgcaacctccacttcccgggttcaattgatgctccttcctcagcctcacaagtaactgggattacaggtgcctgtcaccatacccagacaatttttgtatttttagtagagacagggtttcaccatgttggccaggctggtcttgaatgcctgacctcaagtgatccacccaccttggccttccaaactgctgggattacaggtgtgaaccactgtgcccggccaagtttggtattttattgttgtttggatttgcattttcctgcttattacccaagttgagatcttttccagattattggacttttcaagtttcctaattatgaattgtctgttcctggtttttgcctatttttccagttgattattggtcttttgattgtgaatttttgtttattgtgaatttgtgagacttaaaacatttttgcatattaattcttttttttttttttccagacagagtctcactgtcacccaggctggagtgcaatgtggggatctcagttcagtgcaacctccacctcctgggctcaagcgatccacctgccttggcctcccaaagtactgggattacaggcataagccaccatgcctggccactgtatattactttttaattttacaagttgcaaatgttttctcacgatctgtcactttctttctttccttccttcttctcttcttttctttgtctttttaaaatttgagacagggcctcactctgtcacccaggctggagtgcagtggcacgatcatggctcagtgcagccttgaactccccaggctcaggtgatcttgccacctcagcctccagagtagctgggagaactacaggtgcatgccaccatacccagctaattttttttttttttttttttgtgtgtgtgtgtgtgtgtgtggagatggggtcttcctatgtagcccaggctggtcttgaactcctgggctcaagtgatccacccaacttggtctcccaaagtgctgggattataggcgtgatccactgtgcctggccctgtcatttcttttctcagagaggataacaatttatttgtcctacagaaagttttaaatgttgaaggagattggcctggaaatatgcttttggggagcaacacggtctgagccagacatccagatacagcccattcttctggccagtcttgccctttgctcctgattctccaagctgtacccagagctttctggttcagcatgtacctggaggctgcttttgaccatgttttgagagtggcatggctttatctaatgggatgaacctggctaaagagattagcaaaatgtcttgtggatcccacttttaatctgcagcgttcaggctgccccttcttggctgggaagggcgctgaagaaacaacgcccaggaccaggactatcccctgctcaagctgtgattccgagacccctgccaccactactgcattcacggggatcccaggctagtgggactcgacatgggtagcccccagggcagctccctacagcttgggccatctgcacttttcccaaggccctaagtctccgcctctgggctcgttaaggtttggggtgggagctgtgctgtgggaagcaacccggactacacttggcaagcatggcgctactgaaagtcaagtttgaccagaagaagcgggtcaagttggcccaagggctctggctcatgaactggttctccgtgttggctggcatcatcatcttcagcctaggactgttcctgaagattgaactccgaaagaggagcgatgtgatgaataattctgagagccattttgtgcccaactcattgatagggatgggggtgctatcctgtgtcttcaactcgctggctgggaagatctgctacgacgccctggacccagccaagtatgccagatggaagccctggctgaagccgtacctggctatctgtgttctcttcaacatcatcctcttccttgtggctctctgctgctttctgcttcggggctcgctggagaacaccctgggccaagggctcaagaacggcatgaagtactaccgggacacagacacccctggcaggtgtttcatgaagaagaccatcgacatgctgcagatcgagttcaaatgctgcggcaacaacggttttcgggactggtttgagattcagtggatcagcaatcgctacctggacttttcctccaaagaagtcaaagagtgagtggcttccagtcctggggtcagagctatgaatatattggggacactgaggctcaggcctctgaccagcccctctccccgcacccagtgccttttcctctccatcgggtgcacaacttattgctgcgtatgtgagggtgtatcaggtggaaccatatgaaattgctaatattctacctctttgacccataaaaaatgacaacttcatagggttcaacctaacattggctaaggtggtaggaaggtatcaatttatataagctgtttggataggagccccttgggatgaagagccaggcagcaatgtgtgtccactttatacagagggatggaagtcattcatagatcacaaacactgaggtactatttggctatttgtcccattcattcaaagtagatggattcagtcccagaagtttaaatttcctagttagttcccttgttttccaacctttcaaccctgagcatccattcccaagatgtttgtctggatatgttggaaagagcataggaaggggaagtcatgagatctagggtgaagttttggttctgttgttcaaggtcttgtgaccttgggcaggtcactagtcactctgcgctttggcttgcccatcttttaaatgagcactggaatagaataggtaattttggaagtcacctcctagccctgcctggtagctggcatgcagcaggtactcattaaatgcttgctggtgtttacttagcgagtcatgatagtgcaatgtgataaagcatttctaaagtattcttggcatatgtaaaagtaaaatgctgcgatgggctgtgggaggtgctggtgagagagagactctcgaccactgtgtcggagggaacagcctgtgcactggctccagcgggctgctcttcccaacacacccaccaacctggggctcgagtgacttttcagggaaagggcagcctgccttgaggcagccgctttccctcacctcttctttctgtctgactcgaccctacctggctgaggttaggggttcagttattcctaagggtggtttttttttcttcccagtgaggctggcaagtccaaagggaacttgaactcagggcattggcaccagcagcaggacatgtttgaagcccaaaacaacattaatgacgcccaaatagctagcttatatctgccctgcagatggaagggacgtccaagtgaaggtcacttcttgggattttattttcttgtggatggagattactgctgcaaatccccagtcaggagaggattgtaaagggctgtgcccttcccaggtgacaggtctgcaggggcagcacaagatgccacgatttacataaatctcccgaggagggcatgaagccagggggacaagcagaattctggggagtgggagaggccgatggtagaaccagcctctgtgagcagaggctcacagagaaggggcttttcatcttttcctctatcatttcccttgattgtctcctgcatagagtcagttcttggacagatgtattcaaatctctcggtaactccaaatccccttttgtatcagagtgaaggaattatctaggtcactccactctcaatggtcaatggatccaaaatttcaggcaaatatttagctgaatcaaaactccttcaatgtcccataccaacttgttggtgggaaattttcctaactccactgacttggaaaaattcttctattacacgcacaaaaaatacagcagtaatattaaaagaagccaaaataggaaaacaaattcaagctagcttctcacccataacttgattaatgcctttagtttttctacatttcagtttcagtctagtcttgttaacatttacataatcatacagtgtaatgatagtataaagacaatttagggccgggtgcggtagctcacacctgtaatcccagcactttgggaggccgaggcgggcggatcacctgagttcaggagttcgagaccagcctgaccaacacggagaaaccccgtctctactaaaaatacaaaattagccgggcatggtgatgcatgcctgtaatcccagctactcaggaggctgaggcgggagaacgcttgaaccagggaggcagagattgtggtgagctgagatctcgccattgcactccagcctgggcaacaagagcaaaactctgtctcaaaaaaaaaaaaaaaaaaaagacaatttagtgttccattttgtaatctgatagtataacatttgcataatatccacaatgatcatgtttaatggttgcataagaagtccactgaagccaggtgcagtggctcacgcctgtaatcccaacactttgggaggccaaggtaggtggatcacgaggtcaggagttcgaaaccagcctgaccaaaatagtgaaacctcatctctactaaaaatacagaaaattagctgggtgtggtggcatgcctgtaatctcagctactcgggaggctgaggcaggagaattgcttgaaccagagaagcagggaggcgggggttgcagtgagccgagatcttgccactgtactccagcccgggagacagtgtgagactcgatctcaaagaaaaaaaaaaaaaaaggaagtccactgaatgaaagtacatgcttaggcaagcattcagatttttatttacctctattataagtaacactggaatgggcatctttgagcattttgcttctctctgtctctgtcttttatttcccttaggctaaatttccctgagaaaaatggacctttggctttaactttccacaaagtttgtctaaagacacaattagggctgggatcagtggcgcacgcctataatcccagctctttgggaggctgaggtgggaggatcacttgagctcaggagttcaagaccagcctgggcaacatgatgaaaccctgactcttaaaaaaaaagcccaaaacataaaaacattagccaggagtggtggcttgcacctgtggtcctagctactcaggaggctgaggcaggaggataatttatttgagcccaggaggcagaggttgtagtgagctaagatcatgccactgcacttcagcctaggtgacagagtaagaccctatctcagaaaaaaaaaaaatatatgaattagcacacaaatttcttagaactgaaatgcttttatccttttcaaaacctccagtgacctcatactgcagtgggctacgtgttcttccaagggtgcagtctgatagggccacctttgcagagagactttcccacagacttttatttttatttaattaattaattaataattattttgaggcagggtctcactctattgcccaggctggagtgcagtggcacaatcttggctcactgcaaccatcacctccagggttcaagctattcttatgcctcagcctcccaagcagctgagattatataggtgtgtggcaccatgctgggctaatttttttttttttttttgagacagggtctcactctcttgagatggtctcactctccaggctcactgcaactcccacctcccaggctcaagtgattctcccacctcagcctcccgagtacctgggactacagacgtgagccaccacatctggctaattttctgtatttttggtagagacagggtttcgccatgttgccctcaggctggtctcaaactcctgagctcagatgatccacctgccttgacctcccaaagtgctgggattacaggcatgagccaccgtgcctggcctctggctaatttttctatttttagtagagacggggtttcaccacgttggccaagctggtctttaacttctgggctcaagtgatgctcccgcctcaacctcccaaagtgctgggattccaaacatgagccaccgcgcccagtcccacagacttttacatgatcactgaacaaggcctgcgagggaagtgaggctcctgggattatgttcagaaagctgctcagagctgggttgcctgaggaccagtgcctgagaccagagcacagcccttatctgttggtagaaggaatgaaagaaggaatgaatgagagactgtggaatggcatttactcccacctccaaggaaaactaaaaaattttttctgttcatgttttcatggcttcattttggagggtttagtgagtttacatgacaaagctggctctccaaaacccttccctgaaaaatgtaagttatatttatttattttttgagatcacaagcactgagaaatggtaagcatttaccttctggattatctcggcagcaccccccgggctaggattctgatggcaaagaggtgaggccggcaaaagggcagggagagggaggttatcatccaccaagatccttttctttttgtatttgttgcccaggctggagtgccatggtgcgatctcagctcactgcatcctcgcccccctggttcaattgattctcctgtctcagcctcccaagtagctggtattacatgtgcccgccaccatgtccacctatttatttttttttgtatttttagtagagactgagtttcaccatgttggccaggctggtcttgaactcctaacctcaagtgatccaccttccttggcctcccaaagtgctgggattacaggcatgagccaccgctcctggccacaaaatctttttaaaagaaattcttggccaggtgcgggctcatgcttgtaatcctagcactttgggaggctgagacaggaggatcccttgaggccaggagttcaagaccagcctgggcaacacaatgagacttcacctctaccaaaaaaaaaaaaaaaaaaaaaaaagaaaagaaagaaagaaaagaaaagaaaaaaagaaaagaaaaaaggcccggtgaggtggctcatgcctgtaatcctagcactttgggaggctgaggcgggtggatcacttgaggtcaggagtttgagaacagcctgaccaacttggtgaaactctgtctctactgaaaatacaaaattaaccaggtgtagtggcacacacctataatcccagctacttgggaggctgaggcaggagaattgcttcaatctgggaggcggagattgcagtgagctgagatggcaccattctactacagcctgggcaacaagagcgaaacttcatctcaaaaaaaaaaaaaaaaaaaaaaaaaccaaccaaaccaaaccaaacaaaaaaaattagctagggcacagtggcatgcacctgtggtccctgctacttgggaagctgaggtgggagaatccgttgagcctgggaggtcaaggctgcagtgagccaagattgtgccactgcactccagcctgggtgacagagtgagaccctgccttaaaaaaaagaaaaaaaattcttttcttaaaaaaaaaaaatagagatagggtcttactctgttgcttaggctggtcttgaactcctggtttcaagcaaccatcccacctcagcctccagagtacctgggattataggcacccaccaccatgccaggcagaattctccttttttttgtttcccctctccccatcaaatttggatgagccaacaaagaggttcgggtgagcctctttctcctacttgacctgaggactgtggggaagcgatcccaggagaatgagctggtctgagcatgggtagcctggagaaaatccacagggatcctcctctgacacagactgggcatgggcggtgtctggtgacagtgatttccaggcatttctgcaggctctgttcctggaataactttccattctgtgcagtgggcacttcaccggactgggctagagaaagttgaggtcctcactttctggcatcttcagtccagttcctgagaggaggagctgggtgcttgcattctggcctccctaggacctccccacttgtgcccctccttggggccccccagaaacctgaggatagagtgcattgcctcagtaagcatggaggggcgggcaggttttggagatttctcaggggaatctttaagatccaggactggctcctgaagattcctgatctaatgaataagatcaggcagaaacaattccatatttttatgggaatttacaagagttttttgttttgttttgttttgttttttgaaatggagtctcactctgtcacccaggctgaagtgcagtggcacgatctcagcttgctgcaacctccacctcctgggttcaagagattctcctgcctcagccacccaagtagctgggattacaggcgtgcacctccacacctggctaatttttgtatttttagtagagacggggtttcaccatgttggtcaggctggcctcgaacttctgacctcaagtgatccgcctgcctcggcctcccaaattgctgggattacaggtgtgagccactgcacctgagttttggctgctctgtcttaggggagtagcccagtgactgcaccccatccccaacctgcctatgaccgtgttgccaagtcatttgggagggggaaatgacccacatttatcctgcacaaaactcctcctgggaagtttttgtcttaatcttttttagtttttgtttgtttgtttgtttttttgagacagagtcttgccccgtcacccaggctggagtgcagtggcacgatctcgactcactgcaacctccgcctcccgggttcaagcgattctcctgcctcaacttcctgagtagctgggattacagacatgtgccagcacgcctggctaatttttgtatttttagtgaagatggggtttcaccatttggtcaggctgctctcgaactcctgacctcaagtgatccacccacctcagccccaaagtgctgggattataggcgtgagccactgcacccagctggtattattagctccattttatatatgagaaatctgaggcccaagaggttaagggacatgtctaagatcacacaataggaagtgggggagacaaaaaaagaaaatcagcttcggccacatgtggtggctcacacctgtaatcccagcactttgggaggttgaagtggatggatcacttgagcccaggggttcgataccagcatgggcaacatagtgaaaccccatctctacaaaaaaatacaaaaattagctaggtgtggtggtgtgtgcctatagtctcagctacttgggaggctaaggtgggaggatcacctgagcccaagaaattgaggcagcagtgagctgagattgcaccactgcactccagcctgggcagcagagtgagaccctgtctcaaacaaaaagaaaaaacagctttattgagatataattcactcactatacaatgtacccattaaaagtatgcaattcaatggtttttagtatattcacagtcggacaaccagcattacaatcaattttagaacattttcatcacttctaagggaaaccttacaccatttagctttcactccctagccttccctccccctagccctaagtaaccactcgtttactttctgtatctatagatttccctgttctggacatttcatatgaatgagtcatataacatttgtccttttgtgtctgccttctttcacttagcatagtgttttcaaaattaatccatgttgtagcgtatatcagaacttaattcctttatatggtgaaataatattccattatatggcatgtcagattttaattctgctcttttcaccttactctcctgtttcccagcgatgttaaagtacctcttgcatacattcggcattaaatgaatgtttgctcactgagtgacagaaacctcaaattatccaggctgcttggggtacgggaagtcttgcttttctccctcttctccctgtctttccctgtcttttttttttttttttttttttttttttgagatggagtcttgctcagtcacccaggctggagtgtagtggtgtgatcttggctcactgcaaccttcgcctcccgggttcaagcgattctcctgcctcagcctcctgagtagctgggattacagacacccaccatcacgcccagctaatttttgtaattttctagagacggggtttctccatgttggccaggctggtctcaaattcctgacctcaggtgatcttcctgcctcggcctcccagagtgctgagattacaggtgtgagccaccgctcccggcctttccctgtcttcttcttctccatttcctctccaagaaggacagggaaaggggtgggcagagatgatgcagggttggaaaacatggatggattaggttcggattccagtgcttctgtgccaacgtctcagataataacgaggtggccccacagaaactagaaacaccattccgggctctgcggcgcctgtggtaaatggggctgtcactgggcttcaacctcccacatctccctcccctggcctggtggtcctgggtgggccaggaagagggggacacacttcctgctacacttggaggaggctctcagagggaggagccaagtccaggaatgctgtctccctcactgactctgtcttttcagagcaaggtatcagtgaaagagatttgtagttctttctctttttttttttttgagatggagtttcactctgtcgtccaggctggagtgcagtggcaccatgtcggctcactgcaacctctgtctccagggttcaagcaattctcctgcctcagcctcccaagtagctgggattacaggtgcccaccatcatacctggctaatttttatatttttagtagagacagggtttcaccatgttggccaggctggtctcgaactcctgacctcaggtgatccacccaccttggcctcccaaagtgctgggattacaggcatgagccactgtgccaggcctgtagttctcaactgatgctcttttatcttattttattgcatttccgacttctattatagaaaaaactcaagctttcacaaaattagagagttcattataattaattctcatgtagccatcacctagccaggtgtggtggcaacacacctgtaactccagctacttggaggctgaggtgggaggatcacttgagcacaaggtctctaaaaaaaaaaggaaaaaacaggctgggcacagtggctcatgcctgtaatcccagcactttgggaagctgaggcgggtggatcacctgaggtcaggagttcaagaccagcctggccaacatggtgaaaccccgtccctatcacctagccatcacctaggaacaaatatcaatattttgcctgtttcatctatactaccctcccccaaacacattttccccttctgaatatcctaaagcaaatcctggacatactttccttttacctgtaaatactttaataggcatctccaacagataaagaggctttagttgttttttgcccttttgtttctgctgaacataagcacaagaccagtcatagtcaacagatttaatggcaatatcaatcaatacccagtctatgttcagttttccctgatagtctcggaatgctttttacagttggtcaattcaggatccaaaccaagtccatgctttgcatttggttgtttggtttcctgtctgttttactagaaaactgtcccctttttcataccatatgtgtgagagaaactgggccacgtgtcctgcagaatcccccatagtttggagttgggcaattgcagccaaatggtgttgtctaacttgttcttctgtcccctgtatttcctcataaaccagtagtctgggtcgaggtatggttggatcaggctcagttgtggcaagaacatttcctacagtgccgctctgtgtatcttaccgtagcacatgaggaaggacatgaggtcttcagtcagtttacaacacttcttttaaaggttgcaggatgagcagagctgcagtgtcttggggtgagaggtagaacatgcgggagctcagacattttggaaccaggaactaccagccaggaaggcccagcctggggtccccagtctgagggagaagctggcaccaagctcttgctcttcaccattcttcccagggaacccacagactacaggtacctgcttgctcttcttaaacaattcgtagacatctcaaggagaagattagaacttgactctatggggtttctcccctctcagacgggaactctttgaagagagctgtgtctccccttcaaattggggcttcctgagggctgggctatgtctcccctcagaccagggctccctgaggatggggctgtgtccccctcagaccggggctccctgaggatggggctgtgtttccctcaaactagggtcccctgaagacagggctgcatctcccctcagactggggctccctgaggacagggctgcattcccccctcagactggggctgcctgaggacggggctgtgtctcctcctcatgtcacccctcaccgtctagtacctcacactcagtgacttattttcttacttcactgtgagctgctataacagaatacctgagtctggataattgataaagagtagagatttatttcttactgttctggaggctgggaagtccaaggtggaggggcccgcatctgctgaggggcccgatttcatccttttcctcaggaacccactcccatgataatggcattaatctactcatgagggcagagcgcttgtaatccagtcacctctcaaaggtcccatctctcaccactgtcatgctgggcctcacgtttccaacacaggaactttgggggacacattcaaaccacagcactacacaaaaaagcaatcatcaaagcatactaagcacatagtgtgtaccaaatgctccacgtgtatgatcccatttaatttccaccatcccctgtcgagtgtttaaaatgtcatttcttagatgagaaaactcaggctcagagaggttaggccagttctcaaggtctcacaggtgtccctcagccagcgttctgcttggcatgacccactgtcaggtatacccctgctcattgccctatggctggctttactaatttgattcacttactaaattatgttggtttttctggaaaaactcagacgtgatcattttcccaggctctttgtgccttgcttatgggagagtggcctagaacatagttcttatcttaatcaagaccctttcaaaccctagtgactcctcctccaccgcccccggccccttccgcgcagagtgaaattcgtagcctgggaaacacgctgtgatataaatagccggctcaccactaaggcgctctcctctgcctggctttgtcttaagagggtgagaggagccttaatctgtggttggaatgagggcaagcactgagtaaacaagatgatgtttggagtgggggagggatagctccagaagtgagagaccccaggagttcccaggctggtgacccaggcaggtcccaacgttcaccaagcttggccttttcccccaggctgacctggatgttgcccctgggaatacactgggaagttcccagtatgagggagacgcagccctgtctttaggaagccccagtttgaggggagacagccccatcttcagggggccccagtctgaggggagacacagccccgtcctcagggaaccccagtctgatggggagacacagccccgtcttcagggagccccagtctgagggggagacacagccctgactcagggagccccagtgtgaggggagacagcctggtggagaccattagggtgacttgtctgggggctcagggaggcgaggtggggagacggggaatgtccgcaagcccagcctgcagactgagggtggctcagagcctctgctggcctcagcccacacagttttaggcctgaccctcacatcacagacaccttagtgtgcatgaggcgggtgtgcaaggtttgctccaccttagggccacctggtaggtacctgagggtaggtggtggtggctaggaaaggactcctgggacagggaagaggggagaaaacacacagttttccaggaaatttaacttccaggcctggaaacacctggctggaaagggccttggccaccagtgacctgtaagggggagatgaggttggtgagggagctggggtgtcaccaatggcagccagatgctcgtccatcaacggctcccatcctgctgctcctcctaccctccaggcatgaccccaaggaagggcctggccccacagagtggttgggtgaatttctatattccctattgacttggtcttggattaccatctacctcaaccctctaggccataagatcgaggaaggcaggggcatttattcactgctctgtcttcagcgcctagaatagcagctggcaggtagcaggtgcacagcaaatatttatcaagtgagtgaatgaatgaaaggtcaagtcaggagggacaagggaggtggggaactccaatgggaccagtgggcaactgctgtgggctggacccaagtttttttttttttttttttttaatttgagacagagtctcactctgttgcccaggctggagtgcaatggcatgatctcagctcactgcaatctccacctccctggttcaagtgattcttctgcctcagcctccccagtagctaggattacaggcgcccgccagcacgcccggctaattttttgtatttttagtagagacggggtttcaccacgttggccaggatggtctcgaactcctgacctcatgatctgcccacctcagcctcctaaagtgctaggattacaggcgtgagccaccgcgcccggctggaccccgacttcttgtgtggctttgggcgaggccttgccctcctctgggccccacttgctcctctgtaggacaatccgatggttttccaggtcttatccaatggctctaagcggaaggagggacaacattttctgaggcctccagcatgtccagcctgtgtcaaatgcgtgactcgaattgtctcatttatatcccccataacccctgagaggcagctgctatcactcccagctcacgcaggtccacagagtttaagctccatggctcccaaatacatatttaggactcagtggtgtgctttcaaccacccccaccctgtccacaggacactggcaatggctcagctgggacactgtactgaggggaaggctccagggacagcctgtaggtcaggaggtgggacagacagcatttgggttgggaggcccctagccttgaggaggacactttggggaaggtcttgggggaagaagggagagaccactgcagagatgccatctgctcagtgtgtccagggctactggcccctccagagggccagtagaggggagcgggaggcccgagctgaaggcccccctcacactgctccagcttgtcttcccacccctgccccacttccgtcaccaacagcccggtgcccagagaggggctgcagaaggacagctgagcaagacacagtttctgccttccccacgcacatggctggagtggggctttgagtggtgggcaggcagtgccagcgggcaggtgctccgtgtcaggcccaccatggagggtggcccgcacgatcctgccctcaaggagctgacagcttctttgccacagctggtagaacctgcacggccaactccccagggagggctctcccatgatatgatatggcgtggtgggctctgttcttacaacctgatgtcagctcccaggtgctcagagtaccacccctgatggctcttgctcggccacctgcccagtgaggtggcttttgctcacagcgcatggctactatgtattaataccagcactcttcaagcactcttacatgtatcacttcatgtaatcctttgtttcaaatataaggaagcagaggcagggagaggttaaggaacttgtccagagggatggagctggcatgtgggcgagccaggagtaaacccaggctgtccggctcttgtcaccgatctgtgctgcccatgccacccagggccatgtggtctctgggcagtgtgttctgcccacgaagtagagggcagggattacagggcgtgtggaaacatggttgccatgacccaggccacctcatgcagcccttctagaaagtcttaatcataataggcggaagtcaacatggttcatggaaatggaaccaccagtggcccttgagcacaccaaaagacgctcaacttcactcataatgagaaaaatggaaatgaaaacaactctgagatactgtttttcaaagattaggttggcaaagatcaaaagtctgacctgtgtggatgtggctgtggaggacaggttctcctgagcatggctggttgggctttgtgaaccgcgcccccacctcagcccccagcaggagagaccagaggagaaaaatggcaggtatctggcaagatcaccctttgatgcaaggatccatcttcaaggaatttacctgctccatatagtcacaatatgcaaaatgactgatgtccatgtttgtattaacgagagactgggaaaaacccaaacttccatcagtctggaactggctaggacccatgtgccatccacgcaatgggaataccatgcagctcattaacaaacaaaaatccaggacactccacagacagatacgaaaatatctcagccgagcgcagtggctcatacctgtaatcccagcactttgggaggctgaggcaggtggatcactcgagatcaggagttccagagcagcctggccaatatgacaaaaccccatctctactgaaaatacaaaagttagctgggcatggtggcacaccactgcactccagcctgggtgacagagcaagactccatcccccatccatgccaaaaaaaaaaaaaaaaagatctccaagatattgctaagggaaaaaagaaaggttcaagacagtatgtatataatgttctaatttgcagtaataaaaaaagaacaggaaaaatgaaaacatgtttgcttgtccatgcatgaagcctctctctggtggaactggccatagcggtcaggacctggaggctgagagatgaggagtgagaggcattttatattaaagagattttatttagaagcaaaagatggacatcttttaagagattcgtgaccaattcaatgaacattgtttaaaataatctctattggaaacagttatgctttctattatgttctaaaagtctattatgtaacgcattcttcgcgtgcaatttttttttctttttcctttctttcttttttttttgttttttgagacagagtctcactggcgtgatctcggctcactgcaacctctgcgtctcgggctcaagtgattctcgtgcctcagcctcccgagtagctgggactacaggcatgcaccacaacgcctggctaatttttttgtatttttatttttatttttttattttttatttttattttttttgagacagagtctcactgtgtcgcccaggctggagtacaatggcgtgatctcggctcactgcaagctccgccccctgggttcacgccattctcctgcctcagcctcccgagtatctgggactacaagagcccgccacaacgcccagctaattttttgtatatttagtagagacggggtttcaccgtgttagccaggatggtctcgatctcctgacctcgtgatccacccgcctcagcctcccaaagtgctgggattacaggcttgagccaccgtgcccggcctgtatttttattaattgtagagatgaggtttcaccatgttgcccaggctggtcttgaactcctgacctcaggtcgtctgcccacctgggcctcccaaagtgctgagattacaggtgtgagccactgcacttggcctacatgcaactttttcttttttttttttttgagacggggtctcactgtatcgtacgggctggagtgcagtggtgtgatcttggctcactgcaacctcttcctcccgggttcaagtgattctcgtgcctcagcctcccgagtagctgggactacaggcgcgtgccaccacgcccagataatttttgtatttttagtagagacggggtttcaccatattggccaggatggtctcgatctcttgaccttgatgaagatctgcccatcttcgtctcccaaagtgctgggattacaggcgtgagccaccgcgcctggctgcaactttttatttagatgacaagcacccagtcaagtgcacaaatatatatatatatatatatatatatatatattttttttttttttttttttttttttagagaaagtcttgttctgttgcccaggctgagagcagtggtgtgatcatagctcactgctgccttgaactcctgggctcccgcctcggccttacaaagtgctgggattacagacatgagccaccatgcccagccaaatgcacggatcttaagtgtgcagctcagggagttttgaccataaaacacctgggtaatcacccccaggctaggtagaacatacccagcctgcctgaggggaaggggagacttttcactgtaaagatcccttttgaattctgaacctgtgtgaatgtatggtaagcgctaaacaaatacacacaaaaatatagaagtgcagaagatatgctgggagccccgcccatcagcctggagaacctgcttgcagctgtgtcccttaggtgagtcaggagctcccacctggctgggggtggagtcctccgagggcaaggactgtgcctgcctcgggtctccatcccctgcctctgcacaggccctgggactgagcaggccttctggaaacacctggctggaaagggccttggccaccagtgacctgtaagggggagatgaggttggtgagggagctgtgggcatcaccagtggcagccagatgcttgtccatcaacagctcccatcctgctgctcctcctacccacctatgcaccaggcatggccccaagaaagcgcctggcagcacagagtggttgggtgaatttctatactccctattgacttgggtcttggattaccgtctacctcaaggtcgaggaaggcaggggcatttattcatttttttgtcttcagcgcctagaacagtgactggcacgtagcgggcgcacagcaaatatataccaagtgtgcgagtgaatgactattctaggtttccagaggcaggggttgggaggaagtggcccctgttgagaagcccgggaagcccatctccagctgtctgtttccctttaagtcgaatcaagagcaacgtggatgggcggtacctggtggacggcgtccctttcagctgctgcaatcctagctcgccacggccctgcatccagtatcagatcaccaacaactcagcacactacagttacgaccaccagacggaggagctcaacctgtgggtgcgtggctgcagggctgccctgctgagctactacagcagcctcatgaactccatgggtgtcgtcacgctcctcatttggctcttcgaggtaggccctgggccagctgggggtagagggtaaggagagcctccggtcccatttgggtctaatgggggcggagccaggcttggagagcatgcctccctctttggaaacagccttcagtggagctgtgggtcagatcagtctgggcttgaaccccacccagggcctccaccttttgtatttatttatttatttatttattcatttatttcttttttggtttctttcccaccacttaaatttattttttttattttttttttattttgaggctgagtctctctgtgttgcccaggctggagtgcagtggcatgatctcagctcactgcaacctccctctcctgggttcaagggatccttctgcctcagcctcccgatagctgggactacaggcatgtgccaccatgcccggctaattttttatatttgtagtagagacaggttttcactgcattagccaggatggtctcgatctcctgacctcgtgatctgcctgcctcggcctcccgaagtctgggtttacaggtgtgagcactgcacccgaccgacaattgtttttttaattgaggtgagatttataaaaggtaaacaatttggtgtcatctagttgatttacaatgttgtgcaagcacctctacctagttccaaaagacttccatcagcccccaagaaaatctcacacccatgaagcagtcaccacctcccaacctgccctccagcccctggcaactgttctctggatttatgtattttggacatttcatataaatggacccatattacgtttggcttcttttagttagcatgttttggaggttcatcctgtgtccccactttttggtaccgaggtcttagtcatttaacctctctgttatatggggtgacagcacttagctttggggactattgggaggcaacatgaacagcatgtgcaggtgttcaggaaatgggtactgtttggatttgtgcttcttgggatgctggtcctcatttacctgttagtctagttatgtgtgggttcatcttatctgcaacgctcagtttctctgtagctatagggcttgcaatgtaagcaaatcctcggtgagtgtgctgaattcgctctttggttaaagagatattcattttttatttttattattttaaattgtttattattattttttttagagacaagaagaaaaattcacctgtcgcccaggctggagtgcaggggcatgatcgtagctcactgcagccttgaactcctgggctcagggctcttcccacctcagccttctgagtagctaggactataggcacatgcagagtagctgaaaacaggtgccctgagtcatactccgtagagtcttctgtagaaatggggtcttgctatgttgcccaggctgctctctaactcctggcttcaagcaatcctcttaccttggtcccccaaagtgctgggattacaggtgtgtgccactgcatctggccaagagatatttctttctttttttttgagatgaagtcttgctctgtcacccaggctggagtgcaatggcacgatctcagctcactgcaagctccacctcccaggttcaagcaattctcctgtctcagcctcccaagtagctgtgattacaggcgtgcaccaccacgcctagccagtttttgtatttttagtagagatggggttttaccatgttggccaagctggtcttgaactcctgacctcaaataatccaccagcctcggcctcggcctcccaaagtgctgggattacaggcgtgagccaccacacgtggtcagagatatttcttaaacatgtacccatatgccaggcacagctcaggtgttgaatgagagcctgttagtaaatgaggtggcatggtgactcagggtagctgctttgagctaccttgagagcagaaaatccaaacttcaaaatcccaatgtacaaagccaggaagatttggtgaggaagctttttccattgaggagattcccaaagattcctttaaatgagtcactgtcctaatgctatcagccagtgcatcctgcctgtggctgataaacacctcctctaactcaccacatgaaactaaagggtgactgtatgtccaggaagccgcctttttttttttttaagacagagtttcactcttgttgcccaggctggagtgcagtggcgcgatctcagctcacggcaacctcagactcctgggttcaagtgattcttctgcctcagccccttccaaatagctgggattacaggcgcccaccaccacgcctggctgattttgtatttttagtagagacgaggtttgaccatgttggctgggctggtcttgaattcctgaccacaggtgatcccccaacctcggcctcctaaagtgctgggattacaggcgtgagccactgcgcccagccgaagccttcttttaatgctgaggcaaacacagcatattcatgactatttattggtcgctgactccttgacacagagtcttgggtgggtagaatgaggagaggaacatactgctggaaatttagatggccacattccctgaaaacacacaaaaagaagactgaatataaaagaagtcataaaagttcactagcattgagctcaggagttcaagaccagcctgggcaacatagtgagccctcatctctactaaaaaaaaaaaaaaaaaaaaaaaaaaaaaaaaaaaaaattgctggacgtggtggcgcatgcctatagtcccagctactcaggtactcggatggccaagatgggaggatctcatgagccccagagatggaggcataaaagaagtcagcggagccaggagcggtggctcacacctgtaatcctagcaggcattagctaggatttgggaggctaaggcaggaggatcaattgagcccaggagtttagaccagcccgggcaacatagcaagatctcatctctacaaaaaacacaaaaatgacggccaggcgcggtggcttatgcctgtaatctcagcactttgggaggccgaggcgggggatcacctgaggttgggagtttgcaaccagcctgaccaacatggagaaaccctgtctctacctaaaaatacaagattagccgggcctaatggtgcatgcctgtaatcccagctacttgggggctgaggcaggagaattgcttgaacctgggaggtggaggttgtggtgagccgagatcacgccattgcactccagcttgagcaacaaaaacaaaaacataaaaattagctttgtgtggtggtgcacacatgtagtcctggatcctcctggctcaggcaggaggatcacctgagccctggaggtcaaggctgctgtaagccatgatctcaacactgcactctaacagagccagactctatctccaaaaaaaaaaaaaaagaaagaaaagtcagtgggaaaatgaatggggttccattggcagcctcttagtggccccacctttacaggaatctagtggactgcattagacaaggatcagcttattgggaagagggcattcaaatgccccttttacttggggcctttaatggacagaggtctgatgggccaagggtggctgagcataatgttaagagtctgatcttggctgtgcctgcctaggcttcacaatccagtcaggagatgatgtctaatttatgagccaaagggaggatcactaccaagtgcaaaactcacagtgcagagagcctccttcaggaacgcaggaggggatcagagtggacgcgttcacatcaagaggacttcatggaggaggtgactttttctgctgtaaaaatatttattcaacttccagttgacaatagcagtaacataaatctaaaactctatcagttattattatctactgccataattataaaatgtcccagagcattcattcaaaagagatttactgaggccctccccctacctggtactgttctaggtgctgggattctgagtgagccagatgagtcagggccatccctgccctcagggagcagcttcatcctcttgtagagtttgctatgccatacaaagaagtggaggagagcaagccgggaatttgtacagaaacaagtggctaacggaatatacggaatatattatagaaaaatgaaaacagggtgtggtggctcacgcctgtaatcccagcactttgggaggctgaggcgggcagatcacctgaggtcaggagtttgagaccagcctggccaacatggcgaaaccttgtctctacaaaaaatataaaaattagccaggcgtggtgccaagtttttgacgcctgtaatcccagctactcgggaggctgaggtaggagaattgcttgaacccgggaggcggagattgcagtgagccaagatcgtgccactgcactccagcctgggtgacagagcgagactccatctcaaaaaaaaaaaaaaaaagtgaaaacaataagctaattatcagctacagctgactcttctgctcttctgttggtccttactgtgcactaggtacagtggtggtgtttgctggagtgcagtggtggagtcatggctcactgcagcctccatctccggggctcatgagatcctcccatcttggctacccaagtacccgggtagctgggactacaggcacgcgccaccacacccggcaattatttttatttttatttttagtagagatgaggtctcgctatgttgcccaggctggtctcgaactcctgagctcaagcaatcctccctccaccttggcctcccaaagtgctgggattacaggcatgcaccattgcacttggcctgtgtgttttacacatattaaagtggcacagtatccacacggggtgggcaccacttcatctgaaaatctgcaaaccggatgaataaagtgaggtttcctggtcacacggctggctaagtgcccgggtttgaacccaggcattttggcaccaagtctgccacacagtgaatgctagtgaacaaatccaaattattttttaccaccatccattcatcactgtgctcatcaaaataatggaagggctgggcacggtggctcgcacctgtaatcccagcactttgggaggtcgaggcgggtggatctcgaggccaggagttcgaggccagctggcaacatggggaaaccacatatctacaacaataacaaaaaaaaaatacaaaaattagtcaggtatggtggcaggcacctgcaacgttagctattcaagaggctgatgcatgagaattccttgaacacaggagatagagtttgtagtgagctgagaccacgccactgcactccagcatgggtgacagagtgagacttgtctcaaaaaaaaaaaaaagtaccacacatcagatgcagaaaaggaggtgacctcttaattccacccaaggcagttactgaactacccaatatgtgccaagcaatggggtgtagaggtgaaggcacccaggaataatgcacctgggatgggggcgacccgaggggatggggagggaggatgagctgcaggggagctcaccaagggctgaagatgaattaacagatgaacgtggagaggaacaaggttctaggcagagagcatagcagatggtaaagacctagaggggagaaagtatggggcatgggcgaatccgaagcagcccagggtggctggaaagggaggaggagaggggtctgacatgaggctggagaagagtcaggtgtgttgagcactgaggacagggcagcgtggggcaggctgtcaccaacccacactgcacagtgctcaggttgagtcctctctgggaccctcaatttgaggctcctgtggtttcctaatggtccagctcccagcgattctcccagattgcctctaaatctcctctcccaccaccaggtgaccattacaattgggctgcgctacctacagacgtcgctggatggtgtgtccaaccccgaggaatctgagagcgagagcgagggctggctgctggagaagagcgtgccggagacctggaaggcctttctggagagtgtgaagaagctgggcaagggcaaccaggtggaagccgagggcgcaggcgcaggccaggccccagaggctggctgagggccctggggcccctcccctcccgaacactgagaaatagtgcactccaagaaacgtggatctccccctcatccaactccgaaagtctgaatctcccaaggagggcaccatcttacagagactctccctgacggtggaatttaaatttagggtccctaaaagcatttgacacacagttgttgaatgactgacccaaaatgtgaatgaagctaatgtgaatgtgagtgaagctcccttcaggcccgctgccctaggatatgccctcctggtgactcgggggctgtctcagacgactagcccaggacccatctttctcacacggatttagtcccaccctatggccactggccgtatctgagggctgctccccttttagaatttacctcttatgagctccatgttgcttcactctatccaaagtgtcacttggtgcataagcacagaaatctgaaaaatggccatgttgtcttttttttttttttttaatgccaagattgacaggttggccgtttgcttaatgccagaagttgggggaaagttacacttttctaagaataatggactcttaaggcattgagggctctaaacaggattctttaatcatggagcaagagaatttcaaggcaggggattttatcccccaccaaaaacacagtgaaaggcctgcttttgtgtcccattcacatgccctcggtcactgagtctggagtgaaccacgggttgaggaagtcaggctgttggcgtgtcccagcaccacaccatccctaaagtgccaggtgatctcctgtggctcatcggtggaagcagtggggtaggctgctgccctgctgtggaagaggagcaacaatcagacatgagtccaccctttggagaccaggcctcagctcttggtgggcccagggacacccacacaggtggccatcacagccccatggacaacactaattgtccacagcaaagggcaaggaatcctctgggagcttcttccgtttcttccccccagatacccatcttgaaaaacactatttctggaatgcttctgcatcaaaggagattctttgagatagcccatcttcctgagctagcaaatacaggagttttcactttctttaggaaagagaagctttcaggggaaggagagaatgattttgctgacttcccaagccctggtgaccagaccaaggcagggcccagcataattcctccagttggatgaacattcaagagagctcgttcctacctggctggagaccgaggccagaaggcaaaaaccagaaagggaacagtccataacttacctctgcttctgaccgatggtgtttgggaataggttactttggactgagtttgggttctttgctgtcctaagaactttagtgtagagaaaataagacttctggtgctgctggggtatgttctgggcttaattcccccaagcagaagaccagatccaagatgtttggacaccctgtcagacgttggtcccaagtttaattagatttctgaatctcgttgaggccaaggaatgatccatactgaaaaaatgctgagccagccatctttggcaaaggtccctgagctcttgctatctctcaagagtgctgagaaccacggtgaaagtgctgctctaggcccacaagtgtaactatgctgttaacagctgtcaatagataattaaaattcatactgtatgaaaatcacttttgttaaatgactgtttaagcccattcaacaacatatatcagaatcccctactaccgctagtatttgccaaaaaagaaaagaaacccaccctaagggaagcattggtaacaatcgttgttataaacatggcttgggtatcacatctctccatcttgccatctcttacctgtaagaacggtgactattacaacagtgactattattatatccaaataatctcagcatttgctggagtttgaaccagagctgaatacatggaattttaatgtagaaatttaggcaaaactccaagccattttttcttctcctctggccaaaacgttatttcctcaaacagggaaatatgagtctctatggggccaggttataggagcaaatgtgaacaacctgagaatctgaaggttgttgagaggaccaagagtgcattgactctacaataaatctcactcattggttcggagcaggcttagggttaactgcattttaacaggtcttctcaggtagccggtagttgcgagagaaacctggaccatcccttttggtcacctaccagtgcccaggaagtctctgctatcaggtttttgcttgtgtgtaacttcagtctttccttgggctggtgtaaatccttttctcctgagggacccagcctacttttttttttttttttcaaatatggagttttgctcttgttgcccaggctggagtgcaatggcatgatctcagctcactgcaacctccgcctcctgggttcaagtgattctcctgcctcagcctccctactagctgggattacaggcgtttgccaccacgcccggctaatttttgtatttttagtagagatgagatttcaccatgttggccaggctggtctcgaactcctgtccttaggtgatctgcccgccttggcctcccaaagtgctgggattataggagtgagccacctggcccagctagcttttaaagttctgccagcatagccccgggatggggtgggggtagacagggccttaggactttcatttttaaaatgctcactccacagtgaagaaacaggtgatgactatcctgaatatttgggaagctgtgtcctagaatttttggcctcagttccagaacccacagcttctttacaacatgcttcaagcctgggactgagctgccagtaaataaacccctagtaaccttaatatgggttaataagattaggtgcccgctctgcacgctcccctgcccctcctcgtccgggcacctgttacgctaggccagcatgtttgcagcttagccagggaaaatcgtggaccaagacagggcttttcatccacgactggctaaaaagatggctctcaatgacagcgcaggcaggcagcaccactgtgttaggaagagaaaagtgtctgtccaatactatgaaagtccagggaagagacaagtgccttcccaggtcacaatggatagattggctggaaggggaaaaacatgtcagttcttaactcctgacagcattttatcctgtccatcacagaggactgtaaacagcaaagttacagattagagaatgctgagctctcaggatggcatcaaatggaggattaagatgtaagggacaacttctagctatttacctgagggaagtgaaaattcaggtttgtacaaaaacccatccatgaatgtttgtagcagtaatcaccaaaacaatcacccaaactcacccaaatgcccttcatctggcaactgcccagaagtctgtacaacggaatgctactcagcaatccaaaggaacagggaggacccgaatgcattcttctttagtgagaagccagactcaaaatgctacatatgatacaattccatttatataacattcgggaagagacaaaacaaagggagagaaaaacactggtagctgaaagccaggatgaggcaagaagctgactacaaaggggacttttggggaagatggaattgttctatttctcgattgtggttgtttaa

SEQ ID NO: 17453 - DNA, 56678 bp, Human
cctagtggaactaaggtatatatctcataaaaatgcagtgccagtaggtatcagaaagtaaggctactgatgtggaaaaaagtggttggaaaagaaatgatagaggaagcgagacttaacgtaaaatacgaagagtggttagaacttgattgggtttgctgggttagacaagaagagattggtccagcttgaagagagccttaaaataccaaaccaaataatttagattatatcttgcagataagaaaaaggcattggaggtttttcagtggaagggacatttagtgcaaataatgttttataatcttagtgctgaagttttggaagactagtgcattgctctattaaagaaaagttggggcagggcgtggtggcttacacctgtaatcccagcactttgggaggccgaggcaggcagatcacctgaggtcaggagttcgagatcagccttgctaacatggtgaaaccctgtttctactaaaactacaaaaaattagctgggcatgatggtgtatgcctgtagtcccagctactcaggaggatgaggcatgagaatcgcttgaaaccaggaggcagaggttacagtgagccgagattgcgccagggcactccagcctgggcggcaagagagacaccctgtctcgaaaaaaaaaaaagaaaagttggtacatctcccttcttagaagttaaactcaagactttacaggtacaaaaataagtttgttttatagttccttgttgtcaacaaaagtttacctactcactgaggatgggccccagcctatgttgtaaatgagtggagctggctgggaacgagagtggccactgagagagctcatgcctcttgggatcttgttgattgttaaaggttacaaactagatcaaatttttaaaaaacactgtttggcctcagtgaaatatgtatacaaacatagtttgaaacaaaagctgtgagtttgcaacctctttatagatagcgttcattattaaatctttattatattctatcataacatttaaaaaatacattatttaaaattgtgtacaaaatagaaaaatgtggcctgtttgatttgaagggttgaataagtggctatttataattttggatattttgactttgtgacttggacataaaaatattttccaaaactcttttcttacaggtaaaagaatgtcacatgtcagcatttgtacctgaagtcagcatgcaaagttcagggtacatggatgaatgccaacttttgcatttcccatgtgtatcctgtgaccattctatctggggtgagtgatttctaagagtagctggcaacaaaccagatgccagccagccatggactgccctaacaaataatgctaggagttataaattaaacactgatctgtgatctgtgatgtgtaaggcagttaatgtagttcatctggattaactgtcagcaccaaagaactatattcccataatgtgaaatctgaattctgtatgtttgaaagagagtaataattaacagtagggaatttttgttaacatgtaaaattacagcaatgtctaagattattttgaatttacagcagtattttagtggttcaccatataatttaaataattttaattttcagattcaaagacttagtatttcttgagtgatggttataattttgtataaaatacggctttttggattgtatatcttccaattgccttataatatagttttgcttcccatattgtatgcataacaatatttaggtttcttaaaaatacattagaaaatttatttataccagacttcacatttgtattttaaaacttgtttttttagtttcattctgagaaattacattgagggtagagcctgttcattaccttatccatgcatttttctgcttatttaaattattttacttcaccaagccattcatttttttagaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaaggtaagactaattttttaatgacctaagttatatggtagaaaggttttggttgttaatattggagatcttttttattgcaagcattcttttaagtaacttaattgaatttgattttgaaaattttccttagttttctgatggggaagagagatcactcatataaagatttaatgcaggctttatacctgtaatacctcatactgtaatattcatggcttatgatatttgtatctcataaaatttaccaaaaccaaaaagcacaatttgaactcatagggacatgggccattctgggacgttagtacgaaatatgactttgaaaatattttcaaacaggcatcatgttactacttttaaatcttttcaacaactcacaataggcctgtgagtgacacttcagaggaggtccttaggggatttggtttaacgttagttgaatgtttttgcaacacccatattcatttaaaaatcaatgttgctttaagtaattcatgcattctccctacaagcctgttttgcataacagctccttggctgtcgtttttgtcattcaacctcctaattttacaaaatattaatataatgcagtctcacatgtaccctgttctccatgtgcctaggacccattcctccctcgaagaaaccacttttatcagctcattttgtatctttccagaatttctttgtgcagacacaagcaaatacaaatataattttatatttttatacacaaaagtaagcatatttatcacactgttctgtaccttgtttcacacagtagtatatgttggatcttttcttgtaagtacaaagagagcttcctcattctttcctgcatttgcaagtaatgcatagtgtgtatgaaccccaacttattaactagtcccccattgatgggcacttagttgtttctagtcttttgctcttataaacattaatgcagggaatgaccttatcataagtcactttgcatgtgtgcaagtatatctgtgggataaatttcctagaagaaggctactcaaccaaggataatttgataattttgtaatgtttaacattttttttttgcattttaacaatttattcttagttacatttaattttaatttttaacagttgtaattttcatatgtaatgccaaatttctctccaaagagtctgtactatttatattcccactagcagggcatgtacatgggtgttttgccaaagcctcgcctacagagtatgtttataaatttcaatatttttgcaatttaataggtgaaaaatgttatctcatgttaactgttaaaattcttttattatctctgaggttgaaatcttttcatatgtttaaaagccatttatatttctttttcctttaactatctgatcatattatttgctcattttttctattactcatggatcttagcagtttctaggacttcatatcactttattaaatcactcgttcattaaatattttagtgcctacctaatgtgctaggtgttgttctaggtattagagatgtgtcagcgagcagtgaacaaaataaataaaaattcccgctctcattctagcctgagagcagatcagggcacctgttcaactgtagggatggccagctgccagtgcaggaggaggcgggcagaggtcagctgctacctccgtaacatgcagctcctctgatatctctgtcccctcatctctaagggaatacttccagggcctgccagaaaacatacagagtacagctcaacttggagattgctggtataatctttacttttttttccagaactacctaataattcattgcaaataatgttattagtcgttttttaaactcagaaagccagcataccttaattaaaatcagatttttgttttctccctaagaggaaaaaatggagtaggatcttttgttttgttttgagacagggtctcactctgtcgcccaggctggagtgtagtggcacgatcttggctcactgcaacctctgcctctcgggttaatgagattctcctgcctcagccacctgagcggctgggattacaggtgcgtgccaccatgcctggctaatttttgtatttttaatagagatggggtttcaccaggttgggcaggctggtctcgaactcttgacctcaggtgatccgcctgcctcggcctcccaaagtgctggaattacagatgggagccactgtgcatggcaggatcttttcttatatgagaattgttttattaggactctgacattcttcttacaaagttacctacttttttccaaaaatctgaaaagatttagggaggagatcaatggaacatgtaatgtgttttctccagtctaaaacttaacagctgcataactaattttaagtacaaatcatgctcttgggttactgagagttactggtatatggttgtgattaaagttaaaactttatttatacctgtatctctaattttctttactgattttcagctttagtctactgaaaataccattacattttaagagaaaaaaaggtgaccaatatattattaagatataagaaaaagcctttttaaattttactgattatgaaatcaatagatgtttcattgtttaaaaataatctagaaaataccaaaaaaaaaggaaaatatatatgaaaaaaatctgtaattcttctgcccagattcagtaactgttaacatttgggtgaattttttatacaatcagaaacatttattgaacaccctctctgccagttcactgctaggaaccaagtagagagtcagacagagatggctcttttttgagcttacaggccagcctagaagaggaccatgaggaacatgtattggcagaggggagaacctaatctgtgggctcagagaaggcttccctggggaagtgacttacctgggacctgagggttgagtgaggctccagtgtggataggaaaggaggagagacaacagcacatttgaacgtgagatcatgagctaagatcatggtgtttgaagaagtgagaaaagtccaagaatgcagagaataagctgttggcaactggagacatgggagtaacattcttaagatctaaactaggggtttctagactttgggattttatagatttttttggatccagcttcccagaagaatatcttgaggtgactattcctgtgcaatttttatggaaatttttgtggaaatttttttatgaagatactctaggagaagctagtaaaggagtagggaaagcatgatgggaaaaatcaagcaaggatgcaatatcatgtgaagtcccagtctgctgggaggcaaagttgctagagagctgggcccttatactcctgcaccagccagacttttaccatgggctggaagggtgggaaagggggactgtcaatcttctaggcacatgtcactccctagatgaagcccaaggtagttctgtgaagaaggttgtaagtgtaaacccttaggagcaaagcaagcccatctgcagggtggcacatagaactgatgagatgggggatgtgcatgtgaatggagttcaggtgggaggagtcagtcacaataaactagtaacataataatcatcataaaaattagggaactcatagacttgtcagattatttactttgctaaattaacatacagtaaaaagacaaacaaaatgccaatgttacctgtcatcaccattatttcataaaagtttatgcatctgttcaaaaaaaattaaccagtgaagagcttggtcaattctgagttaaatgacaaaatcatgttttttggcccacaaagtcgaaaggacaagatcatgacaaatttgtgaaatgattactcaagcaactcagtttataccaagaaatcagcatgatcagaatcttgaataaagatctctttcaatgttataagaacatatatgtgtgataggtgcatactaaatgtgcattctcacatttagtgatggaaaactccgtcatgtactactgtttgggaacccagtgggctacagtgtctattattttaattttatatccctcccttaggagttaacaaacaagaatgtgttggagtagctcaggaatttgcaggaaattgacttcttttagtcccagaacatttaaaatttaaaaccagtcttttcctatttcatgtgattgcatttctttgttcagtaaatgaagtggagaagttacaggtagttctaccagatcttaaagtctcctcatttcttgcctagtaccttattaagagcaaaagaaaaaggcctggcatggtggctcacgcctgtaatcccagcactttgggaggccgaggggggcggataacaaggtcaagcgtttgagaccagcctggccaacatggtgaaaccccgtctctactaaaaacacaaaaattagccaggcgtggtggcgggcacctgtaattccagctattcgggaggctgaggcgggagaatcacttgaaaccagaaggcagaggttgcaggttttatagagtgccctagtcctgtgaataatatcttaatggatgcttatgtaagactcagaaaataggctagctcagggttaccatttggaagagagagacaaggaaacggggaagaagaagatgacaaatagaggtcagattaaagaaaccaattggaataaagttatttgggaatgaaatttaatgatgtggaattttttttcagtgttcaaagcactccaactatataatattgaaattaagaaagcagggagaaaaaaagaggctttcatagaatttgctaccaaatccagttgcttaagtaacgatttcacaaatttgtcatgacctggaccttggtcatgtgggccaagaaacatgagtttgtcatttaactcagaattgaccaagctcttcactggttaattctttttttaagcacatgctagtttattagtttccaattagagatgggctgggaggcagggagtgaatagatagacctgtcagaatacttgttacttttatttctgttttcctattattccttcactttcagctagtgaaatggaacagggttggcaagataactttctttgctggctactagatatacttactggctaggataaattttggttgcaaggaagctttttgtactcatctgcctggcttcaagcctgaatacaggttagaaaacttgctttctttggtttccattaatgaaacatctctcttcctctcatctacccactgcttcctggttgccctggagaaagtttcttagtggtataacaggtcagcagtcatagagtggtttgtttctgagcactggacacatagtagtcatccagtacaatcaacagaaagaacattaaatgggctgtgttagttactatcccagaattgaatgctccagatgcagactgtaagcccagtctcaaagacattccaggctgaattttgcacatgtgatacttgagatttaaaatacttaaagagtacattagagtttgtcagatttgtccagtaaataaatacagtgtatgagaataatattaaacatgtaaatgtactattacaaaagccatgacttaaaggagtttaatcatatcaacactgccctggggctagagaattaaaagagttgagctttctccagaatgtgtgtgtgtgtgtgtgtgtgtgtgtgtgtgtgtgtatgtgtgtgtacccatatgtacatgtgcgtatgtttatgtttgttttcttgttttcactgactagtttttattattctggctttagttttccagaataaaaagaaattctcatattctcttgttgggtaagatagatacctttctcattttaacttagaaatgatacattttagctctattggggaattttaaacaaaaaccttaatgcaggtagcagaaaatctatttgtattggtctcatagttaattcaaataatttttctgtctttttttttcttgttactttttaggttatcaagaaaaataaaagtaaaatatagaaactaatgatttacttggaaatttttaatatttagacatatttttaaatctttctaaaaacagatacaatcctgatattccactttaagtataatttttgcagattctgatatatatgtaactaaataatctttatgcgatatagaagtcagaagcaagaatgatgctaaaataacattaatcctaatatgtttaaacatgctagaaatgttaaggaagtcagtgtaaagcatcatcttaaccctgtctgttttgcatgttctgcaaggtagctagagaggactttttgtagattaatgcattattaaaattgaatatttatgttctaatcaatgtctttatgtttatatttataatttttaatttgatttacattataatgcatttcaaattatacatgaagacctgtattgtgtgcatatttatttattgctaagaacttggcagaggttatttctttattatattttcagtgttcttcttaagcctcccaaaactccccattgaaactaaacaacaaagtaggctggtttagttcacatgtgctgtaaaccagtataggtggttatttcacagggtcttgaggggtccttgtttcttggagatgttcctccagcatcgtctggtgtcaatttgcagtggcgacaaaaaagtaagactaaaatttgaatttcttcatgtattctataatttactctgtgattcttggaaataaggtatccaaaattaggcatacattttctcaccagcattgttttagatgtttcatgcttctgttccctagcacctatatggctagctctgttttgctgcatgtatttacattagagtattcaaatcaattccttcgttaggaacccttgattttagcagttaatctctagggacattcttaggttcaggatggcattccaggtttgcttttctgtcttgtcaccagaagaagatacccagcctgcttctctttcctcattaaacctgccacagcctgccctattctttggaactctttccctgccttgcaagattggttatagggtgtaactaatttatccattgctactttaatgttgcctctgaatacaaatactcacaggctgtttatgtttgatggattttattcctacatttcaggagagaatcagcaaaaataacaagtatgggattttaaaggttctagaaactgtaataaaagtccctactgctaaagttccctattctgtggttcctgattcccttcgtgatatgtttattagaattcctttggagtttgcttttattcctgaaggtagaaattgccatacttccctctccattcttccaagattgtggctgtatgcttttcttggtcccttctgggcctaaaaacagtaggagtacctatatgttgatggcttctataattttggctctgatttctcccttgagtttcacattttttttttctttcagtttcttctatgcgttgccattatcagtttttacttagatctcagtaggtcattgggccagggaaataaacgaacaatttattggtggaaaaaaatctcatatgattaatgaatatataaaaaaattaagtgccattagtaatcagtgaattacaaattacatcataaggagatatggctcactatgaaactagagattatttttaatgctttcagtgatcattcttatgtactattggcataagcttttttgaaagcaatttgtagtgtgtattgagagacttaaaaatattcttattctttgatgtaaaatctttattaaaaaattttactagcaaaagtaaataattaggaatagagaaaaggtgataattgaagtatttttaaatgtttctaattttctctttattagaaataatattagagaaatagttaactgacatatgagtatattaagtacctgatgatgctattattatgaagaatctttaaataattttggaaaatagttttataagaagacttatctggagatggaatataagttaggccttgaagaatagatatgcagataatagtaggttgggcatttcatggggaggaagataacacgagcaaagacataaaggtggaaataagtttattgcatggaaaataatgattaatctggctgggaagcaggagttcatttggaggaataggagaatgttattccccttttatgtctttagatatttgctagatactaaggatataaggatagcttaaatatagcaaaaatggaaattcaggagaagggcatatacaagaaacagtttcttgaaaaatttgatgaaacaatgatttgataaaataaagagaaaaagataatatgaaagttttgcatttatatgaggctagtgacagaaatggaaaagctgaagcaggagacctttgtgaagcaaaatgatcagtttagtttccgcagttggtttaagccatgcacacagggagcttcatctttgtgtgttttattctttgggtttacttatcttgtaaactgtaatgttgttcagatacctctaactacatgttccagtttttaaactgatcaatgtgaaatctgtaaaaaaggactgtttggggacttataaaaataaattaataaggtctgtggcatttggttttttaaagttttttatatcttgggaacaatacttatattggattctatttattttgatgactttgtttcacactgtgacatattgggcatgggtctataaccttaagggaccagtagatctcattctaaactgtattatagggaagtttctttttttggcagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgaggtaagccaaaaatatttagcagcagtattggatataacactatagatttttaatctttagatattaatgtttactgagcatcggtaattgagcattggtaagttatatataatttgatgtgttgtatattttgattttggaaaaactagacaaaatcatgttttaactaatttcactgcttttgttttggtttggcattagtgtttctgggtaaactattaagtatatattttcatattgctaattaataataaccaaatacaaaaaccagtaataagtaacaatccactttaattcatattacactttaactgtgggcaatacatgcttaactttttattagttatgttaaagatgatttgctattaaaaataagaatattaataagattgtgagatgaatgcttattctgtttaatctgtagtttctctaagtgtcattttttttctatactaactctattctatattctcctaactgtaatttttggtctaggcaggtagtgctattaccttggaattattaatactttttttttttttttagtttttttttaattatactttaagttttagggtacatgtgcacaatgtgcaggttagttacatatgtatacatgtgccatgctggtgtgctgcacccatcaactcgtcatttagcattaggtatatctcctaatgctatccctccccactcgccccaccccacaacagtccccagagcgtgatgttccccttcctgtgtccatgtgttctcattgttcaattcccacctatgagtgagaacatgcggtgtttggtttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttctagcagcatgatttattgtcctttgggtatatacccagtaatgggatggctgggtcaaatggtatttctacttgtagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcacccactttttgatggggttgtttttttcttgtcaatttgtttgagttcattgtagattctggatattagcccttagtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtcctttcccatgtctatgtcctgaatggtaatgcctaggttttcttctaaggtttttatggttttaggtctaacgtttatgtctttaatccatcttgaattaatttttgaataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgtgggctcttttttgtttccatatgaactttaaagtagttttttccaattctgtgaagaaattcattggtagcttgatggggatggcattgaatctataaattaccttgggcagtatggccattttcacgatattgattcttcctacccataagcatggaatgttcttccatttgtttgtatcctcttttatttccttgagcagtggtttgtagttctccttgaataggtccttcacgtcccttgtaagttggattcctaggtattttattctctttgaagcaattgtgaatgggagttcaatcatgatttggctctctgtttgtctgttattggtgtataagaatgcttgtgatttttgtacactgattttgtatcctgagactttgctgaagttgcttatcagcttaaggagatttggggctgagacaatggggttttctagatatacaatcatgttgtgtgcaaacagggacaatttgacttcctcttttcctaattgaataccctttatttccttctcctgcctaattgccctggccagaacttccaacactatgttgaataggagtggtgagagagggcattcctgtcttgtgccagttttcaaagggaatgcttccagtttttgcgcattcagtatgatataggctgtgggtttgtcatagatagctcttatgattttgagatatgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagaggtgaagcccacttgatcatggtggataagctttttgatgtgctgctggattcggtttgccagtattttattgaggatttttttgcatcaatgttcatcaaggatattggtctaaaactctcttttttggttgtgtctctgcccagctttggtatcaggatgatgctggcctcataaaatgagttagggaggattccctctttttctattgattggagtagtttcagaaggaatggtaccagttcctccttgtacctctgataaaattcggctgtgaatccatgtggtcctggactctttttggttggtaagctgttgattattgccacaatttcagatcctgttattggtctattcagagattcaacttcttcctggtttagccttgggagagtgtatgagtcgaggaatttatccatttcttctatattttctagtttatttgcatagagatgtgtgtagtattctctgatggtagtttgtatttctgtgggatcggtggtgatatcccctttatcattttttattgagtccgtttgattcttctctttttctttattagtcttgtagcggtttatcaattttgttgatcctttcaaaaaaccagcttctggattcattaattttttgaagggtttttttatgtctctatttccttcagttctgctctgattttagttatgtcttgccttctgctatcttttgaatgtgtttgctcttgcttttctagttcttttaattgtgatgttagggtgtcaattttagatctttcctgctttctcttgtgggcatgtagtgctataaatttccctctacacactgctttgaatgcatcccagagattctggtatgttgtgtctttgttcttattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagttctgttcttttacatttgctgtggagtggtttacttccaactatgtggtcaattttggaataggtgtggtgtggtgctgaaaaaaatgtatattctgttgatttggggtggagagttctgtagatgtctattaggtccgcttgatgccgagctgagttcaatttctgggtatccttgttaactttctgtctcgttgatctgtctaatgttgacagtggggtgttaaagtctcccattattattgtgtgggagtctaagtctcttttaggtcactgaggacttgctttatgaatctgggtgctcctgtattggatgcatatatatttaggacagttagctcttcttgttgaattgatccctttaccattgtgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttatatttaaagttaatattgttaggtgtgaatttgatcctgtcattatgatgttagctggttatgttgctcgttagttgatgcagtttcttcctattctcgatggtctttacattttggcgtgattttgcagcagctggtaccggttgtgcctttccatgtttagtgcttccttcaggagctcttttagggcaggcctggtggtgacaaaatctctcagcatttgcttgtccgtgaagtattttatttctccttcacttatgaagcttagtttggctggatataaaattttgggttgaaaattattttctttaagaatgttgaatattggcccccactctcttctggcttgtagagtttctgccgagaggtcagcagttagtctgatgggcttcccttggtgggtaacccgacctttctctctggctgcccttaacattttttccttcatttcaactttggtgaatctgacaattatgtgtcttggagttgctcttcttgaggaatatatttgtggcgttctctgtatctcctgaatctgaatgttggcctgccttgctagattggggaagttctcctggataatatcctgcagagtgttttccaacttggttccattctccctgtcactttcaggtacgccaatcagacatagatttggtcttttcacatagtcccatatttcttggaggctttgtccgtttctttttattcttttttctctaaacatcccttctcgcttcatttcattcatttcatcttccatcactgataacctttcttccagttgattgcatgggctcctgaggcttgtgcattcttcacgtagttcttgagccttggctttcagctccatcagctcctttaagcacttctctgtattggttattctagttatacatttgtctaaatttttttcaaagtttttaacttctttgcctttggtttgaatttcctcctgtagctcggagtagtttgatcgtctgaaaccttcttctctcaagtcgtcaaagtcattctccgtccagctttgttccattgccggtgaggaactgcgttcctttggaggagaggcgctctgctttttagagtttccagtttttctgctctgtttttcccccatctttgtggttttatctacttttggtctttgatgatggtgatgtacagatgggtttttggtggatggcctttctgtttgttagttttccttctaacagacaggaccctcagctgcaggtctgttggagtttgctagaggtccactctggaccctgtttgcctgggtgtcagcagcagtgtctgcagaaccgcagattttcgtgatccgcgaatgctgctgtctgatcatttctctggaagttttgtctcagaggagtacccggccgtgtgaggtgtcagtctgcccctactggagggtgcctcccagttaggctgcttgggggtcaggggtcagggacccacttgaggaggcagtctgcccgttctcagatctccagctgcgtgctgggagaaccactgctctcctcaaaggtgtcagacagggacatttaagtctgcagaggttactgctgtctttttgtttgtctgtgccctgcccccagaggtggagcctacagaggcaggtaggcctccttgagttgtggtgggctccacccagtttgagcttcccggctgctttgtttacctaagtgagcctgggcaatggcaggcgcccctcccccatccaggctgccaccttgcagtttgatctcagactgctgtcctagcaatcagcgagactccgtgggcgtaggaccctccgagccaggtgcgggatataatctcctggtgcgccgtttcctaaggccttcggaaaagcgcagtatttgggtgggagtggcccgattttctaggtgccgtctgtcacccctttccttgaccaggaaagggaactccctgatcccttgtgcttcccaagtgaggcaatgcctcgccctgcttcggctggcgcacggtgcgctgcacccactgtcctgcgcccactatctggcactccctggtgagatgaacccggtacctcagatggaaatgcagaaatcacccgtctaatgcgttgctcacgctgggacctatagactcgagctgttcctattcggccatcttggctcctccccccacaatactttttttttttcttttttttttcgagatggagtctcgctctgttgcccaggctggagtgcagtggtgccatctcggctcactgcaagctccgcctcctgggttcatgccattctcctgcctcagcctcccgagtagctgggactacaggtgcctgccaccatgcctggctaactttttttttgtatttttagtagagacagggtttcactgtgttagccagtattgtctcgatctcctgacctcgtgatccactcaccttggcctcccagagtgctgggattatgggcgtgagccaccgtgcccggcctggaattattaatacttttttgtttgtctagtctgaagtcctgttttcagtgtgtccctactggggtgtttctgaggtattttagcatcccaggctcccagatgtcaaatgctagtagcattctagggctgtgtgacatgaaaacctctccccaccagtttcgaaatattcctaggggtgagagtagggccaagcatttctgtctcccactgaaaactactgtgtggttaaaaatgtatatcagttttctttttaaggaaactttatagactcaaattttaaccaacttagatatcccttttccaaattgatgtgtatttcagatttcatggaaataacacaaatagcttaactttcatgaaacagtaagatagccttttgaatgtcttagagtaatagtaactataatgcctctccaacatattacagttaaaatgccatggcacatcctgtgaagtagctaaagttgccacataaaggtgaatttaagtgtccaagttaatttggtctttaagccatgggaccaggatcccacccagacctcatgtgatggaaagggagcttcacagattggacaaaactggcctttactgggaggagggaggaaagatgaaggaaaagctgggtttggggagagagaggagcatgagatactgacagtgttgctcctcagggctctgcggtgggtctgttgttgcagcagtgggagcaattcatctggaggagagtgaatcgctgctttgattcttacccacttgcaaaaactgtaaaatagaaatataatttcagcaaatacattttaaacagtttattgaattttatccagacctgataaaatgcttgacccatagaatttgaatgaaggccagaagacacttgaggcaaagggaagagaaggtacaaagatgagaagtgaaactgtgtgacttgtttggaaactccagtatttcagtgtgaccaaagcataggatttgataggggaggctgcaggagatggaattggatggaggctcagggctgcctcagtgcacagctccatgcacatagatgacagtgattgggactccctgtctttggcagtgtggagtctattctgctgcgtcatagaggtctgtttgggtttcaccaagagatttgcattttatcccttcagccagtgatcttcagggtggtccagtatacagccaaattagtcaaggggagtcacagatactttagactttgcagataatttacttttgctaaaaaattagaacatgccctagagtaggaaaatacaataaagtaaaaatatcggttttccttaatcagtgtattcaatgaagtcccaattaaaatgcaaacagaattttttaaaattgaaaagtttgcctaaaaatatgaaaatactcaggaacattctggaaaagaagtgtgatagaggagtattagtcctgattctcatttgcagtcaaacaatccatgacattccaacacatatgctttaaaaaacttagttattttacttggaggactattgatatgggagaaatagcatatagataaatggaacagaatagagtccaggaacaggtcaagaggatagtgggaaatgtatcgacaactcccctgggaaagtgttatgtttctgttgttaaaaaaaaaaagaaacacaaataaaaacagttttatatcttttcttccttttttgtctttcagaataaaaacgttttgataccaatgttgtctaggatataagcaaaagggtactttcatacaatttttatggatatataaattgatgggaacattgtgaatggcaattctccacttgcatcaaaacttctaaatgcatgtaatttactataaggatatattttcaaagtttgccaagatgaacatacatgcataatacatacacacaatgatattgcagtattatttgcaataggaaaaaaagcaggacatacatcaatgaggaactagttgaattatgtcacttctatgaaacggaaggaggtgggtctgtatgtgcagatatagaaagatctataagatatatcattaaatgagaaaagcaagttgctgaatggtgtatatagtatcattcttttagtgcaaattcaagaacagaatttcatacacatttatttggaagagatcagaaaaacaatgattatctttggggagagggatggttagaactgagtgtagagaggaagaaacttcttattttagacctttctttaatgtttgggtttactttttacttgaaatttttgatttttgtttgtgtaatattttacacatcaacaggtgtatctggatgatgagatttgttaaagaaaaattattcaatcgttctaggtatagggaccactacaatgggattttgcaatgtctgagagagattgggttcaacagcatgggcaagtgggaattaatagccaaggagcagattagaaagtcagtaaattactaagaaaattactaagaaacatcaggagtaagggagattctggctacaccctctttaaacttattttaaagatcatgttgttgttactctgcgttttgtgatattttggcttaaaacagtgaaaatctgacctgaaattaatactgagcctagataacaaaataaattgaagaagagcatttaggttaattgcaaaacaaaaagtttagctagataaatacattaaattaaaaaaaaccctctctcatctaaataagatttttaacatttagcaaatatttaatatcttttcctttatatttgttagttcagaataggctatttaagcagttctttgaaactagaagcccccaactgtttagaaaaaataaaccttggactagttcaagaagataattttaattagagataacaatctcttgaattctgccttcttaataattcttgtatctgtttgctactccatcatcactgccagctgccttaagcagaccccttatttcctatttcctagaattctgtattagccccatggctggtttctcttcctgcctccttgctcccagtagcacgcccacaatgatctttctgaaacacaaatgtgaacatgtcactctagtttaaaacccctagtttaaaacccttcaggactcctcattgctttcaggataaatccaagctcctctgtgaggctttcataacacagtctttgccactagactctcttttcacctggtttgcccctgactctttgaagctgaatgttccagcaaaaaactatcatcagagtgaacaggcaacctacagaatgggagaaaatttttgcgatctatccatctgacaaagggctaatatccagaatctacaaagaagttaaacaaatttacaagaaagaaacaaccccatcaaaaagtgggcaaagaatatgcacagacactgctcaaaagaagacatttatgcagccaacaaacataagaaaaaatgttcatcatcactggtcattagagaaatgcaaatcaaaatcacaatgagataccatctcatgccagttagaatggtgatcattaaaaagtcaggaaacaacagatgctggagagaatgtggagaaataggaatgtctttacactgttggtgggagtgtaaattagtcaaccattgtggaagacagtgtggtgattcctcagggatctagaactagaaataccatttgacccagcaatcccattactgggtatataccccaaggattataaatcattctactataaggacatatgcacatgtatgtttattgtggcactattcacagtagcaaagacttggaaccaacccaaatatccatcagtgatagactggataaagaaaatgtggcacatatgtaccatggaatactatgcagccataaaaaaggatgagttcatgtcctttgcagggacatggatgaagctggaaaccatcattctcagcaaactaacacaggaacagacaaccaagcaccgcatgttctcactcataagtgggagctgaacaatgagaacacctggacacaggcaggggaacacactggggcctgttggggggtggtggggctaggggagggataacattaggagaaatacctaatgtaggtgacgggttgatgggtgcagcaaaacaccatggcacttgtatacctatgtaacacacctgcatgttctgcacatgtaccccagaacttaaaagtgtttttttttttttttttaaagctgagtgttcctggcacaggtacactgtacactttcactttggagctaggtctgctaggctttagtagcattctgtgtatctttttgtcaaagctattaaaacgtatcattgtccttaccaatccccactggactgtaagcactctgagaatgggcactctttcttttctgtcgccagtgtctggcacgtagtagctgttcagtaatgctgagtatgacaaattgtattagtcaatagattaccaaagtgtatctttgcacctaagaaaatgagtaggcaatgtgaggtgagtatactttgaataatcttgaaatgcactacagtcaaatgcacgtatgatttcttttatttggataattctgttggatgtttatttactatgtgaaaatattgttataaaatgtatgacacttttattccttattagattatgttatatgtttcatagaatgatactgcttttcactcttgatgatcttggtttctctgtcttatttagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggttagtacaaagccttgatgaagtttttttcccccccagcagcaggttatacttattatgtagtggttttcataataaaagtttgaaattatgtaacatgtacttacaaaaataaaaaggaaatatattttgagtgtcatgtttagaatgctgctgcttataaaaaaataagtgttttactatcctcttcagctaaattttatatgaatatgaagggaaactataccctttacttcatgtttcttaaatcccaagtaactttcagcagagctcctgtttcttctttttcatatttgcagcacagatgattaacacattttaaaaactatttccaaatcaaaatctacctctctaatgtgatttgtcagaaatggaaaacaatttattatagaacatttttaattaaatcttaattacatgtgcaatacatcacccagatttagaagctcatttaaactaattatgttgaaaatgcagttgcatgctaaatagacgaccacacttgcagacctgcccaggtgtttccgctcctttctatttaagcatttagtttccttactattaaatgtcacctgttaagcatttgaaagcttgcacaagtgcatattcatttagtaatgccatagtaattttttcttaggatacaaacaggtgtttttctcctaaccttgatcatggtttttctcattgtatgttacatataatcccagcattttcatgaagttaaataatgaagaagtagaaactttagagaaattttctgttatttttaattaatgaatactcttgtattctatttttaaaaatgaaaagtgaactgtagcaatccctacacatatccccagtgtacattctacaacagtggtttatgaattagaaattcgtatgtggagccttgtttcctcaacttagattataaaaataaagatgcagttccagaaataaagatttgatattgttagacttaaatgaagtaatgatgtttgaaatagtaacaatgtgttccaaatactgagcttgatagtttatgcatcaaagtgaaaaataaaccaagtagtaatggctagtagcacatgttgaaaccatggatgcactgagtttcttttctgccagaaattgaaccaggagaaggggttcattgctagatatttggcagctgtccagtgaaacacagtttagtcctttctacttccctttgccccaaacacacatatttcaaattcttttctctgctaataggaccaagaaagaactgaagctaatgaagtctgtgaatatttagagtatacattatcataaaccaagactaactgaatatgaaaacagaacaagtggtgtcagtaagcattattttacattatgtagaccattagggtattttaattaccctcatagctctttcccaatgttttccattattaagaatttattaaacgtttgttttcaccctttgtgtgcaaggcattgtagtgggtgttgatcatatacagagacatgagatatataatatagttcctgccttcaggctacagagaagataaagatattaagataaacatataaacatatcccttatttttataaacagagtaacagggtagtaactaatgtgtagacattaaagaaaatattagtcgtgaatggctgaagtccagctgtactggcaaagtgctgcatatgactgtgataataacgagtaaaatataaagctaatattaatcaattttaaaaactttatgcagcttctggcgcttgagaagaaacatcacttataagaagaaaacttagccatgccatttaaaaaatttttatactagtaatggataaagatcttttgcaaagttagagtttctatctactttctaacccacaatttatcttccattttcaattcacccagggtagttgctgtagagcagtttgaataatcagaaaaagccatatataaatttaagttctcatattttactgtagtatttcagccagtaaaatcataaatcttgatggcattcctttaagtgtagtcactattcccattaagaaaagaaaaagttgaggtaagagggagagagaaccttttcttgtgcggggcatattggagttttgcctactgattactgttggcccccatgacttgactgctgaattgatagttattatggcttgtaggcagcattcccagaataaacaataaatatgcatggcttgattattaatgaataatctttgaataagtatggtctatttatgctcattactatgaagaagacttatttgtaatactttaaagaagaaaagcacatttaaaaactagagaccaatgttgatgagctgctttttgaacaaatctttgggaaaaagttggatgcagtttatttttgttgcttaaaagccttatctcacaagttagaactgtttaactagattttaaataactttttaagaattgttattattcagaatagtggagaaataggttgcattggaataaagagaacttaaaacttttaatcagttattaaaatcctattctagctacagatttgtgatttattactttgagtactgttcatgcatatcattactcattaaaatcacatctattataattccacttttctagtatggttccccaaagtcttagatgttcctttccctgcctgcctgtttgtgctttggaacttaattgtatcattctgttcaaaaagccttaggttcattttttccctaccatttttcttcaaatatttgctgaatggccttgatctccccctcagttatgtgtaggtttttactctaaactcctcttacttgttctcggtagtttatattcattcctttaggaaacattcttggatgcgttctagattcgagaactttattaggtattttgacatagagctaaagttttatggtataaagagcttatttcccactaatatatttattcagttgcctgcctatattttatacagttgtgtcttagattgtcaactctagaaagtagagaccattttaaggtgttcttttcccttctttctatcattgttggatagtacccatatacagttaagcaggaagttttgtttttaatggctttattttggatcagctatattaaataatgttccaagttatttgggattaaaattatcttgaatatattgttttagaaaactcggtgagggtcagctaaaaaaacatgagattaggaatttagaagtcatagatatttatatctaattcttctcttttatacttcaggcaatttctgaggactattaccttttattttgtgataagtaaactcaagtcattcacgtgatcttaattattttaggatgcaagttaccatttagtaaattgcttcttatgtacttgtattattttggacaaattaatcacctcataatgataagcaatttacttttctctccagagattccttttctcatagcaggagacttagtctgggattgtttatctgacttaggtcctctcataaaaccttcagtataaaaaaatactttgtgagcattcacaatgtagaatgaattgactgcaggaagtaaacaagctgagttctcctttcaaatgatcagtggcacagttgagatgaaaaaatacatatatgtaattatgcattaaagtaaaacctgcatgagaagcattaaggaaagaagtaagagctgtgttcagctaattgagtctgctactgtctctgccctcttgggatgtagatatgaaaaggtaggtagtatacattttgaaaatttaagtagagataatatgaggatattaaataatctgctcagagtaaaaatatgcaatatgggattcttgagagagagaaagaaagtcagaaaggtagtataggtatagactttatcttattttgctttcaaattccatcattcattaaatcaagttgggaagtttcctattgtctcctaacagtttgctttctggtataaagccagagtctttatagtgacacacactacgtcaactgtccctcatctctgatctactcatctcgccatcattttgcgcctcctgcatcccccgtctcactgttcttcactctgcttgttatcctgccctggactgcccttccctttgcctagaatgctcttcctccagatacctgctttgctcaccctctcgcttccttcagggttttactcaccacatctctgaagcttctctgactactctgtccatccttgacactttctattgcccttccctgcttttatttcctcctgggcacttttcacaaatttgcgacttactttactcatttggttatcatctccttctctcttcaaaacattagtaagcttcatgagagcagggattttgttttgtccactgctatctccccagtgcctagactattgcctggatgatagtagaagctcagggcatatttgttgaatgaatgaatgaatgtgcttcatgtagactgcagtttagctaatacagctagcaaaggaagcagcagtgagaggggttggaggagatccaagagagggagttatgtgaggagtgtcagagttttaaggaaggagtgtgcagttgtatgaaatgtcacaaatcaaataatacaagtttgaatttagaataaacgggtgttcacgtgtaaataagatgtgcaggctactgggttatttacaatatttaaatttgcagcaactgaatttttttattgtttaaatgtgaattggccaagatttaacttatacttaatgtttatggggtgctttgacctttaaaaactgcatttgcgtagtatttcagcttcaatcccacgaggcagtgtggtgaatgttgttacatacttcaagtctgcgtttacagctgaggaaatgctaagacttgagtagatgccttttccaaggtctctgctaggaactagtcaaacaatgcaaaaaactccatcttttaaccagtgttactttcttttatttacacaactaatctgatttagtcaattttactttgtatgtgtatttgtaagctcattaaatcatttaggaataaagatgtggcataaattgactaacagtatattactgatgtgacactggtgggaagatttatgtcaagagacctggacaggcataattggtacactgttaagagggttcagtttgcttagttgataaagtttcatggattcaaatactcctagattcatgtttacttttagattgttttcaggggatgatcatagacaggactatttttcccccaactataacataactgacataaatattgtggtaactactctgataaagcattttgtgaccttcatcttggtttatttctatatattttatgtaaagctgcaattgaatattttcaatatcaagcaatctagctgctaaatagtaacagctgcaagtaccataacagtgctgtagttaaacccacatagacattttctgagctgagaggagcctagtctgatttgttttgaggttatttaaataagttgttactttcgtgtgcagtgttcaaaatatattatccagtacttgatgggtactgttgagggggaaatatctcccaagagtttagagttttgttatgttttgctgtttttttttgtttttgttttttggctttaccaactcagatgtgaattataggtaagtgggaaaaatatatcttctactttcttaattttccacttagcattagctgactttttatatgatgtgaattcattttgttctctcaagttgatttttttagcctaaccattcatatttcagtatgcagtgaataagaatttaagcaaaacaaattttacattttccctaatagaaatctattctttcaaatgtatctacttagagttgctaaaattccaaagttcttgcaaaaatatcttttagttttataaaattcacatagaatgttgttttggcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagaggtgagagtaattcataattttcatcattgctattatggtagccaactgaagatttggttttctgtaattgctcataataatgtgttttttatttttaaatcaagtttatgatgccttctgactactctgaaatcaatagagctgattcagtcattgtgaagttatttcaaacctaatatgcttttaaattataaggaaatgttcttctctatgctcttaaaatttttgtgatgctatttatgtccccaggaaaaaaaataagcgttggttgaggtaagccaaaatgctggcagggaatgaattagagaaaggtaggaggatagtatgtaagaggacatttgcttgcagtgggaggaagcaaagtgatatttatcctggaccagacttgggggttaaaatttgtaataccatagttaatgagtctcatttaaaaaggaatcatgtcatatatattagtctacttgctttttcactaatatctctaggacatgtttccagggtcagtgcatatattatctaactcttttactgtaatagtgtatgttataccataatctatttaacattctccaaatgatcaacatttagtttttccagttgttttccttttacaaactacctagcactaacattcttctgtgcatagttttttttttcttttttgagacggagtctcactctgttgcccaggctggagtgcaatggcatggtctcagctcactgaaacctccgcctgaccagttcaagcgattctcctgcctcagcctcctgagtatctgggattacaggcacgtgccaccatgcccagctaatttttgtatttttagtagagacggggtttcaccatgagcctgtgcatggttttacacatacttactattactgctgttggatagagtcctagaggtggtattgctaggttaaagagtatgtacctgggcccctgtagtacatactgtttgtcatatactttttccctctgctgcatgcatattggccttctttctattccttgaatgttctgacctggtcccagctcagggcttttgtttttttgcctgtctggaatgtttgtctagctcattatggctgcccttttttcagctcagtgttcaacttgcatatttttttagagatggcttcctggatactgtagcaccccttctagtttgtttccttcatatcatcaagtttcatttcctttttaacatccttgtcactctctgaaatgatacttgttttcttgcttattttctgtcttctcacattaggatataatggtagaagccttgttggtctttttcattgccatatttccagaatctagaatagtacttggtaaagattggccattcagtaaatatttgttaagtaaatgaataaagataaccaaattacttttccaaaatgatataccagtgacttgggagactggattagttctggtgggaatggtttggttcccaagagagcaggtggttgtaaagcaaggatgccttttgtgtttggcctctttgtactgtctgcctcccctttgatcttctgccatgttaagacacagcaggaaagcccttaccagaagccgagcagatgacagtgccatgccccttgaaattcccagcctccatacctgtgagctaaataaactctttttctttatcagctacccaccctcaggtattttgttatagcaacaccgaatgaattaagatggcattattctcaattttgggcaaaatatttagctaggcttcaacaggtgacctggcagggtggaaagaagactttgattctagttctagccctgccagcaataagcttggtaatctaggtgaagacattgtctcagatttccagattttttatttgtaaaatgaaataattattgtccctgaatgccagatgatattagcctgtgttttcattggtctgtggtgaaatgactccccatttgtgtgggtataaaattgctagctatcttttcttgggtaggactgttcattctgaaattatgccatacctgctttttactggcacatttactattttatgggcctaagtactataaacgaaatcctctgagcaaggaggatttaaatgcctcatttaaaattttctgattgtttaataagaaatatagcaggcataattattaaatgtagttattaaatgagcctttgagaagaaaaatagggtaaaaaccaaaaaaatattaacttgctaggcatcttatatctattgtggcttgtgaaaatatatcccatgagatgtttttgaaatgttgtatagtaatgtgatctaagtgtcagagaattattagtctacagttttcttaaatttgtttcagactgatagatatgaccaaattttttaagtgtgatttatgaggattaagaagatttcatatctgaagagtggaaatttatacatatgtacctaggtctagatagcataagctctggtttccctcagttacttaaatacagatgtaaaatcattgtatgaatatattaaataaaatttaggttgtaccctctgttacttcctattaaattttttttattggctcatctggtaaaatatcataaacactacgtaatttttctgacattgaatatgtagaaaaaaattataaaactgagttttcagtgatctatggttgacttaaaattaaagatgctgttattttagtgatataaatggcaaatgtgaaatttagaaaatcttacccaggcagtgtttacttttaatgcctccgaactcattgctttctacctatacttcactctcttattgtctcctcattcttgggatctgtatcagagtcccacatgggcactaagtaaattagaaaaaggagagttggcaaaataatcagctgatttctttaaaaacaaacagaagctacagcactagtattcatggcaatctgtaaacacctccattgtcacttaagcaaagcgttatgtcacctccttcttcctttgatacacacactccttttaccttgcacctaatgatggtgtatgagagcaaacagagaatgagaagacaaggtgtaggagactggtctctctttaaatgttccacaaaatcactggcagtatattctcattctagactctgttttgaagaaggagcagtaattgatttcaaatgcctctgcttgctctaaggacatacgtgaaaagaaaaagaagataataattttagttttcttggagaggttattttgttttaaaagggctacaaattatctggtaccactttaaccctgttttcctgaaccctacaaaattctaaaataagcaaaaattagtattaaaaatatggattgtattatagcatattaacttcacagagaccagtttatgatacaatactgttacattttatgtgcctttacataatttgcattaataaatatagtatatttatgccattttacaagacttagacaagtccgtatgcataatgcataaagcttttgaggattttgaagacctggatttttagtcccaaagtttgggaaaaagctactgaatatattctgttggctgtcctagatattttgcattattatttctttacaccagtctgaatagggttggtggtattctcatctttacacataattaaattaaggtctcaaaagattaataaattgcctgctggcacaagcaatagagtcaggatttgaactcaggtcttgtggccttggtgttgtagttaaaattataacatatataaaagcatagaatagtagttattctgatagcttggctatttacctaaaacaaggattttctttactacttactatttctaatttgtagttggtaaggagatacaacatagtaactaacatatacaacattataatccatgataaaatacagactattatgtttatgttttataaatatcttctgcaggaaaacggattttttgtctttttactatgaacaagcttagtttgaagtcttagttgttctgaatttataaatcacaatttgttattcaaattacatttagaaacatttaagtgaaagtttgtagaatcaatacataattaactgctttaagtaagtagtttatataggcctactctcaattttatactgtaatggagagcagcattgagacagataatcctcaaaataattttgacatgtaaaatgatgtgttgttgatagctaggtgatgtattcttaagtcgttagccatagccaggcatgcagcaggcctgatgactcagtaagaatgagacctcaggagaatagaactgtggcagggtcagaattgtcttgtatgctgatgtgggtccctccctgcatcagtggttgttcagaatttttagccttataagatagtaaaatatagttcaacttggtttcttaatttatttcatgagatctttttctttctttagatgtgtttaggattacaatgaaaaatgacttcatcagagaaataacaaatgtcttataaatttagcaaagaaaattcactaactaagctatgtgcagagtcagtggcatatatttgttgaatttcattagactcagagcattaaatacatgcttagtaaagaacaacatactattacatcaataaaagacagaatggacgggtatacagtaagcccaaatatatgctcgcattgtcacaggcttgtccttagttggagggtgatctgtgttgggaaacctttttagaagaaattactcttgagctgagatttatgccctgtttagtgtgtaatcccagaattactagtgaaatgggttggtaaatagggtaattttttttcctcctgaatttggtggatcttttagagttgaatagacagcactttctgcaacagatggggatttagacagggaggacactttagttgtgcttagtttcttctaccatccgtggcatggaaataattaggtattataatgatttaaaggacttaagttcagtctttttggttcttttcttttcataagattcttattaggtacgataaagcattgattgcaagtacttctttaaccatacatgatgatgtattttcgtgaaagtagagctgtaaaaatctagcccattcagctgggctcaggggctcatgcctgtaatcccagcactttgggaggctgaggcagaaggatcacttgagatcaggagttcaagaccagcctaagcaacatagcaagaccccatctctacagaaaatttaaaaaattagctggacatgcccctgtagtcccactcaggagactgaggtgggaggatcacttgagcccaggaggtcgaggctacagtgagctgtgattgtgccactgcactccagcctgagtgacagagcaagaccctgtctcaaaaataaaataaatctgactcattaaattgatttttaaatacttgaaaaaaacttttattttgaaataatttccgacttacagagaaattgaaaaaaaaaatgatttcttatgtattttcacccaggttcccctactatatgcataattgttttagtgaaccatttgaatataagttgaaaacataataaccctttacccctggggcattataagtgaaagacataatttgcccctaaaagggcatatatctgtaatgtactttcaaatacttgtgttatgggctgaattgtatctccctgaaattcgtacattgaagtcctaccccccagtacctaagaatgtgactgtatttgagacagggtttttaaagaggtaattaaggttaaatgaggtcattagggtagagcctaatccaatatgactggtgtccttaaggaagaggagattaggggacacacacacaaggaagaccatgtgaagacaatggaagaagatgacccgctacaagccagtaagagaagtcttagaggaaaccaactctgttgacacctagatctcagatttctagcctccagaattgtaagcaagtaaatttctgatggttaaactacctagtctatgatactttgttatagcagccctagaaaactaatacaccttgtataggatagcataagaaaagttttttaacatagtgcatgagagtgtctttaagataagtcccacacgtactaaaacaatctggactagttttagaagtttgaacctgtttaccttttctctgtttggggaaaaaaaaaatctggagtcaggggtgaaagtggggcatgataggtagctcagtaagaatgttattctgttgcttagcagcagactggaaaaccaggagtgttttttaaaagttggagttataaatggaacacctgcatccagttttgattgcctcacttcaagaatgatagagcataaattgaaagaatctgaagaagtgaaaaaactgattataggtattgtgggggactagtatatgacagtaatccataagtatggttcagcatctgtttacttggcctactcagctgtgtcgacagtttcaaggacccctctgcttttatcttcatgaactagaagacaacaaaagaagttgatctttacttctgtaggatattaacactctcctatttttttctttctgtgccagtttatttggcagagcatatatataagtaaaattgcacaccagcctgactgttaatgaaagcagctgggctttctacaaaaggtgtattaactgtcttttgaaagagtgtgatttaatttagtgctacgaatttgttttctgacatgcgtatatggtggtctccttactgcattcttatttgatttaaacaatacattattgtattttggtaagtagagcagggatgagctttcttttaaaagagccattgcagctaacaaagtcagactataagaccaaactgattggcaaatgaagagggtggcttctcacttacagagccagtgctggtaactaagacgagggtgagaaattaaaatagaaagaaccggctttggtcacctaaattaactaatgcaggatgttgttagttgtcatctaaaatgcagtctatttaaaatagaaatgttaatatagctagataatatgtaaaacagaaagatattagtaattactttgttcttaaacacaatcaagaatcaatagttttaatagctgataataagtttaattatcacagataaaactaacaaactttcttagagtccttggtatgtgtctctaggctatatttctgtatcctgattggccttgtagaactttcaatgggaataggtgacttggtggggtgagtatgtgtgccctgaatgaatggactgtagtccagttacagtcaagaagcctaacttgtgagtgcagaggtggggaagataatcttttaatgggggcagactccttatcaaacacaaccatgacagtgaccaataagccaggtgtaagaaatctacctggaaaggacaccattcattagagatggctgattaacccatcctctcacagttggcatgtcctgaggaaagccaaattaaagttataggactgttaatatgtaaactgccatgtctttaaattttttttttttttttttttggtagagatagggtctcactgtgtttctcaggctggtctcaacctcctgggctcaagtgatcctcctgcctcagccttcaagtgcttggattatatgcatgagccaccacatccagccccatgtctttttgactgcaaatctctgcatccattgtaggttgttatgcaaattgatcagtcgagtatctgtgaggaaagatgtattcgactatattattgtaggaaagatccaatacagtgataaaaataggcttcaaaatgagactgcagggcaaggcaaaggtgtgtgaacatttagtcttagattttgtttcatcacacacaaggattttaagaatttgacaaattatctgaaccttaaactgaaacttgtatgttagagctaaaattctgagtctgtggtctagggtagctattaaacatctacagttaggtttagagaactttttcctcaaaggcagtgtaaggaactttattaatttttgcaatttatgatatttagccttttctttttagagatctgtcagaattctaactctccaccacaatgttgatcttaaagttgtgaaagacaatattattttcaaggtgattatgtatcagtatataatctataccatattgtgtatttgaactgtataaaagaataacttctaatagatggttcatagcaaatctggacaaagtaattggatttaaatattctaaaatggtgattatttctacatatgtttagtttcaagtactttaaatagttcttaaaatacttcaactttttttttgttgtttttttttgtttttgaaatggagtctcgctgtgatgcccaggctgtagtgcagtggagcgatcttggctccctgcaacctccgcctccctagtccaagcaattctcctgctgcagcctcccgagtagctgggactacaggcgtgtgccaccatgcccggctgatttttatacttttagtagggatagggtttcaccatatttgccaggctggtcttgaactcctgacctcaagtgatctgccggcctcagcctcccaaagtgctgggattacaggcatgagttactgcacctggctttcaacttttattctatattcttcttcaccaagtttattgaaattggaagagtggagccaaaaaaaatttaattagagaaagatttacacttatacatgtattttacactccagtaattgagtggttgtgttcttaggatttctttggagacatttgttatgcaaatttatgaattttcatttagtgaatatacttttataaaatttcaccaccttactctgagatagtgctctgatgtgtttgaaatgtagtataatcaatgaaagtacatttgtttctgatcacgttatataactagtctatattttagctagtctttgtctgtaatatgtacacttgttacctatcccttattaatatgctttctaggaatcatgttttagaatggagaatactaatttggaatcctactgtcctatattgagtgttataattaagggttacattctttattaaagataaccaacaattcttaacactgagcaaaaaaagtcataaactagttgtaacagctaaaaacttacattaatgtaaaatagcaaacatattactgcatacattgattatacaaggtctcagtatattataaaatgtacaggtatgcataaatataattctaagctataaatctggactatctaaaagttatatttgagtataataaatattggttatttttattaagtagttttgcttagcactttagaagcctggagggtgggaagttataaagtttatgggtaacgtttcttaaaaagctgtcaatgaaaatttgaattaatgccttttatctattaataaatttcttcttaacaagtaaaggcattaataataattctttataactgaatggcacttcatatctgcatacaccaaacttccacatctgttatccatcatttcactaactaaaactgtttttgaaattgaaaccattgtttttttttttttttttttgagacagggtgtcactctgtcacccaggctagagcagtggtgtgatctcagctcactgcaacctctgcctgccaggttcaagtgatccttctagctcagcctccaaagtatctgggactataggcatgcaccaccgtgccaagctaatttttgtattttttgtagagatggggttttgccatgttcccaggctggtctcaaactcctgagctcaagtgatctgcccacctcagcctcccaaagtgcagtgaaatcattttcttagcagtagtcattgtagtcattgtagtagtctgagtatttggaagcttcactaaaggacactagggggaataaacttgctaaacaaacaagaaggcagttgtgaaagtagggggaaacagtcttcctcctgttataatcattggagtatggtgtttatggactaattcctttgcagtcctttcctgagttgtataggaaggtccggaaccctgatgctataagcatgctttacagttgtttttgcctaattgcattaataaaaactgttcacgttgaacttgtctcttgcctttctctccagttataacttgttataatattttgctgtttacttctttacctttggcatttcacaatggctgagtgtcatgtgaccaacttgaatatttaattatgtgtttactcttccagtttgatcccaggttaagaagcgtatgcttcttatgtgtggcgaattgttgaatttattacttgaagttattcattgggttttgaagctgctgaacagggttaataggtagattttaggtggaatgtaaaataaatcattgtttatgaacatgtattctactgctagatgacagcatgcacctagagtatgttttggtaattctgtagaagaaattatcatggacccagtcactccttagtgaatgccttgccatagttgtttaagtaaggttgccctttgtttgaaaattacaaactcatttgaaaatgaatctgctgccttgcactattaaagctgctattttaattatattttagttttatagaactactcttgtacttctattgaatgagttttgagacctaaccagcagaatgtgtagacttggggacctgaaagatactttatgtcttaaataagaggttcatagaatttttcacttttcatttctgaataaatactgtgccattttcacagtacacctaataatatagctttgatccatccatttgtgtgttctagatatgtagcagtgctgcatatactcattatagtagaatcgttttgttctcctaagtagagattggcaaactttttctgtgaagggctaggtagtaaatactttaggccttgcaggccctatgggctctatcacagctactcaatcctgctgttgtagtgtgaaaacagtcacagacaatacgttaatgagtgggtatgtctgtgttccagtaaaactttatttacaaaaacaggcagtaggctggatttggcctgtggacagtagtttgccaactcctgctccaaactattgagttggtggtctctacaaaatcaggtccttctgtatctggaaatgaagagttaatttctccgtagtttattctctttgctttgacatcagtaacaacattttaattctgaatactaatagcatggagaaagaatattttaaagatattttaggaggaaacgggttgactggatttaaagacattgtaaactgattccataggcatgttctctaaacctgggtactcccagagtctctggcttttgctgatgagctttgctggagaaagccatgaaactgtgttaatttgtgcttagtcacctcagtgctacctgtcagccctttgatttatttctatttgacctcttgttaattcctcacagtatctcttccaaggttatcattgttctttccattaccatcacttccatctcgcaatatcttggtctcagcatttgatctcacgtctcttattcagcaaagatcagttatatcattcaacataaatctcttttattctatgttaattccttttcaagctgaggattttaaaaatgatagttctaatattaaatgattttttaattcccagtttaatgtacagactaagttactgtaaaatatttgctgtgaattcctcttctatgacttgaaattctcccagagaaaataatgcatctaccatttcacaaatgttttctagacatatataattagacttcagttcaaaagtgagttaggaggatatgctgttaggtctgtgccttaaagttacaatctttaagatacacaataagcagaagttgtgatttctctgaagaacagtccagacaggttaatatagtattcttgacaataaatattttttcttaccattatcttactttttttgtttgtttcttttgcagacaggttcttgctcattcgcttaggctggagtacagtggcatggtcacagcttattgcagccttgacctcctggtctcaagcagtcttcccacctcagcctcccaagtagctgggaccacaggcatgtgccactattcctggctaattttttttatttttatttatttacattttttgtagagatgagttcacaccatgttgcccaggctggttttgaaatcctgggctcaagctgtcctccctccttggcctcccagagtgttagaattataggcgtgagccaccacacctggccttactcttacttttaattcaaagaactgattgtatagggaatttatctcaaactgtatcatgagaatcttattgtcccagtctggggataatcagctaggtgacagtgttccaagccaccccacccaggagtttggatggaagtcttagagaaagaagagattttgttttgggcagatataccaaaaagtatatagtgacctggtattggccatgcctcctggtcagaactgagctaagccttctactggtcctgcagtatccgcagtgccactgcagagcaggacctctataccttcagcagaagtcctggttctagaagggagcaatgtgcaagacccttagacaaggaggaataaaaaaagatggggtcaggagatggcagttcaaagaaatagtgaaagtaccttgtgaaaaagaactagaaattttgaaacataaatagactaaaacaagaacacatagttgtgaaaaaaactgattggaaatctagcaaataaagtatagtcattaggaaataatgaatagatgtgataaattctaaattggacacaggattactaaattagaagagaagtctgaggaatgtactcagatttctaaaaggtatgtcagacactgctgtaagttttatacacacccacacaatctcaatcaataaatctctctctctctctctctcatttactcctaaggcaaggcagtcctactcatttaataaatatatattgtgcctactatatactagtgactctgttatttatctattgctatatatcaattgcttcaaaattagtggcttaaaacaacctacatgtattatctcacacgttttctgtgggtcaggaacctgggagtggtttagctgggtagttttggctcagggtctctaaggaggttgcagccaggttgttatctggtgcttgactatggctggtggctcagcctccaaactcagggggatgttgctacagttccccttcagcttgtgaccagaggcccctgttccctccacacaggcctctccataggctgcctgagtgtcctcatgacatcacagctggcttccccccaagggatcaagttgggagggaggaagccaagacaggagccacagcctttttataactgtattaggagggttccaaatcagaaccaataggagataaagatatttattataaggaattggctgacatgatatgaggctggcaagtctcaaaatctgcaggacgaattggcaagctggaaacccaggagagctgatagtgtagttgtagtctgacaggtagcaggtttaagacccaggaagagctgatgtttcagtttataaccaaattcaggaagaaaccagtgtcccagtttgaaggccatcagacattgttttttttcctgaatttggaagaattctctcttatttgagggagggtcagcctgttttttctattcaggccttcagctgatcagatgaggcccacccacattaggtagggcaatgtgctttattcagtctactgatttaaatgttaatctcatccaaaaacaacctcacagaaacacccagaattggcagggcgtagtgactcacacctgtaatttcagcactttaggaggccgaggtgggtggattatgaggtcaggaggtcgagaccatcctggccaacaaggtgaaaccccacctctgcataatataaaaattagctgggtgtggtggcacatgcctgtaatcccagccacttgggaggctgaggcaggagaatcgcttaaaccagggagtcagaggttgcagtgagctgagattgtgccactacactcaagcatggggacagagtgagactccatctcaaaaacaaacaaacacccagaattatgtttaactaaatatctgggcaccccatggcctagtaaggctgatacataaaattaaccatcataaatgtaatattgaaagtgacctatatcacctctacaatatactgtttgttaaaagtgagttgctaagttaagcccactctctcaaagggagaggaattaagctctacctctggaaggaaagcatatagaataacacgtggacatatttttcaaaccactctaaccgctggtactgggagactccagtgttatactccagtgttcattgaatagaagttactgaagaaaaaaatggaaggaatggtagaaaagtaatatttgaagagagaattgttaagaatcattatctttcatgaagagagatatgagtcttcagatcaaaatgggcacttggggttttaaacaaaataaatgaaaatacatttttagacagattgtgatgtaattgcaggagatcaaaaataaagggacaagagctatcagagacaaaagatatattacctgcagaggaaaacaattagattgacagtagacttcttatcaagtaagagactcataagcaatggagtaatgttttcagagtgttgaaagaaggtaactgtcatctgaaaattcgaagtctagctaaactttcgttctagattgaggaaaaatctcaaatatgcacaataaaatttattttaaaaaaagattgagggtaaacattaagttatttaagtttctgtctttctgattccccatttataatgataggataggtaaataacggtatttaccttataggttaactgttctgttcactgttatatcccaagtgcctaaacggtgcctaacacatagtaggcatgcaataactgtttattaaatgaatgaatgagtgaataggattgttgtgaggatttatatatataaagaatttacagcaatgctacctgacatgttaataagtactcaataaatgtttgttgttaagattttatcacctgtagacactcagtaaaagaacgattaaaaatatttctcaacaaaaagacaaattctgtaaggaagtatcagatataaaaaaaaattatgacacagaaattgataaaatgctagtaaattaactaatgaccatggaggggagattaatttaagaaaaattaatctttttgtattatttctaaaaggtaaaaactaaaacctttaaggtgattctaaagttcacatgaaagagcaaagggccaacagcagctaagagatgtttgaagaatgaggaaaagctatttgccatactagatttaaagacttatgaagtataataattaagacagaaatgttggtgcagggaatggaaaatagaccagtgaaacaaaatgacccagaagtagactcatgcgtatatggaaaccttatatatgacagaaagcattacaaatcagtggatacaatgaagtcttcaataaatcaaactggaacaatgtggggaaaatgaaatttgatatcctaccatataagaatcaattgtagttgggttaaaaacctaagtgcaaaaaagaaagactctaaaactctgattttaaaaaaaaagaatcttagattcttccttagctaaagaagaactttttggaaaaaacaacaggatacaaacataagggggaaaaggattaatggcacatttaatatagtcatattaaaatttaaaatgttcacatctcagaaaatccagtaaacagtgaaaagacatgcctcagagaaggtatttatagctgatataactgacaaagattggtatccagcatgaataaagaattccagaagtcaagaaggaagaaacaacccaatggaaagaaaaatcagcaaaggatgtgattaagcaatttacagagcaggaaatatgaatggccaatgaacatatgaaaagatcttcagtctcactagtaatcatactaatgcaaattataccattctgtactcatgagacaggcagatattaaaaaggatgaaaagtctacgtatgttggtaaagatgtggggacctaacagtcttacagtactgatgggagaataggttaatttaagcactcagaagagctattttgcaaagccaaataaagtcaaagaatacataaacacctggaaattctccttctggtgtgttctctagagaaatactcttctataaatgcacaaggaagcacataaaggaatgtttattctaacactgtttgtaatggtgaaaattgtaagcaactaaatatcaatcaaatgagattgtatgctattatatatttgcataatggaatattatacaatttctaatgttaatattatatgctacttatggatacataacgtatagtaaaattgtatattttcaagcatgttttaaacaccaagtcataataaaggttacctctgaggaagtacgtgaatggatggagggatacaaaaatgtagtgaggtaaacaaaatattgagttgataaattgagtggtggctacatggttattatgggcattcttttggaccctacacttgtttgtatatttgagattcttcatagtaagtaatttaaaaataaattaccaaacaagtttcattaaagattagtggactagagctatatgtatcaacatggacagatccctcacactgatgaagaagatgcagaagtatattcacatcgtaataccatttatatagaaaccatgtagaacaatattatgtgctacttatggatacataatgtattggaaaattatatattttcaagcatgttttaaacaccgagtcatgataaagtttacctctgaggaagtatgtgaatggatggagccatacaacaatgtagccagataagcaaagaatgtcaaaatgttaagagttgacaaaactgagtggtggctacatgggtgttatattggaacctatacttgtttgtgtatttgagattcttcatagtaagtaatttaaaaataaattaccaaacaagttgtgtgaattatatgtatgtgtgtatttatctctatgtatgtgtattttttaatttaaaatttcttaccaacaagaatttatgagattctttctaaaaattctaatattctctggatcttacttaagggaaaatcttataaaacaaccttttaatatggatatggtcctgtaattaaaaaaaaaacaaacctaatgttatgttcctgtctgttaattagttaacatggctaagtattgtgaagaacctgaaaattaaattatcttaatataccctttctaatgttaacattctgagagctacatgggattgttttataaatgttgttatgttgaaacttaagtataaaatcaatataaactttttttgtttaaattcaaagaaatgctcaataatgaaataattagacttaagtataatagtcctctgtggcctattgtaactattattatttttgctttaagtaaccttacatttgagaaatattttattactttattttctcaatgagaatctttatctgggatttgaccaaatgttttacattttcattgacacattcttcacctttccctcaactgatagtttttagtttctgatcacttggaacagatttttacagaagttgtataatatcttaatttttaaatatatttaaaaatgtataagatattttgccatgtaagtttgaatagttttctccttaattgataaaagaaaaattagaaatttgaatattttgcattattttgtttttcacaatttttcatagcagacttttttaaaaaaatattttagggtgccatgattatgtagcagtctttgggtttctttagtggtgagaccattttcattgcacaggatagatgggcttaaatggcaggaacatgactagaaagtacatattatatatatttcagtcagcatgttgctactgacaggtgctcaatggttgttggtatccttgtcagcaaagagaatcctttgacattaaagtcaccagctcaatcctgatttggggtgactctattggcagttccatcaagctgcagctgatcagtgaatgtcagagctgcagccattcttcaggagtgtcaccagcctgctgcgggttttttgtctttttgtttttgtttttggagggaggagtggtttagcttgtcttgttgttcaattgtagccagactttcaaattgcttacctttgggaaatgaaccgagaggtcatagggaatataggtatctttagggcatccaaaaccatatacaaagtgattacttacatggagactagtaatgattaccttgactccaagccaatcaatggtggagcctctggggactcattaaatggcatttgtggactctgtaacctagcttttgagctgcatttcaggaaaagcagtgacagcctttaatgtctaattgacctcttctctttgtttcactttcattcactttccatatttgcctctgatgtggtccctaatggcagcaaacagcactgctcagcattttgaacttctgttcagagcttcagcacctcagtttaggcagttgtgtcatggtaagtgtttgagaattctttatactactcaattacttgttctctttttcttcctatgggtgaaatgtatcctgactcaccctaccccacacacacccacagtttttcagatttatggttctcttctttgtcccttgctttcaaacatttttcttaaattggaaagtatgtctttgaaacactgacattatttatccatgagagcaaggaaagaagtatagcgtggtggaatagagtatagttctgcctcaagccagatgttgtctccgacaagctaatcacctctctaggtttcttcacaaactaaggtgttagtcatacctaaatgccgatagttcagtaagtttttcactaagctcattttagcttttaaatcctgagatacttttcttgaaattttaatgataatagataggtttattttatctgtttgtttttgtgtttgttttactgtccttactggtcaaaacagaaagattaacaccctatgttggaactcttttttgtgtgtggaaattttactggtctgtgaaatataaaagcctagggactgttggactagataagcttcaaagtccttccagattttttttttttttttttttttttttgagatggagtcttgctctgttgcccgggctggagtgcagcggcgcgatcttgactcactgcaatctccgtctcccggattcaagcaattctcctgcctcaacctcccaagtagctgggattacagggatgtaccactatgcccggctaatttttttgtatttttagtagagatggggtttcaccctattggtcaggctggtcttgggtttcaccatattgagtaggctggtcttgaactcctgaccttgtgatccgcccgcctcggcctcccaaattgccgggattacaggtgtgagccactgcgcccagcctagtccttccagatttaaaatacgattttatgtgcccttgaaagagctcatggaaagagttaaatgttttaatctaaaccacataattatatagcttttaaataatactgagatataaaggacaatagaaatcttgtgtggagaaggtgtgcatgtgtgtgtttgtgtgcacacataccgtaagtgaatcttccagtgtaactgactggaagaattcattcctcctcacttcatcccctgttccctaaaacaatgtaggtttaggagatccccagaccattccatttctgccttgcattcacttagtaggaagacttgaattagcaaaatgatggcaagattctagaaaacttctggtatgctagggagtatttgctttaagtaaccttacattttgagaaatattttattagagtcaatagacagggtccctgacctaaaatgagtaccatttgaacacctcttagagctcagtgtggcttcagaaatgcctcaagatttggcagtgtagactaagtaggcctcttttgatgacatatttatctctgtgtccccatggtctttaaaatcttgtggttaggtcttattaaaccctaagtatgggctcaggccatctcagtctctagaaacagtcttgggagcccactagattttcctcacttctggtcaaattctttccatagtaagccatttgataggcttctgtgggtctcttcagtgactcttcttgatggacccgatgacatttgatggcagtttctgtcacaacaaaccagccagttactgccacttggatcttccttattgctagcctgctctctttagattggtaaggaccatttaactttgcttagatgtaccttattctgcttgttatttacctccccttaaactggagcaacattccttagaaaatcaagcctctggccatagactctttactgttggaattatatatatgcttataattgaaattgtgttattttcagttagcattttccagagttgacccatggaaaattacctctaaaggataatcaattttaaaggctgtgtatttgggggtggagtggagattcctaatgaaattaggaagccaggtatggttgctcaaacctatagtcccaactactctggaggctgatgtaggaggattgcttgagcccaggagtttgaggctgcagtgagctatggttataccaccgcactccagcctggtcttagagttttacaatggtgtgtgctacaacaaagaaactgtttacctttgctaaaaccagtgttttcaaaccttgcctgactactgaactcatttttctatattacattttccatattacattttattgttgactgtcaatataatagcaatgtttagatttgtgatatttatgaagcaactgttcacagtatacatacatagagcactgtgctgactttcccatggtgattgtgatctattatataccttcgctgagtattcacctcatggcatactttctctgtagtgagtttaatgtagatactaaattagttgtgtcactttttttctgaaactaatctttgtgccacaagtgccagttagacagatttgcagtgacaagaacttctgaggagcagtgtctcacctgtaataaacctgaatattctagtcaatgccgtaaacatgtttttaggactacttagaaatatttatttttcctcttgattgggaaagagacaaattttatctatttctttttacttctaaaaatgactttaaaaagtttaaattccactattatataatgctgattgaagtaatttaaagttgcctaaattaaagaatcctaagacctacctgctattttcttaagtttcctactaattatgtgatcctggttaggtcacttaaattcttgctgatagttcctctgtgacatttgccctatttttaaaattagataatgaataagaaaataaatatgtctaatatttttggggaaaaaagagtcctgcataatatctaaaatttagaaggaattatagttaataaaggagggataggttgactttgttccagtaaaaagtatttagtttcatttttattttcccagccctgaatttggcatgagtagtgctgtgataatttcacaacaacaacaaaaaactcttgaaggaatttctcactgtgttctatgctagtagagaatttgttcaaatgctgctgagattgcccaggcacaaattgggcacagtcagaatcataggtttcataaagtttttaaattttttttttctaagtaagctaattggctgccctaattatcaaacccacagttttgtattgttcaggtatactcacttaaggagatatgttcccccaaacctgtttctcatagacttccgcatgattccaccatacatacactgacatccagaaccttagaaatcattacctctatatctaatctgtcagcctttggttctaactcaaaaatgcagccccaaatctgtcggatttcttcattccaccattgccaccttaatccaagtccctgtcatctgtcctttacactgttgcagacctcttcaatgagcttccttctccgttcctccccactataggcccatcctccagacagaagccagaggtggttttgtgtcagtttttatgtaaataataatatgtcactcctttgcttagaaccctccattgacttccttagtacttgaaagaaaaatctaactccttcatggtctaaatgtcctggccactgcgtgactctgccctccatagcccgtcctctccctcaccacccttggactgtatggatctcatttttgttcctcgaatgcatcaacctcattcctggagatttcagcaattaccacctcttccctcaacccgtgacactctgatcactctcacatcactctgttttattattttcccactatatgtcactctttgaatgtattttttccttaattagtctgtgtgtctttcctaaaaatatggacagtgtctccttttttcagtttactgctggtcctagcatctggagtggtgcgtagatgtttgttgaaaatacaattaaacaaaagaacaaaaagaaataatcattgtaattgtttactattttgtttccttttgataattttccttgtgataattttaatatctgattttagcaaaatcaaatgaacctcttaaaataacctatttaaagaaacattattaaagcatgtaaagcccaataactgaaatgtttaatccttgattagtagagtcttgtcctgtaatcatgaggtaagcactggacacctccaataactgacagttgattaacatattgtaatctaaattattttcatgttgtatatgcagtccccaaatgcctcatttaagccaaaactagtatccttattagtattatcagcatttccacatagtgttttagagcctaccagatacacatcagggagatcatatatacttgccaaagtatattagccatatataaaacggaggaaagtaggtgctgtcaatgagtagcagcagcaaggttgaaatggtgggcataaaagaagaacatataatcctttaattcttcatgagagactgaagacatagactgctttgggatttaattcattaacatcttctgtctggagtgctcttaaatggatttttaaataaatgagtactcctggctgttttatgaaacagtggcagatccgtgaggtcagtgggcagatctgtattaacaaggatgtggatttgtttacatggaagcaaagcaataggttataattaagaatctgacttactctaaacagtttgcatgtctgagcataacatgtaaaagattggaattatttgatttccagattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacatgagctgcgctctctatttttattaaggagagaagaaattaattcatttgtataatgaattcaagctagttttttttaagtttcttaattaaaattcttgattaaggaatatcgtgaaatctttatccctgataattctagcgtttaggaatagttctaccccaggcagatctattgaaaatcttttccagctctgggatttcttgaatccttgctgcattcatcagaaaggaaccctgtgtaattttgttgcttcttacttttagccaggggtgctagcagtgtcacagtagttatcattgtccacacaattgatactttgtgaagtcatatcgcacttgcacattttacatcaaatgcatggtgaaaaccattttgaactggggtgacagaaataggaaagtctggaggagctgatttgaaggggtaggaggtaggaatgaagatagtgggtaggatattggcaagattcaggtcctagatgctaaattggctggaaaattcaacttttacttttttaacagaaccatttcaatatgaagtcatgtttgaaaaaatgattttaatttgtaaagggttattttaagttcattacaaacaataaatcatggatggattcattgttagcacattatataaatgttatacttaaggtgttttgttttgttttgttttgtttcccttaaataggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacaggaggtggaggcaggaggattacttgagatgggattttgagactctagtgtacttatgattgcacctgtgagcagccactgcactccaacctgggcaatatagcaagtccctttctcttaaaaaaaattgtagtgtttccacttttcttctgatatttttgtctatttcactactggataatgccaatataaaaatttgggtataatcaagaataagaggtaaactactaaataaaaaaagctttccaactgttagaagcagatgccttaacattttgtgaaaggtaaagttttgaggtttctgaattatataaaaaaacataaatgtggagatatatattatatatacacattatatatacatattatagataatatatatccacatttatgatttttaatatatacatgtatatattatatattatataattatatattacatttatattatatgtaatgtacatgtatatattatatacatatatataattatatatattatatagagagagatatatatcttgctagggtgtgtggatgctggaatataacgattttgcacttaacaggacaatgaattttgttatactacagttaatattagttttgtgttcaaaacagctgtgccttttcatgccacaaaatattttctgtctactttctgagtagcagaattaattcatttttttaacaaaacgatgtatgtcaagtgttcagtagtcacatgaggagaatgcttcctttgtgcctggcactgtttcttgtgctttgcattgactaattcaattctcacaacaaccctgtaagataaatgccattacttacccccatttacagatgaggaaactgaggcaaagaaagattgaagaatttatttatgatcatacagctgctagtggcagagccaacatataaacccaggccatctggcttctgaagcattgcattaaacctgtgcttttaggtgttcagggtagcttctggctctagggcagaggtcaggaaactttttctataaagggccagatagtaaatattttaggctttgtgggctaagaggtaaaactgagattgttatgtagatacttaaataactagagagaaataaaatttgcacgaaaattttattgacaaaattcaaaacaataatttagaacaattttttttgtaatacgggtttactaatgaaaagaattaaatatttacagggaggatcaaagttaatgtttcgtgtcattaaagttgattgtaagtactcatttgttaatgctgatctgtaataagattttatgtattttacttctgaaaattccttgcagataggtattgtcaaatacttacattaatccatgagaatatgatttttgttgagcatattcatcacttgaaaggttacttcttctctggatattttccttttagcatgtta

SEQ ID NO: 17454 - DNA, 9509 bp, Human
atggtccggatgggggagggggctggctgttgagcaactgctccggagacactccagaagccgagatgaacatatgcctctttctaacaattggcctgggagccatccaatagatggagggcggatccacacctcccggatccggagcctgcagcggagaagctgccgctgttgccagacctgctcccgagccaagccggggctgacggggagggtgggtcaggggttcaaattagtaacatgcaattcgaaagcctagagtcgctcattctccaccacttagttttcgcagaaacattttttttcatcccaggcaaacaccaagagaacttgagagtgtatttcacacgcggtttgcagtaaggctttagggtgccgacagatcccgccttttatcagagggagactaggcagggcccacaatctggcaagcaaagtgagaaagtgcagcgaagatgtgtggggtgtggatgctaccggggtttgtgttgggacagggtaagtgaaaagactggagctgtgcaaggcagccttgagggctggagaatgggtttacctggcgaccaagacactcgcccaagcttcctccagatgccgaggaagggccttgatccgtctctccatttgcttcccatctttgtgtcggtaagccggtcagtccgtcaacaaacagaactttgttagaagagcaaatgcagggcacttggggctactaaaaaaagaaaaagaaaagaaaaagagaacttcaggtcttcaaatccaattaagaagacagaacacatacatagtgaaaatgacttcgtgacattccctcccccccttttttaacatcaggaccttttcttaaagagtatgttttataaacagtgtaaactgagtcgctgttgctgaaaggcagcaaaaaaagagcggcggggccggggcggggtgggggggtgacagaggggtaatcccgatggcctccctgtaagtggtaaggtgggaatttcttggccacaaagaatccgaattgaggtgaaggagaagacccagacctctttccagtaaggatttgtaagacaacatctctacctaagaaagacgaactccaaatgcaaaacgttattcttgctagacgggaatgattatgtagttacaataaaacaacctgacatcgtgggaaggcaggaggaatctccgcgaaccctggggcaagctcttcgtaccccgttgcctactgttggcttttcggcgagcctagtgagctgtacctggccccacggtccgggagagtagcatttctccgggtcgcatcctgccagcctcctgccctggatgaccacagaacagaaaccctcgaacccaaccccagctcagaacttctagaagagccaccgctgccatataggccccccatgcgactctgcccagaatctggcgactttaagaggaaaaggagcccccagcctcagctcttcaacgaatgagatagtacagcccccccaaaaggcagacaggctccaagacagccctgcagaaaactaatgaccattcccccgtctcgtgtgcgccccgctcttccaggtcactccttgagcccacagctctctcccaaaacccctgaagcccgttttggcccccgactagatttaggtcagaaaacagacactaacggctctcctttgcctcagtgaaattactaagtggaatttattgggcaagtccacgcagggcggtggggagagccggtgtcccgggccctggcccccgacagctttagaagccgggcactggccagggctccgggcgagggctgcccatagcccggactcgccagccccaccccgggagccttggccggtccacagggctgccggactcgcgtggccgcgtggactccgttccccagccggccctttgctttcacacgatccgcggtgactgcaccagctcgagcgcctttaaagggccacagacgccagccgctgctataaaaatgtgcccggcggcaaagctgcagaaggggcaccgctgagctgccgagaggaagctcgctctgcccggctgccctcttgtagtccgccggcgaggggcagttctcggtgaggaggaagagagcagcggacggcacagcacccgcgcgggccctccgtgagtatccagttcagattttgccaccaactcgcccacgagccaggacatgtgctaataatgccctaagccggttataaagacgtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagaggtaagccgggccgccgggctgggcgccgggctgggcggcggggccgaggactcccgtggagcgggtatggggagtgggcggccgccaggcgggccggagggttctggggagacttgctttctgttggaaagctgctctgctgggggcgaggggccgcccgcccgcccgcccgccagcgctcgggttcgctcgccagcgcgcccccctgccggccagcggggccgggtgcccgcttctcccggggagacggcagcaccttttctccctgcgcccgcgctttctccagcttggcttccaccgactttgctaatctcccggaccgcatctggacgctctggctccggagctgcacaaagctcagatttacttcggggaattgaggcaagagggggcttttcgggccgagttcagcggaattgcgggatggaagttagcgaatttgggcaacttgcctctactgcccagtcgacctcagccctcccctcccccgacacacgcccacacacacacacccacgcgcacacccctctccctataaacgcgggctggcgagccgcgcgccgagtccctgcttcgcagagcaccggacttggagtcagagagacctggctgcgaatcccggctccgccactttctagcgctgtgaccttgggcaagttaccgcacctctccgagcctctctcactcttctcctagcggggttttagcactgaccgcaggcggcttggctagggggtaggctcagcctgctgccgcgtcggatgctcagcgggcgctcagtaagtgttgatcaggcgcgagagtggcagcagccggcgccggagtgcggactcgccgcggaggccgacaccccgtgccccttcctgcctgtccatcctgtctctaagatcagttcctgatacagcacttgcgggaacggacgctcagggccccggtggcctgggtgcacgcgcccgccgtgcaagggatgctcccggccgcccccggttccgcggctccatctgggatgcggcgaggagggcagccgagctgtccgcaaacaacgggcctttagttttcaggtggcgaaactgactggtctggttagagcgcgtccaagccaagccgcagtgctgtttggatttttaaatttctccttctgagtgagaaaatagcaatcgagatggaaccatccggttggtgccattttaacttttggtcccccaacaggttaaagatgaggcccccacctgcctctcccttctcttttccctctccccttcccacccctgtctaggcgggagggggctgctcgcccaagggaaggcctgaagcgaagagcgggcagcgggactgggaactggtggccggggggccgccaggcatcagccggcgagaaggcacttgttgctctaggtttcccagccgcctgtcgcagccgtttcgcagtggtcagctcgcggcttggagagcgggctgggacgtttccgcgttgccaagttttgcccacgaacgggctagagggtggtggaggagggcagaaagccggggaagcagagccagggatgccgatggaaatgcgattgcttcttcagacgcattcaacaacacttactgagcgcctattgagcgcagacccaggctggggtcagggtgggtggtgggtcagtaatggaaggcagaagatctgaatggacacagggcctcttctgggggagctcccagattgaagagggaggcgcggtaaaatggtcttcccccacgaactgatatcagaatagagagagtttttttgctcgttctctcttttgatttttctaatgtttctcttttggttttgctgttgttgctgctgctcctgttgttttttcttcgttttgtacattcgggtaccaagcggcaaaaaggagagggaaggctggataggaacaggaaaagatggacagggcccccagacatttttcttaggacaggaaaattgtctgatactgattgtgctagggctcttgaagacgacatgtgttagacttcttgtctggtgatcacttgcttttgaaatatttttctacggttgcctcagagaaggagcagggcttcaatcaagcaatgatgcgggacccaacagctgatattttttcctcatgtttttaaaaaaatgtttacccctttctctattttttccctcccctacccccatccacccaagtaagcaatgcaaagatgatacagagaggtagtaagtggccactttctagaagtgtctgagcagattcttaatgaccgctgcggagtggagagtgtcacggagaattctagcctccttggaaagattagagactctttttaaggtcctcaagattctttggaccaagaggtatttataaatatgaaattctacatctctaattgatcatgaaagctagaatatatggggctttttttttttaaagagatagggtcccgctatgttgcccagcctggtatcaaactccagggctcaggtgatcctcccacctcagcttcctgagtagctgagactacaggagggtgctactgtgcctagctatgggacatttttttcttctttgtaaacaggcctccaggaaaataagttgagattttcagaggtttgtttattttctggtttggaggtattcttttgccttcattcccttatcctttggcacttgagccagggaatcacttctttggaagccttttgaatccagctaggtatgatgacttagccagtggtcaggtgaggcatgtggccataggggtgctagattctgctcccagaaccgctgctacctgactaaaaaggcattgaatctctgtgcctcacttgtcactatagatgggaatggctggactcaggtttctggggtaggcatcctaggaaagcccaatgctggggctgtcttggagggggcttgagacatggaggaaagtgacacattcctagcttctctggctccagctgcctcagagcccccagaccaccctaatcagcctggcttctcacaggcatgcccaaggtcatgctttggagctccatgacatttgcgctagagacttgttatttccctgtgctgcagcctctagctttctaggtcttccttgccctgacttcttctcacattctcccagtcccagtggaggccccaactctccagcctggatgctagtagcccattgagacaatatgttgcttactcagggacattcctgtcctctgaaccaggaacagtgccaccctcacccccacacatacaccttgggactgtgaagtcacttgcatgaggaagcagtatgtcccatcttggtgatatgggtaggtggctgcctgggcagtacctggccgaatcaagcacctttcctgcctcaggcaaaagttccagcttgatctcctccctgtgctcgggtgatctctggtcttgattctaactcagtcaccatccttgcctcatagctgcgtggcattgccctgctttgggctttgctagtgctttgttggtcagtgaagccttttgcccttaccactgcttcttcctcacttgcagcacaacagctccagctggcagcatcacttcccgccaatttatccaacttctgccaaggctctgaaatgccaacaacgtcgaggcctgcacttgatgtcaagggtggcacctcacctgcgaaggaggtaatttttgccattttacagatgaggcagggaaagacaaattttccggggtcatgggccaggccctcctaggtgcattacccagtgtccttgagcagagaggagacaacaggactatctctggggagaatgagaacagcttctgcctaaattgtggtcagattgaacccactaggggtgttgaaagatggcagggaagggagcagagaaattgagtaggagcaaaaccactctgttgaagagactaaagtgaggctgagaagagggacaggaggtgccctttttaggatggtgaggtggaggctatggggaaggagctgaaagcagtgaacccacttaggatggcaggtgctccagcactgtaactgggctctggcctcagtgctcagagccatggcagcaaaaggatgcttgaggtgggagcctaattttcaagggggtcgtcttgctacctctccacctctagtcccaaatgaagtgcaggtaggaaccttctaaatctgctgaatggtgaaggacaagccaggagcagggttactatggtgtgcttttctctgtcttctaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaagagacgggccaactagaggtgttcttcattgagatctaatgatgtgtagtatggtctgatgtccctttagcaattctgaggcccatggcggggttgtgagtggctagctgggaaggagctggatgggatggaaggagaagggagggtgaagggggctgttcactgaattcctgctgccagcaccactgtggctatctcctcaggagtacctggtctcattgccctaagactccaggaacaccatggcatacaggggctggttgggggctttcttggaagagagactgatcagacctttgtgcagcctccttgctacatgcacatccaagtctaaaggcacattcctggccacgtggcacacacttcaccaactgtaaaagccacccccacccactctctagccccaatccaactgacccattaaggcctttcctttgccctcttgcccatgtgcaatagatagatagggctgaagaaggatcctgtgacctgggagctcagatttctctggaaaattgcaaaagcaagagactcccatcattaaactggggtttgaggtgccttctccaggttcctcacatagctgctcagtcctcccagcctgggacactctgagctggtcttgagtgtccctaactcctaccttcctgacccaccctgtttgagctggcctctccatcttagagatacagatcagaactaggcttgacaagttcaacatttggcgatctatcccttgcctttcaattaactgctgaggaagcagtggcttcagaagcatgccaagtggcaaggcagtggcactgcactggatcctggccttgtgatacactgataaagccttgtcctcatgttgatacaacccaatgtcctggacactctgtccatgtttcggactcccagacagccttcttccttgaatgctgaaaacgactctaatcagcctctcaggactagcatcaggcctgccccctagcaagcactttcaaaagagtgtgctagcaggggcgttgattggattcagcactccctgagcacctgctctgggccaggcactttgctagacactgggagcatgaattagatgaagtttacctttgagggagttcctcatctcagaaggagaaagacaggcacaaacaaattataataaaacagcatttcctagaacagagggggaaggtgctattcaatcccagaaaaggaaacagctccatctgcctgggaagtctggggaaggctccttgtattgaactgctttatttgttttcatatttcacaagcaataaatccattatccaatctccttgtaaaaagtagaagctttgcagataaggctaaagtaccctttgaccaaatctccccctcaatcctgattgcctctggttctccacggaggtagcaactgtttatctgtttgtggtgcatccttgctggccttgctctctgtccttacataaaggtagatccaccagaagaaagttttggctttcgaaataagacttgaatcagccaagggaagaatgagtgaggggaacagctgttaaacaggcacaggtgcatgagaggggtgacagtggctgaaaaccaggagttcagcatgcaggctatgtcacagggctggcagaggggacgggaggagatgaggttggagaagttcacaaaaggcagagtccatagggccttctggaaacaagccttcgccttagtgccaccagtcctgtggctctggaagaatctctggaggtttgtaggaaagcaaataattaaccaacttttaacatcttgtttttaagatgatttcaataaaggtagatggttagattcatctaaggctgggaacagggagacatggggttttgagggggctgatgaggcaagggtaggaaaacggaaaaggaagaaacgaaggctggaagaaggtggggagagcagagcaggcttgagggccttgggtctctgaggagaacacaggaactggattgggggagctaggaagggaga

SEQ ID NO: 17455 - DNA, 27543 bp, Human
  misc_feature (1)...(27543): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcaaatactatttctcttagagggatttattccaaattaaaattagtgataatttggagaaatatttcctaaagtttgaagtaagtccttgattggttctaacaatgattaatatagatagggatcagtgaagttgaacaaaatttgcatgtgtatctgatatctcaatgtttttctgtagaaacgttacctacttttcaaaaacaaaatttttttttggaaggcactgaggtgggggagagtggtgaagaatagaattcccatatacttttctctccaggaacagagacattatcttacaaaactgctgaccagaaaaggtcagagtcatggttagctaacatgtcttcatcctcccaagccaaatcgcatagaagccactggagaactagtttggaattccggcttcactactatgtagttgtaggattttggaggagctgtacaggttcactgagctttagtttcctcattcacaatatgacgataccaatttcttcctcatattatatctaaagacatatctatgtctatatgcttgatcgtacattatgtgcggagataaaccggtaacagtgattgcctctgagaagagagacttactttccattgcgtaattcttaggctcatggtagaatttgtgcaagtggatgaagcactgcctcactgggaaacactccagtgaaataaagcacagaaaagagcccgaagaataattacttggttctgtatgacacatgtgcttttaaagggttgtagtgtaggatgacattgggtaagtccatgggcctagaagcctaggtggagttcttaggattttgtatgtagactatgaagttttggaaacgtttgagctggagagaagacattctgatcaaaggtggctttcaggaaaggctggtgcgacaggcagggtatttattagaatgaggccagtgaccactctgaaacagacacaaagtaagttcccttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagagaccgatgggaaaataggatgataggttgggagtgtaaagtccttctgtgtcttgctaaggaattgaggttttccagtaggcaacgggctgtcatcagaaggcctttcgttttaactacatcattctaacaacttagtggagaatgaattgttgagagaggaggctgaaccctcctgatggcgctaggtcccaggttcgctagtgtcctagaggggatcgggttgctccacaggccgttctggagggcgctgcctgtgctgggtggctttttaaaaattttattttatttatttaatttagaaatagtagttgaaaactatttgactaatgagagaaaacatctgactggccctccaggccaggtcatctgtctgtccccacttagctactataaaatcttcatggaagtttctcaatcttttggtttgtaccttaccttacctctgccttttttttactaactacgtcttatatccttctaaagactcatttatttataccacacttgatattgtatattcgcatttgctgattgaatttcgtaattggttattattttgtgtttttatgagctgtgtcatttatttctctacattgatctattatctaaccataacaaggaataaaatttgttgagtgccaggcactttcttaatgattttacaaaattcgaggtggtagctactactgttatgcccgttttttagatgataaaactgaggtacggggcacttgagtaacttgccccaggccacacaggatgtaagtgaggtatccagggtttgaacttggacaatccgtggaggtccagactggcagcttacccctcatgctctgctactgggaggaggtgaggtagttctcatgaatcgccctacttctcctggtcatagcatagtgcctcacacatagtataagctcaaactaagtgtctaattgaatttccatagggccttaaatgttacattcatggtgctcagctagagatggcgtcagaaatctaactcgggaggagacactttatctgagggctttataatgtcttgaaatgctttttccctacaatgtcgtggttatttttttctagaccttaaaatttctaccaacataatgtaataagcaacccaaattttatataactgtttatgtttccaaactattaataattgaagtgacatggtattgtagaaagattattggcctctaaatagaccagggtctgaatcctggctctgcttcccagttgctgcttaaccttaagcatattattttaccactttgagcttgagtttctttaactgaaatagggatgacaatacttagagagttgttatgggaaacagagaacatgcttgcagtattgcagtgtagtaggtgtcgaataggtattaatattcatgatgataggaagcaatataccatagtggttagaagtcagacccagtccattccccaaccccgctgaggcagtaatttgttttctttctctgcttgaattgttgtttcacccttgtccatttcatgacctcttcatctttccacatctagttcagatatcatctccctgtagttttctctgacctctaccccaaaacaaaatccctggcactttgtgtccctgtggcacattatgctatacataggtgtcacgtactcttataagcgtttcacatatgctaactcatttaatccctggtgacgaaaaggtacttgtacagatgatgaggaaattgaggcaaagagaggttaaataacttccctaaggtcaactcatctaatgagtggcgaagctgggattcaaaccaggcacctcctgtctcttaaccacagcctatgccgctatagttaattcttgctaaactccagcacctgataacatgtatcatgtgccagaaacttacacttctttctcttccctgcagtgacccttctaggaagatggcatctctctttaacatacagaactcagccattatctctcagcctcaccttttcaatttcctttactgtctagtttgatggcttcttagttcactcccttgctgtgtttctcttcctttttcttccttgtttcagctaagatattctctggtagctagtaaatatggataagaataatgatgtgaagatcttagaagctataagataattgaagttacttataataaagaactagagttctgtaaagtactagacgactcttgtagcatctcttttaagtttcatatattttcatcttgtttctgatccttatctaattaactagcctttcttcaaggatcagcatgtggtataaaaaatattttaacatcagttttactgcttttcttttgatcagttattactgttacaaaagattattctgtttgccttttaggtttactttgtttcagttatttgatactgaaggaagcatttgtggattgccttgggaacccagtaaccatatttagtatgatttctatggtaaaacttgttgaattaaaaataagtaataaaattgataatcttgacatgcaacctgtaaaatcattttgtgaataggatgcatgaataggcaatgtatttgattgttagtttcatatttactactagggatgcatgggaaatgcataaagtggtgggcaaggtcattcttcttttcctatttttgaataaaaaatgaagaggaaagtgaaagaataaattagctatataatatatatgtaccatctgaaattgtctctaactttttataactacaggttgagcatcctaaatctgaaaatctgaaatccagaatgctctaaaatccaaaactttttgaacaccaatatagtgctcaaaggaaatgctcattggagcattttggactttggatttttggattgaggatgctcaactggtataatgtaaatattccaaaatctaaaaaaaaaaaaaaaatctaaaatccaaaacaattctggtcccaagcattttagataagggtgcttaacctgtacttttagttaaaaacaaacctttggagaaaaacaaagcttttttttcttctatgttttaaaaacaaagcagtcaaaaaatctgagtggcatgaattctaaaatttgtaaagtattatttttgatattaaaggaagatgtagattccttcatgaaacagcctgggaatgagactgcagatacagtattaaagaagctggatgaacagtaccagaagtataagtttatggaactcaaccttgctcaaaagaaaagaaggtaagtgtaaaaatttctaagttttgaaaatcttatatgacttgaacttttaaaaaattgagatataatttacatataataaaatattcagatgtcaagtgttcagtcctccaaggtggctgtaccatatgaaattcccaccagcaacgtacaagagttccagttgttccgtatccttgccaacacttggtattgccagtctaaatgtggttttgaaaacataatagaatggttgttaaagactgtattccaaagctttcaaaatcataacgtcttatatgtctagttcatccttctaattttgccagtgagattagagacccacagagtctgggcataagacttaattagttatgaaatcccaagatttcataactaataggcataggaaaaaagctatccttactctcaactctttatttccctacattattttatatagcttataaagtcaattcactgtaataaatatttatagatctctgttttgtgcatgtgccagcattcttctgtaagataaatatttatggaatgccagctagatgccacatactgttttgggtgaaataacatccagtatctgctttcaacaaggacacaggactgggcatggtggctcaaacctgtaattccagcactttgggaggctgaggtgggaggatcacttcagtccaggagttcaagactagcctgggcaacatagggagacccccgtctctacaaataattaaaaaataattaggctgggcccggcggctcgcacctgtaatcccagcactttgggaggctgaggtgggcagattgcctgagctcaggagtttgaaaccaccctgggcaacatggtgaaaccccgtctctactaaaatacaaataaattagccagacgtggtggcatgcgcttgtaatcccagctactcgggaggctgagttgggagaattgcttgagcccgggaggcgaaggttgtagtgagccgagattgtgccactgcactccagcctgggcaacagagtgagactccatctcaaaaataataatagtaataattagctgggtatggtggcatgcatctgtggtcacagctcctctagaggctgaggtgggaggatcgcctgaacccaggacgttgaggctgcagtgagatgtgatcatgcccctgcactccagcctcggcaaaagtgcgagacccagtctaaaaagcaaacaaaccacacaaaaaactagggacacagtttggtggaaattataggtatataaataaaattagcacacaaagtagaacagtagaggtacagggggatggtaactcattactttgtaccaaagcacctcattaacctggaggggccaaggaggttcagaggaagcttctaagaggaacagatagctgtgtagaatttcaaagattagttgtgagtttggaggcagactaaagtgaggaaggggtagtctgggcctaaggcaccatttatgcaaaggtacagaagtttgtaggtatattttctcatttgattttggtgacagttgtacaaagttgaatatgtactgagtattagatgagatgaaaagtcattgacatggaaagatggagagtgttaatggacagaagcaagatagaaaacattaagaacagtgtgctctcgttttggaaaaaaatgtatgtatgcacaggaatatctggagaaatccacactaaaggcatattaacagtggtaatctctgggtagttagaatatggcatttttcttgtttttgcttagctgttttcttaattttttacaatgtacatgtactgcttttgtgatagtaaaagtttatttgaaaaagaaaaataaagccattggatttgagatcacctacagggaggttacagatagagaagaaaatgtgccttggggcggggtgcagtggttcatgcctgtaatcccagcactttgggaggccaaggtgggcggatcgcttgagcccaggagttcaagaccagtgtgggcaacgtggcaaaaccctatatctacaaaaattagctaggtgttgtggtgcatgcctgtagttccagctactagggaagctgaggtgagagtattgcttaagccagggaggttgaggctgcagtcagctgtgagtgtgccactgcactccagcctgggcaacagagtgatgataccccgtctcaagaaagaaaaaaaggaaaagaaaatgggccttgggaccaagtcctgggagagggggaaatttgcgtatcaaacttaaattgctcttctaactagtaaattaatgatagacaaaaacaaaaaaaagaaaaaagttatattgctaactctacaactgtggtatgtagcaggatactcactctagcttaacatatggtctaggcctaaatgtggggagaaggggtaaaaattcaaagcacttaggaaacatcagtgaacgttggtgttctggatgagaacagtgtttgtctagtgttttaaaagagaatggtagagttggagatagtgagttaggaaaattttcttgagttttacctattttaatagtgggttggtcatttttttgagacaggctttctctctgttgcccaggccagagtgcggtggtgtgatcacagctcactgcagccttgacctcctgggttcaagcaattcttccatctcagcctcccaagtagttggagggctacttttctctttttatttttctggaatttctctcactcctatgatgtcagctatgcaacaaaactatttttgtgtcatgatctagttgttttgcagcagatggctctatgtagtttacatgctagcctttttgttttttttttttttcaatttgctattattttatttaggatttttgaatttctgttcataagtgagttcagcctatttctttctttttttaatttttttagtattgatcattcttgggtgtttctcggagagggggatttggcagggtcataggacaatagtggagggaaggtcagcaggtaaacatgtgaacaaaggtctctggttttcctaggcagagggccctgccgccttccgcagtgtttgtgtccctgggtacttgagattagggagtggtgatgactcttaacgagcatgctgccttcaagcatgtgtttaacaaagcacatcttgcaccgcccttaatccatttaaccctgagtggacacagcacatgtttcagagagcacggggttgggggtaaggttatagattaacagcatcccaaggcagaagaatttttcctagtacagaacaaaatggagtctcccatgtccacctctttccacacagacacagcaacaatctgatctctccttcctttccccacatttcccccttctctattcgacaaaacctccatcgtcatcatggcccgttctcaacgagctgttgggtacacctcccagacggggtggcggccgggcagaggggctcctcacttcccagacggggcggccgggcagaggcacccccccacctcccggacggggcggctggccgggcgggggctgccccccacctgccggacggggcggctgccaggcggaggggctcctcacttctcagatggggcggctgccgggcggaggggctcctcacctctcagacggggtggctggtcagagacgctcctcacctcccagacggggtggcggcggggcagaggtgctcttcacatctcagacggggtggctgggcagaggcgctccccacatctcagaggatgggcggccgggcagagacgctccctcacttcctagacgggatgacggcctggaagaggcgctcctcacttcccagagtgggcggccgggcagaggggctcctcacatcccagacgatgggcggccaggcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgagcgagactccgtctgcaatcccggcacctcgggaggccgaggctggcagatcactcgcggtcaggagctggagaccagcccggccaacacagcgaaaccctgtctccaccaaaaaaatacgaaaaccagtcaggcgtggtggcgcgtgcctgcaatcccaggcactcggcaggctgaggcaggagaatcagtcagggaggttgcagtgagtcgagatggcggcagtacagtccagcctcggctcggcatcagagggagaccatgcaaagagggcgagggcgagggtgagggtgaggctagcctttttctttgtatgtgttgtaaatcttgcagcctgtcatttaactttacccttcaagctgtgtaaaagttccttagtatttcatgtgttaatctctttttcgacacttgaatctgagatcttttatctttctttaattggaaattttgtgattatcactttttctatcgtctgttaattttttttcctctttctttctgggattcctgtttacagatgttgacacttctaattctgccttccatttatttatattatttcccttttttctgtctttgtcatttatcttttggcaattagatggatagccatgagttctttgtttcagctgttaagatttttatagctggtagttctggttggttcctcttcatattaccaatatcctttcttttctctttgtggtatctttaagtatttaatgtatagttttatcttttggtatttgttaattttgtttcatatggtagaggttgttgaatttattgtctttatttattataatgatcaaattataatgtcttttccctgtcagcttagattccctcagggatatcagctactttggccagtaatgtacgtggaggtgggggtaatttaagtcactcctggtgggtagcagtggcgctacctcggctcactgcaacctccacctcctggattcaagggatcctcccgcctcaacttcccaagtagctgggattacaagcatgcaccaccacgcccagctaatttttttgtatttttttttagtagagactgagtttcaccatgctggccaggccggtctcgaactcctggcctcaggtgatccacccgcttcggcctcccaaagtgctgggattacaggcgtgaatcactgtgcccagccaagctactttctcttcaggtgaagcagggtagggaggagtgtattgcttgggcatgtgctgtgtcattggtggtctggttcctaagttagctagggctgcatctgattgattcattaatatgctttatagcatattacatataatatttatatatacagaatgcatcttaaaagtcatttacatgacaaaaaatcttgatctgaacatactccttatgttgtgtgtgtatcacatattttacaaatgtataacatctttctgtttacctatatgaacatatcatgcaaaaataagcaaacttgagcaatctatggcatccagattgaattgtagtgaaaaaatgaatgctaggtgtttctagattattcactggactgtattatcaaatgatgacactatgtttttttcttaagcagcaggctcatttaacacatttcttgccaggtcagtagcacagggtgtagtaaatttgccctgccaacctgctgcacacatggagtgacttcttttatgtgacgcaataagttcattttcattgttgtgtttatattttgtttacattttggtctctaataatatttagtaaatttacctcgaaagaaccagagcttcgtttttatatccttagtctgttttgctagaaattacatttgacagagaccctagaactgttttgcatatatctccatgcaaaacacatgcatctaattaccataaagagctaaaccccagtgacaaaaacggtatcattgttttctctctttaattgactgaatgtttttagcatactgtttttctcttatgttcttgtcagtgaggttgattgcatttgggagtcacttactagcattttgctagtagctatcatataacttatccattaagtcggatcagttgtatcatgtccatcattgtttttttaaatttcttgtgtttaaatcagtgatccatttataattttaagacgatcgttccctcatttaaaaaagagcattatcaaccataaaagttcaaggaagaaatacccaaagcttaaaagaatcactaaattatcactgtatcataatgtggtgtgtttggcattcagatgattctgtacatttttcacagtgtgacaagtgcacatactgagaaggtgtcactgtgctttgcctggcatttagctgactgtgatgtacatgtgtgtatacccaatgcacacaccaggagtagctatgtgcatcactggataggggattggtgtcttctattttagaatgtaacttttgaatccatgttatttttaaaattagttttaaaattaatctatttaaaatttcattctaatcaaatgcagaacctatgaatcacctctgtggaatatagtctgctctagaaatgttaaatagccatggggtatttgacataatagaacagagctttgtcttcatggaatgggcattccataaacattcactagtatatcttaaatatttttattaagtatttatactttaaatattttatgaatattttactaaatatattttcttttggtgaatatttctttaaatattttatttttataaatatttatatcttattttatctcatatctaaaaatatcttaagtattttatatctataaatagtcctcaagaacacattagtagaaaatgcaaagttagtaagaccgtgtcctgttgtttatttttgcctgcaaaatactaagttactctttttcttgttcacaggctaaaaggtcagattcctgaaattaaacagactttggaaattctaaaatacatgcagaagaaaaaagtaagtgcatttttgtttgtaaatatgagcaagctaggatatgtcagcagaaactcgtcttctttgactctttggtcactgatatttgatctgtgctgtggaatccagtctgccttcttaagcacatacactaatgttatgatgtgcttctgtagcaaatgtggctttgtggccttcccccaaaagtcaagtttaattctagggcccacacttggattactttgcttatctttagtgcttgtgaaacttaaatgcaatttgaaattgttttaggtgtacaaagaaaatgtcttattctgtgctagcagcatctagggttttttctttgttgttgtctttctccctaagaataaggagttagtccaagatttatagagctggaacgaatcttagagatcatctgttacaggttctcatttcatagttgaggaaatggttatggagaggttatactcgaccattgtctatgtagttagttactggcagaactaaatttgagagtcttctaagtcttaatccagtattcattaaataaaagcaggttgtaaagattaaatctcataagcatattgtatttaaaagattgtgtgtatgcttatgattttgcttgactggtagaataactatttctagtacattttaatatgtggtgaactttgtaagacttcagcaactgattgattgggcatgaagcaccaatgaaataatagaagaatggctaattcttacaataatgccttctctgtatgtcaggcactcgggggtgtgtgtgtgtctgtgtatactcagtgcttaccactgacttcataggtgtagggactgttgtaatcctcattttacagatgaagaacctgagatatagaagttaagtgagatgccagatttgtacagctagtgagtagctgagccagagtccatacccagccacctgggtctagcattcatttcttttaccactacacttagcctgcatgatggtactgttttaaatgtcctaggttcaactgtgcaatctctcctttataaccttggtatcaaactggcctgtttatggtactgtcattttttttttttgttttgaaggagtccaccaactcaatggagaccagattcttgctggcagataacctgtattgcaaagcttcagttcctcctaccgataaagtgtgtctgtggttgggggtaagtaaatgttatagccacagctgatatatttgtaaaccagtgtgttttctgtagcaaacacactggttttgctagtatttgctagtattttagtagtattgctcgagatatgtaaagtgttcatctccttttgattgtggaagggacaaagggacagagtccaagtggttcatattagaaattgactagaatcagaagtgcgatgaagatcgcagtaaaaacatactgaagtctctcccaatcaagataaaactgatcaaacaaaccctgcttctcttccagttagtgctttatctctcttaaatataatggaggaagagcaatagaagtaaaatagaaggtactgctgaactttagataaacgcttcttcccataagagtttaataattctagaaagatccctctcaatttaaggggaaaaagagtattgcaaaaagtttgaggttagagtttattttttaaaaccatgtatttcagttttagatgatttcattgagcttatctgtgatttacctattttgctcttctcagtcctctgactatccagctacctgtctgtggatcttgttacctcaggcaagttctcatacaaagtagcaagccaagtgtacttctaccagctgtcctacggggaggatttcccctagctgctgtcctgtaggatcactctggagaggcactctagattagcccaaggaggtttgctcaaagtttgtacaacatttatatttcactctacaatctgcatttcagtatttatcttttataatttatcactaaggctttttaaaaaataactttgaagcatagcaactacacctgagtgtccaaggattcaatgattttctgtattcagtttttttgtagaaattgcatgaccttttgattcacaaattcaagtgttactttatttcaggaaagataatttctgttgtgtacttgaatgtgacttttgccccatttcttttattatcttttgggaataataaatatgcatatgttcgatctcctttatctgttttcagtacctatcatgttctctgttttcagttattcgatgtgtttcattctgtgtgatttcctctggctgcttccccatgactttgtgttttccctggtagttattctgttttgttgcttttactctgtctttcgtaactgttcttctgtttctctttctcttcattttctttgctgagctcttcttgctcttttcatgtttttcttctttcattcctcttgaatgtttaaatcctcatttcaccactcatagactggcacttcccacaatcttctccatctcagtaaatggcagaatcttttgcctggttgctcagaacaaaaatctttgagtcttctttgactcttctttattttatatctctcaaccagtccttcagcaaaccccactggttccttcttctgaatagattgagaagccaactatctctcacttccttactgctgttaccatggtccaggccacctttgtctcttgccaggactgtgggaatactgtctattagtttttagggatgccataataaaattaccacaaactgggtggctttaacaactgaaatggactgtctcatggttctggaggccagaagtccgtgatgagccccagaatcagggtcgattccttctgagagctgtgagggaaaatctgttctagcctcctctcttagctttggtgttcgcggacagtctttggcatgttgatgtgtagaagcatcactgtgatctccgccttcatcttcacatgtgtgcatgcatgtgtccaaatttctccttttgaaagaccttatctccaaataaagtcacattctgagctactgggggttagtagtccaacttattttttgttggggagacagaattcaatccataataccttacttccacgtaaggtcacattcgctagtataaggggttaaaacttaaatgtatcttttttggggacactgtttaacccataataataccctaattcactgtcttgcttctgcccttgctggaattcctaaagtctttccagcacagtggtcagattaatcctttgaaatctcaatcaggtcattccattattctgcccaaaatctttgaatggtttcttatcacattccgaggaaaagtccaagttctttgagtggctgacaagttcctatacatcctggtactctctgttacttctctctttttttttttttctgagacagagtctcactctgttgcccaggctggagtacagtgttgtgatctcagctcactgcaacctctgtctcccgggctcaagcgattcttgtgcctcagcttcctgaatagctgggatcacaggcacgtgctaccatgcccagctaaattttttggtagagacggggttttgccattttggccaggttgatctcgaactcctggcctcgggtgatctgcccaccttggcctcccaaagtgctgggattacaggtatgagccaccgtgtccagtctctctgttcttctcttacttcctcgcttggccacacttggacttcttgccagacttagagcatgctgggaatggccctgcctcagaacctttattctagctctttcttctgcttaagctgccagagtagtgcttttaaaacatgtcagatgattccgcttttctgctcaagaccccagtggtttccctgtcaccaagggtggaatacagaggtgtcctttccacaggacagccctactccctctcagcactcatttatgctcattcttttgctcactctgctgtagccatggtggccccctaactgttcctggaacctgccagtgtggccccacatttctacttctgtgttcttcacactcaatcctttgagttctcagttccgattgttagctcccccagggacctgctatgacttgtctgtcagcatttcttggtttcacttgtactgtttatcttgtattgttttccttcaaagtacttagcactccctgatatgttattgattggtgtatttaccagttccctgacacataataagtgctcagtaaaaatttttcttgggtgaatgacatttttgttagtttttcatcagagttcatacatgctaatggttcaaagagcaaatagaaagcagcaggctactgctccatccccagatgcacccacttttaatcatgtctgtacatctgtatgtacctaaatatttggaattttgttaattgtttttacaaaaatgggatatatattgtatattgttcagcacagatgtctttatttgtgagtagacacagagtttgcctccttggttttattggcttactattctgtggtagggctatgtgataatattcccaagtcaaggggtgtttggattgttttaaaatttcttgtacagtgagcggtgctgtagtaaatatttttgcacgtatagacttgtatacaaaggcatatttttgtatgctgctttgaaatggaattgttgtgtctaagagtatgcacatttaacatgttgatggatactatcaaattgctctccagaaaagactaccaattttcattttctccaaccgtatataaaaatacccttttattaacagtctcacccacatttttagatttttgctagttttataggtgaaaatagtatcatcttataggtttttgtatgacaaaatgctcatttgtatttcctcttctgtttcccttcctgattatgttgttgctccatttttctgttggattctttttctttttttttttgatagacatttaggtcttctttatatattatgtatttcggatgcacagtcttctcttaatattgcagatactttttctcatctgtcacttgtcttttgtggtagctcttagaagttttaaattttaatgtaatcgactttatcagatatttataattttatcttaacagtgtactcctttcaccaaatctgcaaacatttttttcctaatatttatatacttaaattttttagaaaacttttttgttaaggataacatggaaagataagcaactcctcaggataatgggtgagtgacttccaaaaagagggcctcccaatggccagtaaacatatgaaaagttgtcccacttcattagtaaacagggaaatgcaaattaaaagcacaatgtgatctcactgtgtacccaccggaatggtagggtgatactaagtgatggtaggacatggaatagtgagaacactgatttactgttggtgaaggtgtaaatggacacagccactggggaaactggcagtatctgttaaagcagaacatatgcattgcctatgccatagcagttccatgcctgtctctatctctttctgcctcttgctgtatataagaaatgtataaatattaactaaaagaaaggtataagaatgttcatatcaactctgtagtaaccaaaacctggaaacaacccaaatgttcatcatagtcgaatggatgagtaaatcatgatgtgttcagactgtggaatactatacagtacagaggaggaatgaactgctgctacacgccagcactgcaagggtgattttcacaaacaaggttgagtgaaagaaactgcatagcaaattaccacaaactcagaggcttaaaacaatatccattatctcctagctgtataggtcagaaatccagatgggcttggctgggtcctctgtgcagggtcccacaaagccagaattaaattgtcaacagggctgtattccttactagcatctctgggggagaattagatttcagccttattcacgttattggcaaaatccggttctctgtggttgaggtccctgtttccttgctgcctgtcgtccaggagtcagtctcagcttctagaggccacctgcaatccttggctcatggtcctttctgttttcaaagcagtgatatgactagtctttcttacactttagatctttcaaacttctcattctgctgccagccagaaaaagttctctgctcttaagggctcatataactagattaggcctacctaggcagtctgtatattaaggtcagctctgacaaatgatgtaaatatctcatcagagtcacagattccagagattagaatgagacagctgttatgggagccataattcttgcctactatagaagtcagtcacaaaagagcacatatactgtgtcattctgtttatgtaaagttgtaatacaggcaaaactatgctgtaagtcaggttaatggttacctttgcggtgggggtgctggtggtaactgaaaatgttcacaaggaagctttggggtgttggtgataacctgtccttgatctggatgctggttccatgagtgtgttaagtttgtgaaaatacatcaagctatatatttatgatatgaatacttttctatatgtatataatattaaatataaacaaaaaaatcagaaaactgcataaagcaaagtgtaagtgaacgaatctgttgtcagggttcaaccggagaaatagaaccagtaggatatagctaacctgcataaacttgtgtgcaaaggttcaggttaatatgtgtgtacctcatggtttcatactgttacctccaattcaaattcaggacaacagagttttcactttagttgttcctctggtttttttttttttttttttttttttttgagacagagtcttgttctgtcgcccgggctggagcgcagtgacgtgatcttgggtcactgcaacttccgcctcctgggttcaagtgattctcctccttcagcctcctgagtagctgggattacaggcacgtgccaccacgcccagctaatttttgtatttttagtagagacggggtttcgccatgttggctaggctggccttgaactcctgacctcaagtgatccactcatctcagcctgccaagtgctgggattacaggtgtgagccaccgcgcctggcccccctgtttcttctatatcaagaatcctggttttcagaaataccaagggtgatagaattaagctagacaacattactattcacacgcaaagcattcttagaataacaccacccaacactgttaccactgacatttttgcatatgttcttcctgtccttacacattctttataaggttgttcccacattgttggagcacagagccattatatactgtttgctctctctctttctctctctcatctttcatttatcctagttcttcgtgtaaatattgaatgcacatcatagtctttatgttgatgtccccccagtcatcatccagtcattttgattgtatgttactcattcgtctgataagtagattgccttaagatttatgggaatgatattccctgagttatctcatgttgctgacaacttgtctgtggcctttgtacttgaaattcagttttgctggatataatatcttaaactcacattttatttccttgagcatcttatacagtgccccattttcttttgttgtaaagcatcactgtcaaaaagtgtgagggcaaactgatttctttcttctatgagtgatgtgttctttttgcctggatgctcaaaggacttttgggtcagtttcccccaggtatacaaagtaccctttcatttcattttgcgtgtcatttcacccagtgtgtgtgtgtgtatgtgtgtgtgtgtgtgtgtgtgtgtgtgtagtatgtgcatgtgtcacatttcaggaacattttgttgaaatgaaggatttagaaatttttttggtcccctgctttggtttttttttctttgtggattcttgttatatttatgttcagtctttgcttatgttgaatatttttgtcctatctgaattttaatacagttttctaattatggattggattatttggtcaataagtatttatttggcatttactttgtgccaaatactttcatgttgtcttgtttaatccttacaacaatcctttgagtaattttaaaattgcatttgtgagatgaggaaagtggtttaggaaatgccagtggtaagtcaggtgatagggagagttcaaagctgtaaaaggtgtggcttcccaattccagggtacatgcatccctgaatgttggcagtaacactagatcttcagaatgacagacacattaccttgtcttaatccctaacatctgtcagaagtagtaggaagggacaggtaaaagctagctgtcttttttacctggtcaaatatagatgataataaatgtctttgaaaaattttaaattaatatcatatctcaagctcagaatttatttaaattgatacaaacaacactatttagtttcacgatggaggtagtagaaagataggattttgtatctaaacatactggtttcttatcctgattctcccatttacccactagctatgccagctaaggaaacctgagccttcatttctttaactgtgaagaagacaactttggcctcagcagggttgaggattaaatgatacaatgtatgtaaatatattctttaaccaaggggtcagcaaactttctgtaaaaggtcaaatggtaaatatttttggttttgtagatcacatggtctctgtctcaaccactcagttttgccattgtggtatgaaagcctgagtagagaatagctgggctccagtgaaacttaacttacaacaaaaggcagcaagctggatttgacctgagggctgtagtttgcccacactttactctaacctataaagctctgtgtaaatattgagtaattgtcatgactttctctcttcaggctaatgtaatgcttgaatatgatattgatgaagctcaggcattgttggaaaagaatttatcgactgccacaaagaatcttgattccctggaggaagaccttgactttcttcgagatcaatttactaccacagaagtcagtatcctttcttaaaacaaaaagcaagggaaaaaaggagaaagatttttttaaaaaaacattctttcatgggcagagggagagcattaggaaaaatagctgatgcatgctgggcttaatacctaggtgatgggttgataggtgcagcaaaccaccatggcacacgtttacctttgtaacaaacctgcacatcctgcacatgtaccctagaactaaaaaaaaattagaatacaaaaaacctcccacattctttcttacattgctttagtgggaagaatttccttattaggctaatataaaggttatagattttataagataataaataagatattcggaactagtacttaaataagtttgtagatagattagtgattttgaaatgtgatgtggaaacagcaaattcacataggtgagtaagtatttttcttccaaatattttcccaagacaactttataactggttaaatagtttaatttcacaagcatttaagggtctcctatgttcctgcaactgtgctaagacatatggggcatgaaaatcaattttagaaaagagtggcagtgcctttctctggtagaactgtacatgtaaaacagctgaatgataattcatagcaaactataagtaagttaacatatgcaacaccaaggcaatttaaactttgggaaagatagatgtaggctggacttagttcaaagaaggctttgttgagaagataaaagttaggctgcttttttaaaggcggcgtagggtttaaagatcagcagagagaagaggtgggagtggggtattctggtcaagggggaaggcaagctctttgcctttcttctctggcctgtcttttcctcctacttcctgtcacagtcactcaagacaaaatcacgggagtcacctttcacacttctctcttcctcactaccaataataaatcaatcgccagattcacatcaaatttccctcataaatctctctgcccattactgttctcgttctggggctccaaaacctgcactcagaacctttttaggttcctctcattccatctgtccttcccactatctctagtatgaatttactaggtcactcatttttattcctctggttacaatatttcaacggttccttgttacttacaagatatacatataggcactcttgtgaagtgcccccagcttgtctcacctcatgccactgacctcttcttgcctttccccagtgcattccaggttccagataaccccagtcagttattgtacacactccccaattgtgccacaccctttgcatttctacactttgttcctcctaactggaatgactttcccatatttacaggatgtgctctttttttacccttttaccctaaatatctcagtccaagcatcagagctttcctgaacattttctgatcctcagagtgtttcttgtgtgcttgcttaacacatactgcttagttttaccttgccaaaccgtgagctcttcagatgtaggagctgcactttctcttcttttccagtgtgcagcatgtggcagttgtttatggttggctgagggaaggcaggcctgttggggcctagtgcagtggtcatcatcatctgacgggtagtgtggaaacttcatccagctatgagatgacgagggcctaggacgggtggcttgtggaaaggaaaagatattaaacgtgtgagaaaaaaacaggatccagtgacttagatgggtacaggagccaaaagtgaggaaatcctctaagatgagtcctacaagcttagttaaatgccatttgttattgctagtactgcaaaaggtaggaaaggaaggtgtgcagacaagtgagggagctagggtggacagtctctgttacattgacattctactggagtctaagctccacgaggaaaagaacttcacctgtcttattcaggtcagggctttgtacagtgcctagtcaaaaatacagtagatgcttaataaacttgttaagccaaagggagggtaagagataaaattattgataattgtaataatataaatattacatggcaggatatgggttgagtgatctttcagatttcttggatgagggactgtctttaaaactatcgagagtgtctagtacatatttgttaaatatatcatagttgactagctgacagttgactaataccatagtaaacaatgggttaacaattaatttgagtccttagttttgatagagtttaattatagtattttcctaacaattgacattatagcaggatgtcttacaatactatttgttaccagtatttgtatatgtttcatttctgtgtctttgattcattgtgtgagtggagtgaatacttagtcattgcatgcattatctttagaattgcatttgcattttctttgacaattcttgcagatatggccagggtttataattgggatgtaaaaagaagaaacaaggatgactctaccaagaacaaagcataatgctggcaattaaaaatgtggtttagttttccaaacatgttatcttaaatacccctttatccttacaggttgacataactttgaatgttttaacagcaagaattttaagaaaagataaacaccattttatttatttataaaaacaaaattagtttcaaatatttttgacattgtgatttttttttccacatttctcagcaaagctaatggtattttaatcattatttttgcctgtcataagaaaactcttagctgaaatggccgaaaactgtgagacatgctatggaagctgaatgccggacgctagcacagtttactttttccctttctaatcggctgatgttactctcacttgatgtggttaaaccattttagaggtagagaagacagacagtttgaatatttgtaaacttgtttttctttggtatatttaggacttagtggtcctctgttgctattgtcttctataagtggagtttcatgacttactgcttaacgaataactaactactatgatattctggacattttaggaaatggtaatttgccttgctacacattaagagggctattaagactacattttttctaacctcagataagtgcagtgtctttgcaatgccaacataagggagatcttggccaacgtgaaataaaattactcattcaaaactctgcctaaggtgattttgtagttcttaacagttctccagagcatcttgaacaggaatattaagataaatgtgaatctgcaatggctgaaaagagttgtgagcttttttattcatgataaaaccttataggaatagtataaaaaatccctgtggaaagctactagtacattgaccagcgctgggtgatacagattctgataaaaacataaatgtattagttcatctccatgtagtaaaaagtatacttatacaatgttttgtacttgtatttcatgaaattaaaacagtgatgctaaaactatggcagagcacttttttcatgttactctttgtcttactatgtttgggctgctataacagaataccacagagtggggggcttataaacagcagaaatttatctctcccagttctggaggctgggaagtccaagatcaaggtgctggcagatttggtgtctggtaagggctgtgtcctggttcgtaaacggcaccttttcactgtgccctcatgtggcagaaggggcaaggagctcccttgggcctctttaatttggcactaatctcatcatgagggctctgcccttatgacctactcacctcccaaaagccccacctcctaataccatcaccttgggggttaagattttaacataacaattttggggtgacacaaagattcagacaataacacctttttaaagttaacatgggtcttttcacgtatttgtaaagtttacttgtacatatactagcatgttccaagaacaacttatatttctagaaacaccataaaatccctgtggaaggaatacagatctgcaaacaattgagaagttcattgaaaagataacagaatttccttgattgaatttttctttcataattttaaattctcatattttagaatttgaggtttgtaaacatcttgagatattgtatgtgctcattttccccaaactttgttatggtaagtatatattggtatgaaatgttcctgttaatgttagaacaggaatggtttgctccgaagatcttcattttgtctttgaaagtataaatatggatttttaggtaattacaaggactatgaagaaacaaaactctttcgagatatgaattacaggccaaaaattaaggtaattatttaacatatttaaaaacacccattatgggtcaggaactgtgttaggctctgttaattaaataaagatatttaaatcttacctctgccagataatttctgttagagtggtttacattttcagaataacataaccatcctgatttgacatattttgaagtttaatattagtatagcgtactaggagaggatatgggcaaaagattgactacagaacttgatgctgagaaatgtgttggaaatgcaacttaaattgaactgcttttcattataaaatggatgttcagttaagaaaatttagaaaacaggaaaaaaagatgttctatttgcagtcccccttgatatttctgtgtattctgtttctttttctgtgcataggttttttgaaaacatagctgaaatgattttgtcttaatcctactttcttcacttagcatgaaatttgtgggttgtttttaaaactttttctctattgtaagtagagaactgagcagtttatgtttacataagactttttcttatatttagggttttttctgagactagattaccagtggaattatggagtcaatgatcatagtatatcattacctggggttaactgaaagtattgtttagttagatagaacttgtttgacacagaggctgtgaggctgatgagttttcgaacaggtatgttgagaattgagtgaagcatcaacaggcaaaaacttaagaaattgtttttgttctcaccttaaaagcccagaatcataggtgtttgtttgcaggttttacaatttaaaacacacaagccaaattggtgttttcttttttccagctgttattaatgtaacatttttctaaattcgtgtttttcctgtacttcaattgtgctttccatcatcccctgctccccctacccatcctcttcaatataaagacactgacatctgtagggagaagcaccttattcaaggccatacagcggctatgtgcacagccagaatgacagccacatttccttgcttctgggaaaatttacccctctataccatgatactttgctcctttacttagtaatagctaagtttggggaaaatgttaaggtccattttttaatgagtgaacactctgcctttatatatttgctattcacagccttaaacttcagtga

SEQ ID NO: 17456 - DNA, 23096 bp, Human
  misc_feature (1)...(23096): n = A,T,C or G
taagcttgcttctttcactttactctgtggactcaccctggccccgaattctttcttgcacaagatccaagaacattctcttggggtctggattgggacccttttccggtaacaaaactaaaactaagttgttaatctaccttcagagagagagaatagcaacttcctaaccaggccagtttcagtcttcagtctgaggcagcaaaatagggtctggaggcagggaacataaggccgattcacactttagctatgacaggaaatagcctctgcgtaggccaagtaaatgactttgtaactttgcatcatccctttcatttacatagtgtgtgccccaagcggaggacattgaaactccccaaaattctggaatggggcctttgagcccctacgctcaggcccgctcccacactgtggagtgtactttcatttaccttttttttttgagatggcgtctcactgtgtcaccaaggctggaatgcagtggcatgatctcagctcactgcaacctctgccacccaggttcaagtggttctcctgcctcagcctcccaagtagctggaattacaggcacctgccactgtgaccggctaggtttttttttttgttttttttttttttttacttttagtagagacggggtttcaccatcttggttaggctggtcttgaactcctgactttgtaatccacccgcctcggcctcccaaagtgctgggattacaggtgtgagccactgcgcctggccgtactttcattttcaataaaacccttaattccttccttgatttgtttgtgtgtttcactcttgtcacccagtatggagtgcaatggcgcgatctcggctcactgcatccttcgctgggttcaagcaattctcctgcctcggcctgcctagtacctgggattacaggcacgcgacaccacgtccagctaattttttgtatttttagtagtgacggggtttcaccatgttgggcaggctggtctcgaactcctgacctcaggtgatccatccgcctcggccttccaaagtgctgggattacaggcgtgagccaccactcccggcccaaccccatgttttctcaggaactggagttccctttaggaagcaagtaacagaggtgctgggctgcccgggcctctaggtcgtcttctttcccaggctctgtgctctcaccagagtgcgcgttcgggaagcagggagaggaccaggaaagacgcctgagacggagagtgggcaccggccgggggcaggcaggtccggcccctgggggtcagagtgcagcgccggtttgaggcagttcggccacttagctgcgactcgaagtgaatgagtcacttcccctcctcgggcgagctcctggctttgccccagcaagcgggaactcccaggatcaggaaggtcccagagaaactccccaggggggaagccgaggccgtccagagagatccagggtacacacagtgacagtgccagctccacattcccgaccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtaagaagatttcctctgtagtaggggctgtttaatgtgtaacagaactggctgctggttctttacaattgcccaactgctctgcagaggcgagaagcaattgcgggctgagcctcccgggaccttcgcgggagggaggagaggaggaannnnnnnnnnnnnnnnnnnngggcagaggaaggtgggggcgggcggggcttgtctgcgggatggcccaggatgcggtcagctgagttcgccggcccagggcaggcggggcccgagcctagcggtaacccccgggcagggcggggccgctcgcagactccatatgagattcacctcgcaagtggttccctcattcgagtgctccggcgcacagacccgcgccccgccgtccgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtggaggcagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctaccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtttctttacatgggctttttgtcaaagtggaattttgttgactttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagttttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagatgggaagttctgtctttggcttggtttccttttccacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctgaccctaaaccctacttcttccctcagtcggtaggtctgcttaatggatcctgaagaaggcctgaaatcatgaccagacccctacgccccgggatcctcctgtagtgccttttgataagaagcactgccctggcttctctctcctccttccacatgtgtagggagaggtagctctgcctattcatgaagcttcatccctacactgtccttcatttggcccctggtgaaccgggggccaaggtgtgatacctcttttaaaactcattcccttcacactggtgttgtgactcatgcctgtaattccagctacttggaggctgaggtgggaggatcacgtgagcccagtaatttgaggcggcagtgagctgtgattgcaccactccactccagcctgggtaacagagtgagaccctgtttgtttcttttttttttttttttgagacagagtcttgctctttcacccaggctggagtgcagtggcatgatctcgactcactacaaccttcatctcttgggttccagcgattctcctgcctcagcctcccgagtagctgggattccaggcatgcgccaccacacccagctacttttttgcatttttagtagagatggagtttcaccatgttggccaggctggtcttgaactcctgacctcaagtgatctggcctcctcggcctcccaaagtgctgagattaggggcgtgggccactgtgcatggccccctgtttctaaaaaaatgaagaataaagtgttgaattaaaaaaaaaatcaacaacaccacaccttattccccttcttagctctccttagctggactgcagtaggctgggatttccaaagaagtgttgtgtaaatgctaagggagaatgaaagcctggtggagagatttaaggcagcaattggagggaacatttttctccacacctaacaactgtagttttccctggcattcaaaatttgctggaaatgatcactatattatggtaataataaatcccattctccaaaaagggaccttttgggttttagcttggtgacaagagactgctgagttacgaaggtgagaaccgtgtggtggaaacaactggcttgacctcaggaaagcagcttcacttcacagactcctactgatgtctttatgagccttggatcatcctgtagacccagtgcttcactctcttcctctcagcatgaatcctgcccactctgcaaggctttccagggagttgggggcctggccattacagggcatttggggatttgtttctttattaactgagttcaaaacgtgagtctcaccctccttcaaagagctctggcaaaaccctgcccttctccacacagagaagtggtcttgggggtttctgactactgagccctagtagaataacttcaggtacgccacgtttttccttcatgggactttgcagtggagacggggccgtgggctgactcaggtcagcctcagtccctctccctcctatggtggtcccctgtccccgctgctccccctggagctgataacttttacccatctttgacccaattcttcctggggagaagagcatctgagattctagaaaagtgaggcagaggccaggcgcagtggctcacacctgtaatcccagcactttgggaggccgaggctggtggatcacctggggtcagcagttcgagaacagcctgcccaacatggtgaaaccctgtctctactaaaaatacaaaaattagctgaacatggtggcgtgtgtctgtagtctcagctactcgggaggctgaggcagaagaattgcctgaacctgggaggcggaggttgcagtgagccgagatggcaccactgcactccagcctgggtgacagagcgagactgtctctattaaaaaaagggaggcagagaggtgtggtgtgttgggtcagtgagtcttgacttgctgagctgggaaattgggaataagggacaggtttttgttttgttttgttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttggggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccactttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggctcaatctcagcttgctgcaacctctgcttcccagtttcaagcaattctggtgcctcggcctcccaggtagctgggattacaggtgcaagccagcacacttggctaattttgtatttttagtagagatggggtttcaccatgttggccaggctggtctcaaactcctgacctcaagtgatccacccgcctcagtctcccaaagtgctgggattacgggcgtgagccactgtggcctgcctcagtgattattttttaattgaactaatagtattcctggtattttcagtcattgacagccaaaaatgccttgtccccagtttctggagctcccctccttcctcctcctgccatggcttgaggttgaggcctagtaggaggctggtgggggtggaggggagtggtagaaatgaaggctggagaaaacagggccggcacaccaagtgccaagcaactcagtgagggtttcctccccttccctctcttcagtaattattttaccctcccttgttttatcctcagctatctgctaatcatgttccacttgctgaaaggcagtcaggtgtagagctcaggagtacagcctcttaggaaggatgtgaccttggactttgaatggggttactgatggtacttagtttatactgagagtattaaatgaattgatatgtgctagctattaataacttcatttctaccccaagtcgaaagccttccatgagtggaactggatcttactcatctttatgttcagtacacccagcacaggatgcttggctgttgcgagatgcagccagcattttctggagccctcccacttccccttccccagtacctcaggcccctgtgtctcacccatctcattttcttcttgtctccacatgtgctggtcctaagctatttgggcaagtttatataaaggttgatactgctttctcttccctgctgataaactcctggaatcagaagccagttttcattgctttcttttttttcctttttgtcttttattgagacagggtttcgcccttttacccaggctggagtgccgaggtgtgatctcagctcactgcaacctctgcctcctgggctcaagtgatcctctcacttcagcctcctgagtagctgggactacaggcatgcaccaccacacccagctaatttttgtatttttcacagagacagggtttcactgtgttgtccaagctgatctcaaactcctgggctcaagtgatctgcccgcctcagcctcccaaattgctgggattacaggcatgagccaccgcgcccagacagttttcatttcatttcatatatttcttttacatggtagatgctcaatgaatatttgctagatgaataaagtggtagaataaagcagaataaagtcacttgaaattatgtgtagactagagaaatatttttttccaggtagtatgtctctgacttgttattttaaaatccttcaaaaaataaattggggcatctactggttcattatggtacatgttaaatttactttttaaattttactttattttttatttttagacagtcttactctgttacctaggctggagtgcagtggtgtgatcagggctcactgcagcctcaacctcctgggctcaggtgatcctcccacatcagcctcccagggaggtgggactataggtgcatgccaccatgcctggctaatttttacattttctgtagagtcagggtttcaccatgttgccctggctagtctcgaattcctgggctcaagtgatccacctgcgttggcctcctaaagtactgggattacaggagtgagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagattgtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagtcacctagccccctgtccccttatacaaagatctccctgtctctgtgtataaccctttgtacttatgttttctatatcagcctttctgaaatgttcaggtgtgagctcacctgggccccactctaggggaattgatgggaaggaacatttgacagtcatgaaaggaggaagcagtcaggtataggccatctgtgtgtttggagcctgggtgtctgctgttgatgagtgccagatagaaatagggatttgataaaatgatagataaaataggatgggaccatctcaaccttgtttttcttgtctgtggtgtgttacgtgggattcagagatatataagacgtggtcatggcctccagaaatttttgttctggaggtaaagttattacattaattatgtataccagtgttaaaatatagataaggtgtaacaagcatcgtgtggggagagaatggacaatgtctgtgaggggggtgcatcccttatttaacagttatttccaaatccgtggcagctgagaccttgcctctcttgtgtctttttcttttctcatgagttagaatgaggaggagacatgaccacggggttcagggcagaaagtcagactcagaaggaagaaaaagaagtccccaattgctctgacatcagcatcccatgtctgcctctgtttcctgtaagggagcccacccatctctaggactcagaaggcatacattgttgaaggagctacgtttgaggctggctctaagggacttcgacaggcttgagggactcatctagacctggggcatttgttttgtaaggaaggttttattggaacacagacacactcactcatttgtgtgctatctgtagttgctttcacatgtctacggtggacttgagaagtagcagaaatcatgcagcctgcaaaaccacatgtatttattatctggccttttatgaagaaaagtttgctgatgcttgctctagaccagcatgtgccacgagcacattttctagcagataaacagatgtcttatcttgtcactcctattggatatcgtgctggagaagtggtagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttcctagggaagcaaaggatagtaaataaaggtcattgtattttgtttgtaatataagatacatattgatattctgtttagttaattgcctttaatgtcttattttgcttcatgcagcttccagttaactttttctacaaagtcttaagtcccttagttctgatttatcttaacgtaggactttgaaatgtctaatgggtaaagatgaactgacatgtagaattaaaaatcaaaatataccaggacgctagaatccagtgctgctacatgggatcataattaaacaatagtgttatgtcttatcaatcatcctgttctttgatagtgttggtttcaaatggtggacaacttcccatgtgcttttaattcattaaaatttcattcatcctattaagttaatccgtagtgatttttattccaggctatggaattttcttttttatgtttagagaataattaataattcttttcttttatcttcagacttttttttttaaattttttgagctggagtctcactgcccaggctggattacagtggtgtgatctcagctcactgcaacctccctgtcctgggttcaagcgattctcttgcctcagcctcctgagtagctgggattgtaggcacctgccaccatgcccagctaatttttgtattttttagtagagatggggttttaccatgttggacaggctggtctggaacgcctgacctcaggtgatctgcctgcccactcccaaagtgctgggattacaggtgtgagccactgtgcccatccatcttcaaactctttaaaaacttactcacttaaaaaaattttttttttcaaaaccaacattttcttacatgatgttctgcaaattaaagtttttacttctctgagagagacccatccagaatagctatcacttcctgagcctcctctaggcttcggctggctcttctcaagcattggctatttggcactcaagtaaccaggcgagagagcggtcagtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacattactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcgggcggatcacaagatcgggagatcgagaccatcctggccaacatggtgaaaccccgtctctactaaaatacaaaagattagctgggcgtggtggtgcacgtctgtagtcccagctgctggtgaggctgaggcaggagaatcgcttgaacccgggaggcggaggttgcagtgagccaacatcgcgccactgcacttcagcctggcaacagagcgagactccatctcaacaacaacaacaacaaacaaacaaacaaaaacccccacaaacatggcaaagaaagaatgagatttaatgagaaagcaaaagctaacaaattgttgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagaaagttgagctttgccgctgctggccaggcctgtgtgtacttgttccaggctgtctagggcctggactatctaggatttatagcaattctagaatttaagtgtcctgaccttgaaaggggacttgctttagacccaaatattttgaatatgttatcttgtctcttttctttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccctcctcctggggcaccccgatacccatttctggtttctgtttccgctgcccccaagtcactttctgacatatgtgttgtcaccacaatgctgttcaatgtctgactgtcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaccacttgcaatgagagatgactgaaaaccaatgaagcagacagcaggggtgtttgagaaataatgcgtacctaaacaggcatatacacagtttccaaattatagtcacacacattcccaaaaccatccacaccagcttaatcacacgacagtaatcctcccacccattgtccacaatgctagtgtcttgatccaagtacctagggatgggaaacgggacacctgggctcaagacagcttgtcctattgtttctgtccatggcttgtcagccttgcattcattcctggcctcacactgacattcctagactccgtgtctcttagcttccttctcggttgcaccttatagtggaggggagaatccagggtggcccctctgtctgtctcgggtgagtctggcagcagctacttgggcaggcctaggtccccagctcaggggcagctgggtcttgggtcttcactggcttgtgggttgcccaggctcctggctgacttctcaactctccccacatcagtgtggccactttctggtatttattgtttcctgtccttgagatgggcttatttcctggtgggctctgagggacactcccatgctcaggggctctgcttagcagtttgctgtgtgacttggagtggccagggaggtgtgtggggaccttggtgtgggtgcatgtgtgtggtctgtgcactctttaatgtgccttccctgtgattctgagattcaacccaaaatgagggtcattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17457 - DNA, 41182 bp, Human
  misc_feature (1)...(41182): n = A,T,C or G
actgcaaaggtagtacagaatttccataaattccatttcagatttccctatgattaccatcttacattacattcctcacaactaattaatcaaccttgattcttattactaatgaaagtccatgctttatttagatttccttagtttttccccaagtcctttttctgtcccaggatcccatccaggataccacattacatttagttttcacgtctcctgagtttcttctaggctgcggcagtttttcagactttccttattttattttattttttgtagagacagcatctggctatgtcggccagatcaggcctcgaactcctggcctcaagcaatcctctcgcttcagcctctcaaagtgtacggattacaggcgtgagccacgtctggactgtactttccttacttttgataacctgacaactttgaggaatattggtcaggtattttgtaggatgttccactactggaatttgtttgatatttttctcattatgagactgaggttatggttttccaggagggagaccacacatgtaatatgccacattcatcacatcatattgactacatgccatcaatgagtcacgattgttgacgttggcttagaacatctggctggggtagtgtctgtcggctttctccattgtaaacctactgtttttccctttccacattgtactattttggaggaagtcactgtgcacagcctagggtacatgatctacataaattatttggaattattctgtataggagatttgtctcctctccgccttttatttatttattcaattatttatttatatcagtgtagactcatggatttttttactttggcttgtaatccaatactaccttgtttagtttacttcgttgctcaaatggttccatctttggcaactgggagctttcaggtggttcctgtgtctaaacattctgccatcaaggcaggattcgttctttagttttattttttttcttctcattcaattgagacagcgtctcattctgtcgcccaggctggagtacagtggcgcgatctcggctcactgcatccttgacctctcagcctcaagtgatcctcccaccttagcctcccgagcagctgggatcacagcgtgcgccaccacgcccagttaatttttttattttttgtagagataggctttcaccacatcgctcaggctggtctcaaactcctgggctcaagagatcctcccccttcggcctcccaaagtgttaggaatacgcgcgtgagccaccgcgcccggcccgatttttccttttttgagtatcacttccttacttttcagcctcagccttgtttttcaaggtgctttaccaccacctggcacaatccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgggcggcaaacatcccactccccgcgccggtccgcgcagcccgcgggaacgcccctgggcttgcgggaggggctggagcgcgtccccggctccgggcggtcccgagcgcatggactctgggtggggcgggaacccgcgctctgtgagccggctgccgccgcgccccagcgctgtcatcccggggcggggcctggtccccagctgtggtcgcttcctaagcggcgggggctgagccggcggcgcccagatgcggccgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggtttgtttttctcttcctgagcccccatttctcttcctgactattttccccgtgcgcggagagatcggggagggcgggtcggggcgggggcactgtctaggctcgggacccgcggctgtgccttagtgggattttggatctggcgcaggtcctcacgccgcctctgggcaccttcggaaacacagcattgggtttctcatataaagcagaatgattttttaaaattacttttaatttcagaggctgagggacttaggatttagtgcttcgtaagaattattttagggatacctgttggtaggctgcctttataaagtgtccacccaagactacttttattttaaatcgaaaggctggagtgtttttttattatcacctcttcacttcctagtagggtgactgtgtcaaaaacaccagaatgggtacttcttgacttgaacttggcggtgtcactcagtagccaggaaagacggagaaattgatagagccttcgaggagtcccttcgaagcccacgtaagactttgttttagaaacatggagagaagtagtggcaatgcctgcgagagccacgccgtcctgagagggaattctgcctttttctagactccgctgacaccagctgagatctgtattacttcctgtggttctcacgcacttgtttcagccgtttctcagcagagggaggagctgttatttacaggtatccaaaaatgagtcacagggctgctctcttaattgtgagactttgttaatgaacttttgaaaagcgaggcttgctttaaaatgagactctagatgtgaaatgcctgccctgccaacctggggcagtggtatgggaagtgacgattgagttttcagtttcctaaggcgcctgatgttacaacatgccagtaaaggtcactgggctgatctaagataaccattgaaatcatgtgctttgccacagatgcccaagagaaaattaatttcattattcaatgaccattttgctgtcattttcactgcatgggagaaaggtatcatttaatgtggtgattgtaagtaactctctaaaatcaaaatatttcagacagtttgtgtttactaaattggtgctaaaaccacatgatgatttttgaagcgggtgggtcccagcgggagcagagaaatttaaaagttgaagctgacaagtcctattgcggtgggtaacagcccttaggaagggactgcacactatctcaacacggtagagaaggggacaccatctctactggagctgagttgagctgaattcagcctcaaacaacagttaccaggtaccttctctgtgccagcctcttccctgaaccttgcttgtacaaccatgaataataggatcctgccggcaaggtactagggtaaatctatacccagagtgaagtttctgtgccaatataactcaatatgctgggtcccagtgtatttaaagagtagactcagcagattatcacccctagataattgcggtcacgattagttgatagtgtgacttttaagaaatagtgtgactaattaatagtttatttaaatatgctggaaaattcaatataatgagataggtgctagggtaaatctatacccagagaaaagtttctgtcccaatatgactgatgtttctgaagatctgggatttggaatggactgggtcatggctggaagagcaaggaaacttttgagtttagtcatttacttgtctttgtaggcagcctattcttcatttgatacatgatttaaaaatgtatgaatttgaaaggtatggtttttaaagtgcttgaatgaaccatgtttcatgttatttaataaccatgtaaaacgaaattcagctgattatcacccctggacaattgcagtcacctttagttaacagcatgacttttaggaaatggtgtgactaattaataggttgttttgttttgttttgttttttgagacagagtctcactctgttgccccaggctggagtgtggtggtgcaatcttggctcactgcaacctccacctcctgcgtttaagcaattcttgtgcttcagcgtcccaagtagctgggactacagacacccaccacaacacccggctaatttttgtatttttagtagggacaaggttcggccctgttggccaggctggtctcgaactgctgacctcaggtgatctgcttgccttggcctcccaaagtgctgggattgcagatgtgagccaccatgccctgcctaatagtttatacattggtaacactatattgaagcgagtttatgatcattgtttttgtagttcaaatcaatgttttttatcacattatagccgtgtgagccaaaatgaataaatctaccgtatcacagtttactgttgcaattgaaatctgctgagatgcttttgaactggatgcccaagtatcaaggtttccaagtttccccagtttgctaagatatccaactggtaaaggcaacaatgctaaatttcagacaactttaccttaatttccaaactttattcctcctttgagagccctaaagttactttttctatgagaaagaaagggtcgagtttgtcattcagcattgtactccctgaacttggcccaggcttgtctcatgataagtgttagaaagtgtttattgatggaataatgaaccttcacgtaggaggatgaattgtcaggcaagtggaattgtctgctgtaggtgacccagcagaaggaacagcacccatagagaagtgaaacagcactggacgttcaggaaactccagcctgtttagtgacggcacagagggaggcctacggagacaggaagggccagatcacaaaggccccatgagggtttaatagtactgaagcctttgaacaagtgaatgatattgtcaggtatgtgtttaaaaaataataacaaaacttggaattttaaaaatcttagattagatgagagtgacattgaccctaggaagacaccgtggaaactgttgtcatattgcagatgggacattgaagaaggcctgaatcgggcagtgacaatgcagatgggaaaagagggaaggggctggtagaggtttaataggtggaaccctgtcgggtgtgtgtaatgaggaggtaggagcagttgagatgactcccatgtttctaatgaatgactaggataagaatatcctactcggtggaagaataggtttgggctaaagggtggtgaggagctcacacagtacttggcacataatcagtgctcattaagatttttcaaatgaatgctagtaatagctaaaatttattgagtgcttattaagggccatgtactatcctagactcactatgtgcgttaagccttttactcgtcagtacaatcctgtgagataggtactcaaattaactgctttgactggtgaagaaagtgcagtgttagtaactgacagagccagaaatggatcccaagcacttggttccagagcttgcattctgaagcaccctgctgtgatgtgctgtcttgatgaatgaatcaatgaggttttggactttgtggtaagctcaggttgaagtcactctcctgcccctaacaattcttccttatccaagaatggccttgatgcataagatgggccttcagtgtccctactgtgctacatgacatcccaccccctaccttcactccaagaaatacctgattcatctaggaagaaacctggaataatcagacatttttatcctgggaattgaaacatcttaatggagactcacagtgtctgaaggttccaagtgcttcaatcattgtgtctacagagctgccttggttaccacccctcctaaacactgaatgctcaacttttcatatttctcagatgcactcaatgttttgttgctaagattttccatagggaagcagaaaggctagcaagggaggcattaatctacagagcagggtcaaatggtggaagaaccactaacaaatgcagacaggtacataacaactccagatattacattcctgacttgtgatctgccttttgaatcctattttgttctagttttaccctgaagcaggcgccttacctgcctctaacttccagaattttattaagtgagtctggtcctgctgtgtctcctgtcctcttgattttaacttggcaaaatgattcaagtatcttgcattcagaacttgctttccatttggggcacctgggtagattcttttgtctgaacagcagtattttgaccaacaaccctgtccacccgcccccaccgcctccaaaaaaatgatcccaactcttaactgttctcattgttgataattcaacctaccctgacttggattaatatcctgatttttgttcagcaatcagggactaagaattgatctaggaagaaactggaataatcagaccttttctcctgggaatttacattttaatggagactgtctgaagattcccagagcttcaaccattatgtccacaaagctgccttggttatcttttcctcaaagacctcgactttggaccatgtaaggtttaaaacgcccaattaatgttgtacccaaactgaatcagcaaactcacttattgaagctttaaaatgttcaaatgtccactttgggaggctgaggcaggaggattgcttgagcctgggggcagcggcaggggcgggggagaatgttcaaatgtctaaagcttgaagttttaaaatagtttctccacacatgcattgaatgttttgttcagcatttcttcagattcattgggaaatcaacatatttatagttgcccatgaaatgagagtgacatgaagcctcgcagggtaatagagcccacatgtctaccccttggcctgagcttttatgtgcctgcctataattcattcagtgctcagatcacaagaaagggaagggttttggctaatatttcatatcggtttgtcttggctgttcaattcaactgtggtttccctgagagaagagaatagctagagttgggggctctgttaagccacctctaaggctcctccccgtcctaataaccattctgtgtcttttactaataatgaaaccatctgtcagagtaagtcatttcttggccactccttctgagtttatggataccagacattatctgtgtatttcattcaacttctttgtaaggctcagtaattgggtaatttttagaatgatgtagagttgtagaattggtaattttcagttgcccttcttgagctaattaaatgtgttttaaaatttaatctttctttctttctttctttctttctttctttctttctttctttctttctttctttctttctttctttctttctctctttctctccttccttccttccttccttccttcccctcccctcccctccccactcctcaggattttcccttttattgcacaggcgggagtgcaatggtgtgatctccgctcaccacaacctccacctcccgggttcaagcaattctcctgcctcagtctcccaagcagctggaattacagggatgcaccatcacacgtggctaattttgcatttttagtagagatgggatttctccatgttggtcaggctggtctccaactccctacctcaggcgatcagcccacctcggcctccctgagtgctgggattataggcgtgagccactgcacctggcctcatttccttcttttcagtggataggacatcacaataatccagaaaatactaagtcatctagaaaagtatttcccattttgtatacttgttttacttgtttccctgttcaaagttgcaaagagatattccattactccttgcataacttattgtgtaataaggtcaatttcagcttttcagaatagtgaaatagctctgtttttatcttcctatggaaacagtaagcaagtagttctgtcttcggtttcagtttcaggattgcagcaatctcttttcacggttatatttctaattttctattatgttctttgttatgttgattagtgacccaaatctgttgatttgagataagtaggacatagtgtattagctaaattctgtaataatacaacatttcccacctcctcctcccctcttccttgactactgcatggtaaaccaacatataatgatattcagctgataatattatttagctgtttattgtttatgaagtactgtcatatatattatttctgttaattctcataacagccagaaagaatggaaaaataaggattcattgttgctgttgccattatccacattttatagataaggtgggaaacacctggagagattaagtgaccacccaagattgcccaagaagttaaatgcagaggcctgctacatgatgctgtcaggacttgactgaaaggcgcaagttcagtgtctcaggtcaagttgccaggaaacagaccctgagactctgagatttccatacaggaggtttttattgggaagtgctctgggcacaatacacagtaggagagagggaaacgggattgcacagggggagagactgaactgtggggcatgcacaacagcggcctcaacagggaggagcttggaagctgggattgttgttcagaattgttctgcctcctgaggcaagaggctcagcatttgtacctacatcaactaatcattggatgcaggcagcagctcccttcagtccagggcaatttctggaactgggagccttcagcagccaaccttcctagtacctgggggactgaggatcttggtccagaaggggatctggataccacatcatttactacatttgtagccaagagagcattctcctctgcaacagccttgtttgtgtctgatggcccagaccatcaccttgcagagtggagcccagaaagttgtcatttttttccaaggcccttaaggattttagaatagttgaccagagagcaagaagacaaagtagtcttaatcctaagaagattaggagcagaagagccagggagagtaggccgtggtgagggcagtagtggtgtttaacaaagaaggctaaactctggcacccagagtggctaaactcagccacccaaacagctgtggctatccagacccagaacaaaagcataacacacaccagtccttgctgtaatgctaggctttaacattgttaaatgttgaacaattttgtgatattagggttccccccgctctctctctcgctctctctttcaagcccttgaaagtcctcaaaccagtccagtgtgtagtctgtagattataaccttcagaattaccaaagatatttcagtacaaaaaaaaaacaggggaaaaacaaaaaaaaaagaaaagagaaataaaagtccagggccccattctagatccactggaatagaatccaggggtggaacccatgaattgacattttcaacacattttccccagaagattttgatacatgctatagtttgagaaccttcaccctaaactcttatgcctttcgtggtgaccaactctattgagattttttcagattatccagaagtcatgggaaccgtgggacagcagaggagcaccggagccttagtcccagcaggcctggtatagtgagagtcatcccttgcttttcatttaaattcttgatgtggccaacagacagcacagcccaaattcctttgctggcttctgaccaagattgcaagagggagagtggtgtccctggcttggccttatactatcttagatagcagagtgagagatgccaaattttttgaatagttgcagatgggggatgggaatcagtgaacttagaggaatcagtaaactttctaggagaataagaaggtttcaggatatcttatgccagaggaagctttgaggtgcttttttttaaactttaataattgtctaataagatcagagataacttacaggataatgttaagcattcataaatgtaggatggatttctaggagaataagaaggttttaggatatcttatgccagaggaagctttgaggtgctttcttaaaactttaataattgtctaatgagatcagagataacttacaggagaatgttaagcattcataaatgtaggatggtatattatctgattcactgacattggcaatgattttttcttcaaagggaaaagcacttttaagcctaccaatttttactcctgaaacaccaaattgctgtgtttcttacactttccaggcttcatgcctttgctgaagttgtctgtgcctgggtccctttcccttctccctaccaagctaactccttttaaaccttttaggatcagctcagacaccaccttccctgccctgtggccagactgacttctcaaagtattcccatagatccctctattatggcatttattatcattattctctctaacagcctgtaagagcaagaacagtctttttcatttttgtgtatgagagacctagcctcatcaaaaatgagtgaaaaaaataacgattctggtgagcgtatttattcaacaactatttatcgaggctttcctatatgccgggtgctctggagtaaatggtgcagacacaacaggtacagctcctgaccctatgaagcttatgggcaagcagagaagataagtaacaattgaatatgttatcaaacaactaccaataaaatatggtgagtaccagaaaaagcgaagtgaaattatagagctggaaacccagcctagtctaaggtcagaggaagtgtctcattttcctgaaatataagttatatcaaaatagaagttacggatttggctttggttacaagagactactttttaacaaaggaagatcttttggttgagctagttcaaaattgactctgtgtgtgtgtgtgtgtgtgtccgtccagtatgtggaaaaagacagtacaggaaaatgacgccttcatttaatgaggtaaaataggtaacaaggaacggagagggaagtttctgtgtgtctcattcaatgcaccattactagaagttactttgttaatattttaatatgtaatatacagtggaagaaaataaatgtaaagctctgaaaatcatgaacttacatcacagccttttaaaaattaatctcaaggatctgattactacggcctaggagggtgcttgacagatttgcttttgggtcttgttggagacagtgggtgaagtgcattgccccagaagtccatgcccactgaggtttctcatctttccaggtcacttttgatgccctgggtgaagaggccacaaccccagtgttgcaatttgcaacctccacccagcttggtggctcatgctgggtcctttttctccttttctggccagttcttgttttttaaaaaaatattatgatttttgagagactctgtcgcccaggctggaatgaaatggcacaatctctgctcacagtaacctccgcctcccgggttcaagtgattctcctgcctcagcttcctaagtagctaggactacaggtgtgcaccaccacacccagctaatttttgtatttttttagtagagacggggtttcactatatttggccaggctggtctcgaactcctgacctcaggtgaaccgcctgcctcagcctaccaaagtgctgggattacaggagtgagccactgtgcctggcctttttaaaaattatttttgtacctccttatttctccccataaattgtaagcttagggtaaggtttgagacttcctgatttttaacttttgaagctttgcagctcttctgctgcaatttatttacatttattatattcaatagataaaggaccttaagtttaatatataagttaacaggcaaatcttgggttgaaaaagtaccagattcgttctctagtaagaacctatttcttgtttaacctgacatcacaaagcaaataggccaagtgctaacatgtgcatatttaacctatgaacctctacattaagtactaagaataccaaacatttggctgattgcagggagggagggattaattcaccataaagcagcacttactagatgtaggtggagttatgtaatcctctgctgtgtcccattcaagtggataaacatatccacaccattcagcatcttgaccacaaagacaccaaaaaaactggaactataaattatagtgcaagtgaacatttaactcaggcttgaagtatgacttcaagtgaatggatgtgtgaggtcctgtgatgacgaccatttgccatgtattttcatatctttcctcaccccctttggcatattccttggtttatctcaagtataacttgattcatgttctcattttttgtcttgcttttaccataaatattatataaaaggagcatatgaatggtaaagaaataattctagacatctgttcttgcacttttcattttgtataggttgaacttggttcattgctgaagtgtaggtaatgattttagccacggtaaatccagttgaatacttaattaactgtaaatgagctccatttattatattttcatgaagaatttgaatttttaaataagaagcaatgatggcagaatggagtattttctctttttgaaagtaaactcgttagaggatgaaacgtattccttaaggaatcaaaattataatagtgtcacttcatctgaaaacattaacagttagtggaggaaaatcctgtttagtcagcatatttttggattctttaattggaaattttctttttttctcctttgagacaaagtctcactgtcgcccacgctggagtgcagtggcatgatctcagctcactgcaacccccgcctcccaggttcaagcaattctcatgcctcagcctccctagtagctaggattacaggcgcccgccaccacgtccagctaatttttgtatttttagtagagacgagctttcaccatgttgatcaggctggtctcaaactcctgacctcaggtgatccacccacctcagcctcccgaagtgctgggattataggcatgagccaccgcacccggccggaaaatttcttaagttattaactgccttttgctggaacttcaagtgctatggatagtttgtatttctgttgacatctagatacgtgcacccaccactgttaacagcagcacaaacacaatacatattttcattcgtaggatgttttctctctgaaattcctattatttggaatttgaatgtaaggggctggacctctaagctccttatctttactctgttattttttcaactcttttttctttctttctctttatagaaaaagatcttctatttttctgcctgtaagatatagctcagtgtgctggtaagtaggtgaaggaggagggtttgaaggtgcaacattccatgtaaaaatattcactgaatcctcctcttttcagttggctacctctaccgcactctagattctcttttaccctgttcagagtctaatctgtcatctgtctactcttctgccagggtggaacagaggatggagggccctcccacttctttaaaaagcttctgaccaaacccaacttgttattaccccaccatcacgccctttcccgtagatactcggccttttattatgagttctgagtctttagaaatttatttgatggtgtaacttcggttgcttcttggacttctccattgttcactgaggatttaactttcttaaatctactagaccaattatcatttatccatttgcttcataatttccaacattgtgttgctgttttcttctctcttattctttatcctagttggcttatgcctttagaaagttcctttagtggagttttggaagggagcaaaagtaatgttcaatttgctattttatccagaatgtggaaggcgtcttcaaaaatgcaaatatgctttcttgatggagcagtatattaagctattagcacttacaagcagatacattcatcagaacagttgtttactgccctaaaacatagaggatggatcataggcatgggatgttttgatggacaaatttgaatttggataggggatgggaaaggttgagggacatctctggttggagggcatctccagaagaaaggcaggataaggtggtttgccatggtggagtttgtgtaggccaagacaggctaagagcagtaagtaaaaaattactcaactatcatttataaatcttcttgttgatattcatagaaagtgtgtatgtttaccaacatgagtgacaacataagtattatctaagaaaatacctgcatttgttgggaattcattcactgtgtgtaaataccttttgaggttcattgtcttattctagtttgctcagtgctaggagtcccatacaggcttattcgattctgcatccttatttaaacactaagctattctttgtgtcgtagttgaaaccagtgattgaaattaataaattcattgtaaatacatagaaaactgaagatgaatttctcccacgatcttcatagttccgtctttaaatgtgttgtgaacctctgtcagatagtcgataatggggaagttgcgtaagtcagttttggtttcaactgtgtctacatttaaaatatctcatcagtcttaccttctgtcaaatttataacattttaatttatttttttaaaaatgctttatgggctaggcgtcatggcttatgcctgtaattccagcactttgggaggccaaggcaggaggattgcttgagcccatgagtttgagactatcttaggcagcatagcgagaccccatctctacaaaaattttaaaacttagcccatggtgagacaccatctctacaaaattttttatttttaaaattttttttttaatttttgttttttgagacagagtcttactctgtcatccaggctggagtgcagtggcgcaatctcagctcactgcaacctctgcttcctgggctcaagtgattctccctgcctctgcctcccaagtagctgagataacaggcacctgccaccacacctggctaatttttgtattttttttcttagtagagacagggtttctccatgttggccaggctggtcttgaactcctgacctcaggtgatgcaccctcctcagcctcccaaagtgctggtattacaggtgtgagccactgtgcctggccccaaaatttaaaaattagctgggtggtggcacatggcttgtagtcccagtacccaggaggctgaggtgggaggattgcttgagcccagtggatggaggctgcagaaagctatgattgtgccactgcactcaagcctgggtaacagagcaagaccttgtctctctctctctcataaaaaggtttatgttaagtttttttgttagttttgttttttgcttatctagaaaatatactttaaaaggactgggaccacctatgttttgctcaccaagctgacctcatcatatcatgcctggcacataaatactcaataaatacttgttgaataaacacatgaaagtccctgtcagagtagcctgtgcaaacatgtgtcctgaaagatgtggataagaatatcaatcacatagtctgccttgtgaatattacttaaaatctcgttaaaagccttcccaacttggtttataaaaataaaataaagctaatggatgccattatttctatgctgttgtgtatattttagctaatagaattgaggtattttaatattatgttaaaatcaaatgataaagaatactcaacataagtaaaagtgaaagttaacggtacttaaaattgtatgcatttcatgatttctgggaatgattctgcatggatactgatagtctattcacaagagaacaaattacattattctttagctacagaattttctgcagttttggacatataaaaagatatctactgattcccatgataaacattaccagtatcactgcaaacatgcagcatctcttttatccaaattagaagctcacatatgagggaaaattaaaattctgttggtattaaaagatgtttaagatttttttcaatacctgtagatgttgattctatatagctttattttattttatttttcattttttgagacagagttttgctcttattgcctaggctggagtgcagtggcacaatctcggctcactgcaacctccatctcatgggtacaagtgattctcctgcttcagcatcccaagtagctgggattacaggcacctgccactatgcctgggtaattttttttttatttttagtagagttgcggtttcaccatgttggccaggctagtctcaaactcctgacctcaggtgatccgcctgcctcggcctcccaaagtgctgggattacaggtgtgaaccaccatgcccagcctatatagcttaaaaagagcacagttgctacatggaacagtttcaattggggtaaatgtgtaagaaatttgatctacgactactttttagttggttttgttttgcagggagatattggttatttgtcttctttgacaggtgtaatgcaatatattcactttgaagaaaaattttcttggccgggcgcggtggctcacgcctgtaatcccagcactttgggaggctgaggcgggcagatcacctgaggttgggagtttgagaccaacctgaccaacatggagaaaccccgtctctactaaaaaatacaaaattagcggggcgtggtggtgcatgtctgtaatcccagctactcgggagactgaggcaggagaattgcttgaacccgggaggcggaggttgcggtgagcagagatcgcgccattgcactccagcctgggcaacaagaacgaaactctgtctcaaaaaaaaaaagaaaaacaaaaaagaaaaattttctttacaataagtgagtttgttttcttagctccttttatatagtgagtacaaagcacctaactcttgtcttcctgaagtttgagctgaatagagcattaatatgctgtaacttgagttataggagtaatataaaaactaataatagaatcattctttggttttatagaatcattttagatcgtatcatctgcacatgcttccaaaggagtggtacttatagtatcttcaataagctacctgataaattaactgattatggatggtagtagttcaaaatactaactcctaagactgtgtttgtaaaatactttaaagttaacaaagtgctctcatgtacataacttacgtaacttaacaatcaaaaagtaacctttgtgaggtaagtagagttattaccattttacagatgaggaaatgacagatgttaattgtcttgctcaacttctcgcagctagagatggaaatgggaataagccctcgcttaccaggccaagtaccctttctcctacatggcatttgcttttcaaatgatattagcagccgtaggagtatctaccctttgcttcttgtttggaaatagtacttttaaggcttctgtctgttagatgaagaacaagatcttttcactgcgtgttcttgaatctaactgaaaaacctaacacaatctaccaccactaacaatgaaaccttattaattggtggtgggggtgaggggaatacagcttacctttctgagacacttatgaagaagagatgttcaacgtatatgtaatgcattaaaattgttaatttgttcccaaaagaaaacctagccactaattttataaacattaagtcttaaagacatcagtcctcagattggcttagatgcttcaagattttcacaatctctgggacgtgtggaattggggtaaccaccttgaggttcttaaacatgaaagcacacatgaggattttcttgcattctaaaatttccttttcttttgcaagtttccctcagtcttcctttctttctgtttcttttcttttctttcctttttttttttttttttttgagaaagagtctcactctgcggcccagctggagtgcagtggtgtgatctcagcccactgcaacctctgcctcccaggttcaagcaattcttctgcctcagcctcccaagtagctgggactacaggcatgtgccaccacaccctgctaatttttgtatttttagtagacccgggatttcaccacgttggccaggctggtctcaaactcctgacctgatgtgatccgcccgccttggcctcccaaagtgctgggattacagccatgagccacagtgcctggccccaccttccccctttcccccttcccttccctcccctcccctcccctctccttcccttcccttccttttgtctacctctctctttctttctttttacctgacttcacctgcacaaaaattttgttgatggaaagtacagtgtgacttgccctgtggccctgcatctctgagggatgcccctgggaagaagaaaccccagagagctcctgtagttttccagggaaacaaactaaatttcacagtaacaggattggttcttctgaacactgtctcttaagtgttggcaaccttctggtatagaaaagaatctggaagaatatgtattatattttatcattggttattttatagaattagtatatatagttgtattagatgatggaaaattgttacttttcatgttaaacaattctgtcttatttgatttattattacaagttgagtatttcttatctgaaatgcttggtactagaagtgttttggatttcagatttttttggattttggaatatttgcatatacatcatgagatatcttggggataagacccaaatctaaacacgaaatttatgtttcatatatacctatacacatagcctgaagataattgtatacaatgtttttaataatattgtgcatgacaaagtttatgtacattgaaccatcagaaaacaaaggtgtcactatctcaggcacccacgtggacaatctgtgcttgcttggtatcaccatcattcctgactctgaatttacatgctgctgataagcaatcacttctcctttttttcatttcttttttattttctttttttgagacaagatcttgctctgttgctcaggttaaagtgcagtggcacgatcacagctcactgaagccttaacctcctgggctcaggtgatcatcccatctcagcctcccaagcagctgggaatacaggtgtacaccactgctctcggctaattattgtagtttgttgtagaggtggggtttcaccatgttatccatggctggtcttgaactccttgactcaaacagcctgcctgcctaagcctcccaaagtgctaggattacaggtgtgaaccaccatgcctcactacagtcatgttcttagacttattcacacataagtacttatggtaaaaaaaataacataccattaatacagtgaaaaaaataatgtgttcagggcaactaagcccagtagcatcaccaaatacctatacccactgttaacagcaacaacaatggcaggctttcagtctgtatgtgcaaattatgtattctgattaaaaagttactgtacactgtattttttgtaggtgagaagaaacatcagtaatagttgagggaccagaaagtgggtcctctgaggatgaggaggcattctgctggatggccttttcaaatatttcctccagagtcatctgcctcattaacaatggtgtttgtcttagaagtctctttgattttataaactgacatcatttcttattctgttatacatgcacgctgctctagtccttcaataagctcatcacacatccactatgtcatctataggcactttttctgcagtgttaatggtatcttccttgtcactattatcacaatcattttcattgacaaccatttcagctttttcatcagcagtcaatgaatgaagaactgtagcctctttgttgatgttaaaaaaaacttcattgatgtcttccagcttactgactctgaaggtatattttttgcatatgtaaggaggtcatacatcattttttctctcatctgatatacggaatccttcaaagtcaccacgttgttcatcatcatcactgaacccaccagagcttgtgccaggtatgcacaactgtatctttagtcatgtgttctaaacattggcaacagcatatatggcatccctcatgctaaactccttttgaaaatcttctacacttatgcctctcttcactgctgctagcatgctgtttaagaaagcattatttaatcctcattgatctaaggataccttgtcacatgggtgaagtagagtagtcacattttagggaaagtacgtggcataaacattatttttgatgagaatttccactggaggatgagcaggacagatgtgaaggaataacaaattcttgcaactgtcatccagtgcaacttccctgcagtgaacacaagctcctggtaccaagtgcttatgaaactaatcagaaaagacacccctggtgatctaagcctttttattagcataatggattggtaagaaattcactccttggaaacagcaaagacacaagcttttgcctgtcatagccagattacacttatgcatgcctgctgcatcagcacatccctgcacagttgttctgtccttggcatccttaattcctgtagaggctgtctcagctctagtcagtgtctttccggggcaataacaccaaaacggtgatgttttatcagcattgcaaacttgttgtggagtcaaattttcatcagcaatgaccttggcaaattcatcaattaatttctctgctgctttgtgatcagcagatgcttcatcaccacacatctttgaaaatttgatgctgtgtcttttctaaaatttccgtaaccagccttttgattatttacagtttccttcaattttcagttcactgtgatagatctagcatgtttatggccagcataccattaaatggcatgtgttcagtgtaaggctgatggatccaccctttcaatacatgatcaagatcttcatttctagctttatacagtgttttcctccctcctccccttccttttttctctccttttcttttccctccctccctcccttccttccttccttccttccttctttctttccttcctacctatgaggtcttgctctgtcacccaggctggagtgcagtggcacaatcatagctcactgcagcctcaaactcctgggctcaagtgatactctgacctcatcctcttgagtagctaggactacaggcacacaccaccacacctggcttttgtttgttttttgtagagccatagtctcactatgttgctagtattgaactcctgggctcaagtgatcctcctgccttggcctcccaacacactgagattacaggtgtgagccaccatgcatggagtgtttactattttttaacttaacttctgttcatcattttcaggatggaacttcaacaatttatctttttgtttcttcaggtcatataaggtggtcattccaacaccatatttttctgtctggtttctccaatagcttgattttctttgctacagataaacataaacgcttcccctttttcttgtcactgttactcatagaagtatctgcaggcctttttgaaattttcaaaaatgtcagagcagagtataagcaaagagtcatagtgattaatacctgaagttcttggtgctatgtggagcatggtggagaatctgctattggtgcatccagcctgctgcacacatgccattttattaccttttgtctgtgtgtgtgcgtgggaaggggaatctggacatgtgcagaaaagatgtattgcagctgaagggggatgggagggtcttttttgccttggggacactgagtaaattgtgtgttatgtacttgtgttttgactgcgacttgtcacaggaggtcaagtgtggaatagtccccttgtggccaatgctcaaaaagttttagattttggagcatttcagatttcagattttcagattaggaatgctcaatctgtattattattattatattttacaaagagcatgggttgctttcataatcagaaggagatattttacaataaaatagttggaagaaagatatttaaaacctcaagtaattgagtaatgcacaggtattagtgttcacttatgatcatagatgagacagaaaataaactgttagtagtgtaattaacaaatggcatcatttatacaaatagttactgaatctacattagttatttgagggaatttaaatcacaggaatacatgaccataggtaacatatacaaagtgctcactctctgccaggtgctagtcttaagagctttacatggcttacctcatttaatcccctctactatcctatgaggtaattatttatacatggagaagaccaggtatagagaagatggcctacaacaatacagaacatagcagaggcttgaaaagcactcttcgattaagaattgcactcatctgttcagaattgccctaactgctgagaaccctgaaaccagtgaggaaacccaggcaagacccagtagcgggagagctgagatctggatatgtctccacataattccccaggcttgaacacttagcccccctcctatacgtccctgagtagatgtggagttctaaactgattctacagctctgaaaagaagtgtcctgattgccattaacattttgaagggggtcagtaaggccataataagcttctgaaattccttagaaacctagttcacatcccactaatttttgctctttttagcatggcatcaggaaacttctctggtccagtctttgatgatgaaggaaactttgggatgtggcagtggagttgtgttttttgggaagttgcactgtgcctacatactgtttattttggtgagctgaatgatagacttgtgatacacttcaaactatccacttccatttaaaaactggctcttcaagttctcaaaacctcttatcagactgaaactcagccaaggttaaaactgccaagtatctctctactttcctgaccccactgctcaaggactcctatttagcacactgtattatcgaacagcttttgcagagtctttgtgtggaagctgtgtgtgtgtgagataatcttttttttagcatcttttttttttctcctcaccgtaagtatgaccacagtcttcaaaaaacaaacaaacaaaaaagaagcgctgtcttcagacatgttaagaaacatgtgcttttaaaaaatgtgtacgctttatattaacttttacatacaatatgagtagaatatcacaaaggtctactgaattaaaatcaagatattaatatataccttaagtcacaattattggataggtgacatacttcataaggacaactgtttggttcacgttgcttatgtttgtgttttaaaatcataacaataaacttttgttttaaatgcacgagaatttactttccagaaattataatttatccatgattcacagcagcctccatgtcttctttaaagaagaatacaccttaaggagcatggagaaacccaaggagaggtgtatcaggtagctttgtcagtataacaagccacccccaaataacaattttctatttctcatgggtgcaaggattaaatgagataatccatgtaaaccttccacaacagtctctggcagatagtaagcacctgtgattcttctacggatctcacctggactcagtcatgcagctgtagaggtgggtcagctgggggctggcctagctctccgtgcggtcttcaccctccaggaggctagtctgagctttctcacataatggtttcagtgttcccagagcagataagccccaaggtgctagtgctgttgaagcctctgcttgctccatgtttcctcccatcctcttggtcaaagcaagtctcatggccaagggtagagaaactgattcaaagggtagagagaccgacaccacttcttgatgggacgtgctgctaagaatttgttgccatttgttgtaatcaagtatagtctgtctctgacaaaaattattcacatttcttttgcaagaaaaatatgctccctcccatcccaggattccccgaagtctcatcagattatagtattagcctcgaagtctagagacttatgcctgatctgcatgagatctagatacagttcagactcctcagagatagctcttcttatgctgatcctcttgatcccaagacaatgaacaggctgtctttcccatacacatccaacatataatgatgagataggaaaaggataacaaaagtagacaccccatttaaaaaaaaaaaagagccattaacaggatacatatgacaaccactggtccatagcagttctgtccaagcacatgttaccaggtgcccctgatcctgggctaggccatgttccttgattaggacccagctctgcttttcagaagtggtttcttggtttatattcctccactgctcttggctctaccctctgaaactcttcttttcccacaacaaatggcttatttttgctcctaaatagcttcattggcctagatcctgatcataaaaagttggggacccagaggcctcttttcctttgaaaagtctttgtatttttaggccaaggttgtgtgtgtgctttttagtaaaattctcttaaaaactttgtggatttccaaatactctaattaggctccatgcccctaaaacctatgttcataattgttttcatgttagacctctgtctacttcaggctgaggatcaggttgtttgagacaacacacttagagtcttagagctcactttgtctagctgagaaggtctgcgaggcagcttattcaattttaccgaggtctaaggccatttcttacttagaattgtttcttccagttgaagagactggagagataaaaagtttttattttcctatcttgtgagttctggtttctctctattttctctaaataatgcttgcaaactagatgattcaatttttagtttgtctctatcgtgcagaacttctatgtagttatagacacactcaaaacactttcaacattgtctggagatctttgcagcgagatgcaaaattcataccaacattttcagcctttggagctgccataggcaacagtgttgccaagtgtttggctgcctatgatatgggctgccttttcccctgactgctctcgcagtttcctcaccacttccaccctcctctgacagtctgcatgccatctttccagttttacttaacagttacatcactgcttttcacctgctatctggtgccaaagccaaggtggaatgttttaggtttctgttctggcagcatgccacttctaggtaccaatttttctgtcatttagcttatgctatgtaagaagctgctacccgttttggtggtttcaaacacaacgatttattatttctcactatcctgttgattggctgagcagtcttctgttgggctctccgcggctccttcattttcagtcttttgttaggttagctggtggttgtgctcagcctcgagtactgctcagctgggcatcatcttcctgcaggctagcccaggcttcgtcatatagtggaattaagctacccaatagcaagcccttttgcacaaatgcttttcaaacctctgcttgcatcatatttgctaatgtctcaatggtcaaagcaaatctcagtctcatagccaccctcagactcaaggagttgagaaatagtctgtacctcttgatcagagaagctgcaaagaatttgtagtaagaagatttttatttttattttatttttattttgagacagggtcacgctgtcatccaggctggagtgcagtggtgtgatcttagcttactgcaacctctgcatcccaggttcaagcgatcttccagccttagcctcccgagtagctgggactgcaggtgtgcaccaccacacccggctaatttttgtgtttttgtagagctggattttgccctgttacccaggctggtcttgaactcctgggcacaagcgatccacccgccttggcctcccaagccaggattacagatatgagtccctgtgcctggccagaaaagttttttttgcaccctttcacaaagagtatgtacaaattcaaggggaaagaatggggccacctaggaggtcagatcaagaatgtgggatgagaacagatgctcaccacgtcatggaaataatctaattggttgatgtattcatggttctgatactatctggtactacaatactaacattaggccaggcacagtggcacacatctgtaattacagcactttgggaggttgaggcagaggggatcacttgtgctccagagtttgagaccagcctgggcaacaggcaaaaccccatctctacaaaagatataaaaattagcccgcagtcccagctactcgggaggctgaggcgggtggatcacttgaggccaagagttcgagaccaacctggccaatgtaatgaaaccctgtctctactaacaatgccagacattagctgagcatggtgacacatgcctgtagtttcagctactcaggaggcttaggcattgctaaacataggaggcagaggctgcagtgagccatgattgtgccactgtactccagcctgggcaacagagcgagaccctgtgtcaaacaataataataatgataatatagtaaaattagtagttatcatttgttgaagtctcaatatatgctactctcatgaaaatgctttatacatgttagaattttattgctgtaaatggaaatggcaattacataagagtttttttccactttgctaataacattgttttttcttctgcctcatcctcccgagtagctgggactacaggtatatgccaccacgcccagctgatttttgtattttcagtagagatggggtttcaccatgttgaccaggctggtcttgaactcctgaacttaggtgatccacacacttcggcctctcaaagtgctgggattacaggcatgagccaccgcgcccagccttaataacactcttttaatcattatttgtatgtgaatacaatgagcctctctttcctcatctttacagtgaaggcactgtgcaagctagtcattacaggctttttctgctctcaccttctttgattttacttaacatggtggttgggttgattaaggaaggaacacagtaagtagctgctccttacccacctgacttccacacccgtggagaaataagaaaggaaaagcagtcagaggccaaagggtctcgttagtgaccgataaagacaaggttggaagatgtggcttacatctgtgggactgtgcattctgatcttgaagccagcattagctggatttaccctccctggccacagctgatttcacccaccccacccaggggtagtgcagagacaacacaggttctctgctaaacccacttttaggaaaaagaaagaagtggctgggctactgcagacaggttcttcttttagattcactaattagataagcaactccatgcccctttgcaggaggaggtggagagggatgccagagaagggaagaaacagagcagagaatattgctccttaacaacactagcgcctcccgacctagtacctccccacactagcgcctcccaccctaactcccccaacagcttcagtgcatgattaagtggaaagggcatgaactcaggacctggacagatgtgagtttaaatcccagacttctctcttactcactgggtgaacttaacttctccgagacccagttattagtaaatcgaaaatgatgttaccctcctcccaaggttattgtgaggattgtggtggattttatatcagttctcaagcacaatgactggtttggggtgcacacagtctgtcactgagattcgtttttccttccttgctttacggagtgggcttgattctagagggctgcagacacacgcagaaagttactattatagaatgtttgcttctcgaatgtctttgcttgccacagtctctaaagggagtgagaagactgtcagtggtgagtggagataactgaggaagggtttgctattttaactcccaggaaagagaaacattttaaatcaaatcaagctgatctttgaacacatggttgaaagatgttaataatggccatttgagtcatcaataaattgtgtctaatgccctgttttttaaaaagcaaggaagtgtgtccaggcattttagaagaggatttccaacaaagataagtagatgcctttgacatttgaagggagaaacttcagttactgtaaaggttacttacatggaaaaccctcatgcattgatgatgttggataactcagatatttccgtaccttgtgtaaaagatatcagccatatataagaatattttttctgggagaatttaacaggagtaaccaggcaatgagactagaataagtggcccaaaggacactgtttacaagaaagaggaacagataaaggaatgtaaaaattcttaactggtgttacgagttggaaaagaaaaggtcattgatgattctggaaactccatggatttctccctttcaaagatacttcatggaatagttacaaaatataaaggaattacttaaaggcatatatgttttccaactggactcaaaatctattccccatcattttttaaacatagatctttgctgtattttccaggcaaagttttgcttcacattctagggccaaagggaaatcagatgtaagagttacaacaactgttttagtttgtaaatactaatagagatacaagtggaaaaatttgcacagatgacttgagccttgaggccttgacccttgagtgctcctgtctttactttctcccttagctcatctactggctgggagcggtggctcacgcctgtaatcccagcactttgggaggctgaggcaggcggatcacaaggtcaggagtttgagaccaacctggccaatatagtgaaaccccatctctactaaaaacacacaaaaaattagccgggtgtggtggtgcacacctgtaatcccagctactcaggaggctgaggcaggagaattgcttgaacccgggaggcaaaggttgcggtgagccaagattgcaccactgcactccagcctgggtgacagagggagactccgtctcaaaaaaaagaagaaagaaagctcatctactgtcctttcctgctgtggcttctatgcacctgactgtaaaatttacatctccaagtgtctgtattctgttatttcagagagttaataattttatggattttttttaaagttgtggtgacttactccctgtttttaggactgtaacaactgaagtgttgcaatgttggggaaactctgatatgaagaaatttgtgtgggaaagaaagtagtgattctaatggtgacagtatttccatgtgttaatccagttctaagaattagatgctaataattgttcctaatagaaaagctcaattagggaatacgtttcctattagactaacgattttaaaagaagccttcttgtggggagtttaggaaaaagaagctagtgtagctttgtggattacggatggattctcaagtagtcacacttttgggatttatatctcaactccataactgtatgactttaggcaaactgcttaaactcattaggcctcaaacctgtagactggggatgatgataatacctcataaggaataaatgggttaatacctgcccattgctgagtaccgcatttggcattttacaaatgcttaataaatgttcactgtagagcagaatgtatgaaacctacacaggagtagctgctttgatttcccgtgcatttctacagaaagcatctgaaagcatattgctaaaagtgaaatcccagctacccactggctgtttatcaactgtgcatatcaaactgcctttttctcttcacacactggcagaaaattctgattgaggaaactgaaaagcgaattatgtcagagggcatcaaatgagtaaagtgattgaaaagtagaggctgtctcctccagcagtggtttgaataactcctacctgctttctgctttagagcaaagagaaaacaagagacatttaaaaattatttcttctagcctcagacttttatcgttataaaccatttcaattaatactcttcagcctttcaaattttgctttgaatgagccctaagacaatattaaatgcgttcttgcccaatgcactttaagatacgatacaagcttttttttttttaaattaacttcggagcagcaagaaaattagagctattcattaggaactttttagttttaacctgtaatgttttgatgttcaaagaatagtgtttccctctgtattagtctgttttcatgctgctgataaagacatatctgagactgggcaatttacaaaagaaagaggtttaatggacttacagttccacgtggctggggagaacttacaatcatggtgaggcaatggtgaggcatggtgaatgcaaggaggggcaagtcacatcttatgtggatggtggcagacaaaaagagaatgaagaggatgcaaaagcagaaacctctaataaaaccatcagatctcatgacacttattcactaccaccagaacagcatgggggaaaccgcccccatgattcagttatctcccaccggatccctcgcacaacgtgtgggaattatgggagtaccattcaagatgagatttgggtggggacatagagccaaaccatatcaccctcttagatgtgtcattttaaaaatcaagaaacagaacactggttttactcagttgagtgaaattattgtttatgaacctgttggggaaagtccatttgttgttctttaagggctgtgttactatggggtatgctagaaaggaactgctaaattacagtgacactctacctgtggaatttctaggtgcctctggtagcggggatgtgtgggcaggagggactggatgaggtggttgagaaaggggtacacagggtgaccccatggggctgtgcaggttgtgatctcaccacagatgagagagactggcaatccaaccatgctcagctcaccaggatgcatgcccttgggcagggctttatccacccagagaaagggccctttcctagctttcacaaagatactatataagcccaacacaaaacctcattaaggcaccctatagaccaatagtggaccttctgatttgtaataatcactttaatcatatgtttacaattggtataaaattaggacataggaggtatgtcatagaatctgaaaatcagaacttgggtactgtgcgtaagtcctgtatggagtgtatatcttggggacagggtctgttttgcttctgaaatagccgaattccatttgcaaagactctctttttctttctctttctctttctgtgtgtgtgtgtatctacaagctgatctccataataagcttcacaaggtttgctgtgtgccttgagctgctctgtattgcatattcccatgtctgaaaatttctcactacttgtaaaaatactttaacatcttgctgtgaaacaggaaaaggttttgtttcctggttttggcaaaatttgcttaatgcatatattagtcttttggggctgcctaataaagcttctcctttattatcagagagatactatgtatgtcactttaaataattcccttagaggcatgttgggaacaatgactttcacaattgttctttgtagcatccagtgtcttggttatttatgtgtgatatggtttggctgtgtccccaccaaatctcaacttgaattgtatctcccagaattcccatgtgttgtgggagggacccaggggaaggtaattgaatcctggggattggtcttccctgtgctattctcgtgatagtgaataagtctcatgagatctgatgggtttatcaggggtttctgcttttgctccttcctcattttctcttgccaccacaatgtaagaagtgcctttcacctcccactatgactctggggcctccccagccatgtggtactataagtccaattaaacctcttttcttcccagtcttgggtatgtctttatcagcagtgtgaaaatggactaatacaatgtgattgtcacctccactctttggtctgctgaggtaggtggaaacctgctttctgaattgttccttcctgatatgacagaaaattttaagattctatgtgccaaatatagtaggctattcaaagcaggatctaggtctcaatggctagaatatttaactaatagaatatcaccatccttccttgttccctgtgaatgctatcagagtatttattcatgtacctgagggtgcctcatcatagtaagctcagtcttcaattttattcatactcccatgcctgcaacaattataattttccatcataaaatgaagggatcagaataaactatttcaaacattcttgattccttttccttttgagcttcagagattgtttttatgaaagtgagttttcagctgactttcttatttagcctccataccagggagccagaaggcagtgcttatgaaagccaccatctttccagtgggggagagaggccagtagctaccccttttccttctctatcaggtttttgctcatcgagattgcccccaagctaggaattattataagttctccagaattgcatgataattatgaataaaaagctgacatgggccaggtgcagtggctcatgcctgtaatcccagaactttgggaggctgaggcaggtggatcacctgagatcaagagtttgagaccagcttggccaacatggtgaaaccccatctctactaaaaatacaaaacttagctgggcgtggtggtgcatgcctgtaattcaagctacatgggaggctgaggcaggagaatcacttgaacccgggaggcagaggttacagtgagccgagatagtaccactgcactccagcctgggcaacagagcaagaccacctcaaaaaaaaaaaaaaaaaaaaaaaaagctgacatggtaggtatctatggaatgggtcacaaatttgagtatgcattataatcacctggagatcatcctaggcctaccgaatcagaaactctaggtgcccaggcatctgtaatctttgaagctctccagaagattctgtcacctcttgcagaccgaggaccactgagctaccatcatctctttgttcctttgttttctcttacacaaaactttattgctcaatgaaaaaaggcttaagcaatacccccttccttccttattggatctggttttcagtacagattatatgcatgcctgaaaagaaaattagaaagcagaagcagatttttggtagttggttgtcaattttcttttgaattcttcacctccatgcaaattgaagcaggacttatttttagcaacttgatgaatgcaatttaccaaagtttattacattatcttttattacaataagacaggaaggtcagtggaattgtctgatttttctttctcatttaccatagttctctttctaggaactcatagtacagaatcaagctatgggatatataggttattttgattctctatttgtgcccacttctatatttttgtataacttcagtagtgtatacacttttaacctttttggagacattcttaggaatagcagtctcttcgttgactttctgttgtagttttcctaatgtttgctccctggtgaccaggagaccttctatgtcagtggagacaactcatccaaggctggctgagccaagagaggtgggcaggaaggccaggtgaaggcccccttccctcctttaccacacctcaatagagaatctttatgtctcctgtaccctttctttttctcttattagcacattatggacttgcgccttcacatgagcttgggcccttacctgatttataatttgctatctatgactttatggttgttcaatcttgagaaggaatgactgtccctggacatcttccaaaaccattttctatatgattgaattgtacttgactcttcttattgtgatgagatgatttcccccaatagctttttaatggctgtaggagagcaatacagagcacaggacctgtctaggataagcaggatacatacaaatgatccctagtgtcccagggcgtggtacagtcccttatctacccatttccttccattgaagtgccttgtaaggcttggccaacatgtaaggaaggaaggcatctctcacctattcttgccttgttcatcaaaatgcatccattccatctcatccacttgttgcatggtagactatattgggtactaacttaagcagatgggtacagctcaactctacgcaaactagctaatgtgctttccccaggtagcataaaatgttaacttgattgccatgcatagacttttaaaagttgctaaggagttagtcctttaaacgaatagtatttattgttttatgggggtttttaaattatgaaatgtgtgtggacattataaaaattttggaaaatacagaaaagcaaaaggaagcaatttaaaccatgtataattccacaactcaaagaaaactataattaacactttgatgtgtattactcaagtttctgtttcagaatgctgcacattctctttctccataactactttttatgcctaacagagtatatatgcttttcatgccattagatagccttctaaactctgtgacttatgtagaagccaggacctcattattgtgcatttaacttatttctgaatttctgcaaaaacaaggtggtgatgaaaatattttgagcaatgagtttcatacacttttgcattatatctttagaataaatgcacatatgtcaaaacaaatgcacacttgaaaagcttttgatacatattactaaactgacttccagaaagattctatcaattaccaattttttaaaataatgaatagactttgtttgcaaaatcattaagttgcaaaaacaaagacaccacaggagttttaaattagacttttttttaatctagaaaaaaaatttaatgtacttgcttagttcagcagaagctgagagaggtctcaagaccctgaacaataatactgattttattattttatcttattttatgtttttaagttccggggtacacgtgcaagatgcgcaggtttgttacagaggtaaacatgtgccatggtggtttgctgcacagatcatcccatcacctaggttttaagctcagcatgcatcagctcttttccctaatgctctcccctcccccgcacttccccgacaggccccactgtgcattattcccctccctgtgtccaggtgttctcattgttcacctcccacttataagtgagaacatgcagtgtttggttttctgttcctgcattagtttgctgaggataatggcttccagcttcatccatgtccctgcaaagaacatgatctcattcctctttatggctgtatagtacagtctaacattgatgggcatttgggttggttccgtgtctttgctattgtgaatagggctgcagtgaacattgacatgcatgtgtctttataatagaatgatttatattcctttgggtatatacccagtaatgggatcgctggctcaaatggtgtttccagttctaaatctttgaggaattgccacactgtcttccacaatggttgaactaattcacattcccaccaacagtgtaaaagcattcctatttcttcacaaccaccatcagcatctgttgtttcttgacattttaatagtcaccattctgactggcatgagatggaattaccagtatgttttgagagttcccagaatccttacccatttgaaaaagtattgtttttaaaaaattcctgctaactttatgggcaagaaaattctcagcagtttaatttgcatttccttgtttaatacagaagtcttttgtgactatatttttatacttttgctaaagattatttagtgcattggttaagtggtgctattctaacgcctgagtgttcacttactgatgaccttgagtaaattccttgatctccctatgctcacaccaactctgataatggcagtacctactcatagaatctgtatgaagactaaagagggtatcacatgaaagatgcctagaaaatatcaggcatatataacatacgtttatgttctctgtcatttacatcttctctgaattgcttcactgtctttgggtaagtagattttttggtagcttagaaatatatatattaagtatcttaacctcttgtctgtcatatattataatttctccccagttggtggtttgtctttcaattttgttcaaagtgaggaaacagttgaatatcaagaaattcagaccaggtgaaggcatagttttggtccagggtggatcttttttctgcctgtcaaccatactgctaggagaatcaccttccccatccgtgagaaggtctggtattgattatagccaccagatatcagaaatggcactttaagcagcttacattgttacattaaaaatcaccatcatagaataaaacttctgcttaatttatgtaaataatgatcatggtagatgaaaggccgtggttaatatttcaccattttccatttaccaccaaatccaacttgtcagcattccattagtggtgatataaaattaattacttcaacttgaaagaagcttttaatttgagaccaagaaccctgatagattgcgtaaccattaagtgttactacttttcccctctttgctgcaaattgtgtagtagaaaaagaatctttctcatcatgaagtcttgtgtataaacacaagatattccctatattagcatatatacatgctactaaaaatgaaagtttttcacttcactgaaaagcaatatgaacatagagactattactttgccttactaagcagaggaattaccagaaccatccttgtaaaaacatgaacattctgcttgagctgccaacttgtttcaaaaagctattaaaagtgggcaaacattgctgctacatgatgaatgaatgggagtgtgttgtagtattgctactaggccacgtatgattggaattttccacataaaagcattttaaaaagcagtgttatttacgatgcttatcattagggaatgatattgagaagaggagtaaggaaacctcaacttctaaattttacacttagatttctgtattttgttgtcattttacttcaagcatgttttacttttacaacatcttcaagagaaaaaaatttaaatcatgatttgcatggtaactgttttaagagttgttagtgtgtacaggaggggatgcttcccagtgccgaaatagacacaaaataggcaacatttagatgttggccccaaagccttgtagattatcctcaattaaaaatacttaagtttgcaagtctttcttcttcttttttctttttttttttttctgtgtctgttttaatttgcaatgattggaaaacataaagcaatgaaaagagatggtttcccaatgcaatctaaaattttcacacaccagggcctgttgtggggtggggggaggggggagggatagcattaggagatatacctaatgtaaatgatgagttaatgggtgcagcacaccaacatggcacaggtatacatatgtaacaaacctgcacgttgtgcacatgtaccctagaacttaaagtataataaaatatatataaataaataaataaataaataaaattttaaattgctcattgagttctgcgcggctatgatattgaactgcaggtgcctataggccttaaaacacaactgtttcatgttgttcagtcatcttatttctttccttgtaagcaaaatgtcagaacatttagctcctttagtgcacttattgcccacaccgaggaatacaaaattgggactgctgagtaaaatgtttaagtttcaatcccttgaaggcaaatatttgactctcaatagagaaatttaacttcattatctctacttgcaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaacacttttctggctcttggtattggtttgcttgttttgagtttgtttcactccagtttgccccttcctagtccagtttgggtcaaacttcatgttaaacaactctgcattggttatggcggtagacatatggcggtagaaaatgtatacggagctagagacaactaacattcttggaaatactgcttttgttttactgtggaccattccttccatgcattgaaatggagaaattcaaagtaaaagaattctgtttttcaagcaagcttaataaacattacattatacacatatttttatacatttctggcttgaccatttagtttactttctcaattattgttaaaatttttctttttcctttttttttttttttttttgagatggagtctcactgtgttgcccaggctggagtgcagtggcaggatcttggctcattgcaacctctgtctcccaggttcgagcgattctcctgactcagcctcctgagaagttgggactctgggcgcgtgccacaatgtctggctaattttttatgtttttagtaaagacggtgtttcaccgtgttagccaggatggtcttgatctcctgacctcgtgatccgcccgcctcagcctcccatagtgctgggattacaggtgtgagccaccatgcctggccttttttccccccttttgagacagggtctccctttgtcacccaggctgaagtgcagtggcataatcatggcttactgcagccttaaactcccaggctcaagtgatcctcccacctcagcctacaaatagctgagactacagatatgtgccaccatgcccggctaatttttgtattttctgtagagacagggtttgccatgtggcccaggctggtctcaaacttgtgagcttgagcaatccgcccaccttggcctcccaaagtgctgagattacaggcctgagccactgaccctggccaaattttttttctactagctactgaggctgccacatctggatggaactgagtggagggggaaaagaatgaaaaactcaaaagaattcccatgagggtgtcttgctttctctcctgagttacaatactttagcaaaatcatgaggctttagagatatggtgtagtctgcaaacttcttaatgcccttacccacatttaccatgtttcctggccttcctctgtgtcaactcttagctcttcctaatcattatttaatacatgagtgagtttagtagtgatcatatttctcaggtcctttagaagctggaattttaaaagaattagaaggaggagtatgtgaattctttggagctcactgcctgacttgcttatgaccaggaaaatctatcccctgtatc

SEQ ID NO: 17458 - DNA, 57178 bp, Human; identical to SEQ ID NO: 12838

SEQ ID NO: 17459 - DNA, 22372 bp, Human
ggtttgtgcccaggcgaggcagtggggctgtggtgtgggactctgatgccagcctgggatccagagagcattggtggggcccagggggatggacacagatggagcacccacacgcctgagcctccttgcccctgtgggaagagacagccctgcctaaggggttctaagagatttgagccgaccacgtggggtggggctggggctggggctaggaggctgcctggagcctggcgtggtctgctccttacctctctgttttgctcatatccaccgtaacataacacttacccagagtgaccctgaagagctgagtttgggagggcaaagcttttaaagccattaaaacagaccatgtcaccaactaatggccttgaaattaagaaagggagggctctacccaaccctgcccaagtgacagcatgaactactgatctgcttgtcctcaggttaccaggagtggaacagaatcctggcttaattgctaggagaaagccctgtgttgcatggcctgtcagcaacctcaggctccagaatattctggaattgccccagcccagcctcttccccaactcctttctgtttggttggggcttagttgggatcctctttccttctgtttgtccttcctcagcatctgtcccttgggtctgccagctgtgcctgccgatgtctcctttgggtgaaacttcctgcccctgcccctgttgtgcccctgatagactctgtgttactgtaaagaatcacccaggctgggcgcagtggctcacgcctgtaatctcagcactttgggaggccgaagcaggtggatcatttgaagtcaggagttcgagaacagcctggccaacatgatgaaaccctgtctctactaaaaatacaaaaattaaggttgggcactgtagctcatgcctataatcccagcactttgggaggctgaggcaggtggatcacctgaggtcaggagctcaagaccagcctggccaacatggcgaaacgctttctctactaaaaatacaaaaattagctgggtgtggtggcagctgcctataatcagagctacttgagaagctgaggcaggagaatttcttgaacccaggaggcagaagttgcagtgagccaagatcatgccactgcactctagcctggacgacagagtgagactccgtctgaaaaaaaaaaaaaattaaccgggcgtggtgacagacgcctgtaatcccagctacttgagaggctgaggcaggagaatcacttgaacctgggagatagaggttgcagtgagccaaaacggtgccactgcactccagcctgggcaacagcgcgagactccatctcaataacaacaacaacaaaaattactcatagaacattttccaggtcaggaaagatgagaagagctggatagacctttccagatgtaagacccccaaagctaaatatgccgggtacgtttaaggcccctttaaggtggataactccccctctgccctcagcccagaaaagcttgtttccaataggccgtggctggagggtggggaaatgtcccatccttcgcggaatgtgtgggattgtgggtcagttccatggggtacctgcttgccccagccaccagtgagtacccactggagagaaggaaaaaaaaagccaaaagcactcaagcatgatatcaacagatgagcttcagtcaaatcaatgactgcctcccactgttacagaaactgccttggtcacaagggactctgggcttctggcttgggcccctgtcaacaaagaagggattcttgttgaagaatcgtggaaggaggaggaggaggctgggcatcatctctcagcctggaggaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaaggtaatagtggctgccggcatcccgggctgcactgtgggcacagctgtggggtgttggggttggcagagagcctgggtccctggaacacgatctggccacctgtggactagagcagaggatgaggtcatcaagctgcaaatagatccgatttcccttaatcctcgaatgcctgaaaagttgtgtggagatgacatgctccccacaaattcaattccttcagaaacctgtccgggcgttgcggctcacacctgtaatcccagcacttcgggaggccgaggtgggcggatcacttgagctcaggagttcaagaccagtctgggcaacatggtgaaaatccatctctacaaaaaaccagccaggcatggtagcgcccacctgtggtcccagctattcgggaggctgaggtgggagaatcgcttaagcccaggaggcagaggttgcagtgagacatctcaccactgtattccagcctgggtgacagagtgagagcttgtattaaaaaaaaaaaaaaaaaatatgtggcagggagggcagggagggcagggcctggcctggggcaggagaggtgatgctattgtcattgacagtaactaacatggtctgtaagagagacgaaaattcatgtcgcaggtggagggacagccgtgtgatatggtggtagttgtagtcatcgatatttaattttgtcattaaaaataaaaagtaaaccaggcacagtgtctcatgagtatagtcccaggtgagtggatcacctgaagtcaggagttcaagaccagcctggccaacatggagaaaccccatgtatctactaaaaatacaaaaattagctgggcgtggtggcgagtgcctgtgatcccagctacttgggaggctgaggcaggagaacacttaaacctgggaggcagaggttgccgtgagctgagattgcaccactgcattccagcctgtgcgacaagagcgaaactccatctcaaaaaaagaaaaaaaaaaaagtagctgaaaatcaatgttatcagaaggtcagtggaatgcttcatcatcacatgtatgtcagtttaaggggatgacctagtctctcagtgcctgagtctctttctttacgaagcaggaaagaggatctgctcttacgacctcataaaggggtcgtgaaaaggccagtgccagtgcccaggaaatgcttttagccttttggcaaatgatgtcatttagtacagcatcaacataacctttcctggtacaagctggagtgtcactctcaagccatttgtcatgacatcaggcatgcttccattccatttgggtttgcttattgaaactcttcggggggaaaaaaacagcctccctgagtgctgagaaaatgccattcttcacctgggcagcaggtgcgttcctgaaaggctgtgagtaaatcacatgttgagaaagcaaactcttctggcccatggagttatgtcctaattcctgaggtgcctctctgctctcattgccatcaagtagacaatatttgaccaaaattcctggaaatataggttgggtggagtgacttatgcctgtaatcccagaactttgggaggccgaggcaggaggattgcttgagctcaggagtttgagaccagcctgggtaatagagcgagacctcgtctctgctaattaaaaaaaaaaaaaagccaagcatggtggcatgcgcctatagtcccagctactcgggaggctgaggtgggaggatcacttgagcctgggaagttgaggttgcagccccagcctgagcaacagagtgagaccctatctcaaaaaaataaaaaattcctggaaatatgcaaaagtcatggtccttcatggtggtccagagtcacgtggaggtacaaaagcccctccccatagattcagaaatgacctctttggggtggggggtgagggaacagaggtgttgtctgaggatgtcatgctccagatgacagtctttttttttttttttgagatggagtcttgctgtctcccaggctggagcgcagtggcacgatcatggctcactgcaagctccgcctcctgggttcacgccattctcctgcctcagcctcccgagtagctgggactacaggcgcccgccaccacgcccagctaaatttctgtatttttagtagagacagggtttcaccatgttagccaggatggtgtcgatcttctgacctcgtgatctgcctgcctcggcctcccaaagtgctgggattactggtgtgagccacttcgcccggcacagatgagtcttgtgctcacctgctgtgatctgccacactaaaagttgagtgactccaaagaatcactttgctataagaagtctttttcttttctttttttttttttttttttttgacggagtcttactctgtcatacaggtaggagtacagtggcgccatctcagctcactgcaacctccacctcgcaggttcaagcgattctcctgcctcagcctcccacatagctgggattacaggcgcttgccaccatgctcagctaatttttgtatttttagtagaaacagggttttgctacgttggccaggctggtctcaaactcctgacctcaagcgacctgcccacctcagcctcccaaagtgctgggactacagccatgagccctgagcccagctggaacggtcttttcctaacccatgtatttgcacttcctggtcctcttgggtgctggctgtaccccagctacaggttgtgccgcccagggtgttctggatgggaacggaattcaccaactgtgtggcctccctctgcttacatgtcctcctccttgtctttccagatgttcaaagggcctgagaaggatatagagtttatctacacggccccctcctcggcagtgtgtggggtctcgctggacgttggaggaaagaaggaatatctcattgcaggtgtgtatgagtggggccatcagccggaggctggcacagaagtggggctgttcctagacgcggtccagggctcgtttcccaggctcggggggtggggaggcggagtagctgaggaacagtgaggcagggtacggagccctctcggccacttcccgtcagagaatgctagtgaatgttcactacctgccaatttcctgggaaatttgagattggtggacaaaaaaaagggagcatttttgccttttgttcctaaaagggaggcgagtgcgggatgctggagacatgcagggcagagaaaccctttctgccgtcgggagggccaaaagctcgcgtaacatctgtggatactatgcacgagacctgcttgacttattcattcatctgtctcctttttttattgtggtaaaataatacgtaacaaaatgtagccatgttaattaaccattttctttctttctttctttctttctttctttttttttgagacagagtgtcgctctgtcgcccaggctggagtgcagtggtgcgatcttggcttactgcaacctccacctcctgggttcaagcgattctcctgcctcagcctcccgagtagttgggattacaggcacacgccaccacgcccagctaatttttgtatttttagtagagatggggttctaccgtgttggtcaggctggtctcgaactcctgacctcaggtgatccacccacctcggcctcccaaagtggcaggattacaggcgcgagccaccgcgcccggccaaccattttcaagtgtacacttcagtggcattagatacattcgctattgtgcaaccatcaccaccatctgtctccacatcttcccaaaccaaaactccgtccccgttaaacactaactcccccttctctcttccctcagcccttggccacctccattttactttctgtctctgtggatttgactactccaggggcctcacatgggtggaaccctgcagtgtttgtcctctctgtctggcttatttcagtagcatcatgttttcaaggttcgttcacgttacagcatacatcagaatttccttactcttttttttgtttttgagacagagtctcgctctatttcccaggctggggtgcaatggcactatctcggctcactgcaacctccgcttcccaggttcaagcgattctcctgcctcagcctctcaagtagctgggattataggcacacgccaccacacctggctaatttttttttgtatttttagtacagacagggtttcaccacgttgaccaggctggtctccaacttctgacctcaggtgatccgcccacctcagcctcccaaagtgttgggattacaggcgtgagccaccacacccggcccaaaatgtccttactttttaaggatgaataatatttcattgtatgaatgtagcacattttgtttattgttgcatctctttgtttatagttttttggtttgttttttttttttttgagacaaagtcttgctctgtttcccaggctggagtgcgatcatgactcactgcaacctcgatctcctggggtcaagtgatcctctcgcctcagcctcccaaagtgctgagatcaactacaggtgtgtgccaccacacccagctaatttttttattttttggtaaagaagtctcaccatgttgcccaggctggtcttgaactccgaggctcaagcaatcctcctgcctcagcctcccaaagtactgggattataggcgtgagccactgtgcccagcctatatttttattcctaagtaaaattattttcccttacttccttctacggcctcctctgcttgcccagctaggctgaaccacaggaggccaggacaggattctcaatctcagcactattaacatttggggatggaccattctttgttgtgggggcctaccttatgcattataggatattcagctgcatccctggcccccaccctctacatgccacagcacccgctccagtcgcggggtctctggacattgccacatgtgcccaggggaggtggggtagattgcccctgcttgagaaccactgggctcaaagagctttctgcagtgatggaagcggtctctgcaccatccagtccagcagcccccagccttgtggctcatgagcacccgagatatggctagtgcagccgaggagctgcattttaaattttatttcatttcaagtaattttagtataaatgtaaacagccacatgtggccggcagccgcagtctagcatggcactgactcagccagttaaggaacattattcccctcctccctggggaagtaggaatctgatcacaaacttaagaaaaaaagaatagacaaggcctggtgcagtggctcatgcctgtaatcccagcaatgtaggaggctgaggcgggcggattgcttgaggtcaggagttcaagaccagccttgccaacatggtaaaaccctgtctgtactaaaaatacaaaaattagctgggcgtggtggcaagtgcctgtagtcccagctactcaggaggctgaggcatgagaatcatttgaacccaggaggcagagattgcagcaagctgagatcacgccactgtactccagcctgggtgactgagcaagaccccatctcacaaaaaaaaaagagaaaagaaagaagagacaagacaattcccctagcctggtactatagtttgttccaaaaggcaactgtaatcataaacatatactccaaatccaaatatccatgattgggggattttcttctggtttaggtgacatgtacttttttcccttctaaaaatcaatgtgtgcttagtgagcacctgttaggtgcccagccccgtgttagagacaatgggagattcccacggtgagatccttggctctggtcatcatggagcacacagatgttccgaatggggagactggaaaagaaagaaaatagattttgcttgtggagaattgtgaatagtaagtgaatgcttagaaggtgcaaaaggggccgggcgaggtggctcacgcctgtaatcctagcactttgggaggccgagacgggcagatcatgaggtcaggagattgagaccatcctggctaacacagtgaaaccccgtttccactgaaaatacaaaaaaaaaattagccgggcgtggtggcgggcgcctgtagtcccagctactcaagaggctgaggcaggagaatggcgtgaacccgggaggcggaacttgtagtgagccgagatcgtgccactgcactccagtctgggcgacagagtgagactccatctcaaaaaaaaaaaaaaaaaaagaaggtacaaaaggaagagagactctcacaggtccaagggtctagacagacttgctgctggaagaaggtggtgtccttgcctatggatggggaggaggtcattgcagggaggaagatgcagggctgtgagttgggcagggaagactcctgttatctccccttgggtaagatcttccctcccttccttaacatgctcacagctcctgctttgctgggtatctcggtcatcaagacttctatccctctccttggggataataggagacttcccccccttttaagatgcatttctggacttcctaaaatgttttattatgagcacttttcttattctcattccaagacagagtctccctctgttgcccaggctggaatgcagtggtgtgatcttggctcacagcaacctctgcctcctgggcaattctcgtgcctcagccacccaagtagctgggattacagatgtgtgcccccatacctggctaatttttgtatttttagtagatacggggtttcaccatgttggccaggctggtcttgaactcctgacttcaggtgatctgcccgcctaggccttccaaagtgctgggattacaggcgtgagccaccgcgcccggcctacaattcagtggttttagtatgtcacagagttgtgcaaccatcactacagtcaaaaagaaatcctgtattcttgagctattaccctcctgactcccctccccctcccccagccctaagcagccactggtatacttcccgtctctatagatttctctatgctgggctttcctgggaacggaatcatacgtgtgaccctgtgtaaccggcttctttcgtgtttccaagggtcatccatgttacagtgtgtatcagaatttcattcctttctatgactgagtattccactgtatggatagaccacgttttgtttatccggtcatcatttgatgtgcatttgggttgttgccaccgtttggccattgtgacaaatactgcaatgaacattggtgtgtgagattttgcagggacctgttctcatttttcctgggtgtatccctggcagtggaattggtggggtcgggggtggggaggggttgggtgactttaggtttaaccatttgaggagctggcagaccgttttccaaagcagctgcaccattttacacgcccagtattatctatgatttttacaataagaaaaaaaaaatcaaatggagaagggtagagggacaaaaaccacctgtggtgcaaagatcttaccagctaactaatgccctcaaaaaaaacacagaggaggcaggagagctggggtggccgcacagcacgcacggtggcgcgtggcagaggcatggtctgcagtgtggcattcgggggctgctgcagctgtgcacagaacagagcacgggaggaaatttcccagcgtgtcagcatctgctgtgtctccttttcagttctttcctgtattaaacctttaaaattatggcatttattacgtttgtcatcagaaaaataaaatctggagagacaagaaaggagacagaatcccccgtggtgcagggaacttacttccagttttctgcatcctgtttgttcctatccacagggaacagcctttaaagtaagtcccagccgtcccagctcagtttcgtcacactgccctctaggggctttctggccaaactgcagcgctgcggaaggactcttgggtgcaaaagtgaccttggtctgagccagcaccggtgtccaaacatacccagctgaatcctcgcccatgctgaagctctctgtttgtttttgtttttgttcgagatggagtctctctctgttgcccaggctggagtgcagtggcacaatctcgggtcactgcaatctctgcctcccgggttcaagcagttctcctgcctcagcctcccaagtagctgggattacaggtgcccaacaccacgcccagctaattttttttttttttttttgagacagagtttctgtcttgttgcccaggctggagtgcaatggcgtggtctcaactcaccacaacctctgcctcccgggttcaagtgattctcctgcctcagccttccgagtagcagggattacaggcatgtgccaccacgcctggctaattttgtatttttagtagagacgggatttctctgtgttggccaggctggtctcgaactcctgacctcaggtgatccgcccacctcggcctcccaaagtgctgggattacaggtgtgagccaccgcacctgggcggcattaagtacattcacagtgttgtgtaactatcactatctatttctagaagtttttcatcatcccaaactgaaactctctccccattaaccaataattccctgttcctctgtttgcccagcccctgacaaccacctttctacttcgtctccatgaatttgcccattctagacacctcgtacaggtagagtcatacctccttccatagctgaagcattgcacttagcataatgtcctcaagttcatccatgttgtagcatgggtcagattttattttattttatttatttatgagacggaggcaacaaagcccaggctggagtgcagtggcgcgatcttggctcactgcaacttccgccccccaggttcaagcgattttcctgcctcagcctcctgagtagctgaggttacaggcatgcaccaccacgcccagctaatttttgtatttttttagtagagacggggtttcatcatgttggtcaggctggtcttgaactcctgacctcaggtgatccgcctgccttggcttcccaaagtgctgagattacaggcttgaaccactgcacccggctggtagattttatttctttttatgtgcatacattttaaagtttccaaaatatgtaatactcttctaagttgaattctatatatgttttcaaattgttaacatttccattaactttttaactcagatactacttagtatctcaaggaggaggcacgaggttttgatgaggacacagaactaaaggtgccaagtgcaaacagtttattgcataaagaaaataaggaaatgggctgaccatagtggctcacacctgtaatcctagcattttgggaggctgaggcaggaggatggcttcaggttaggagttcaagatcagcctggacgatatagcaagaccctatctctacaaaacaggaagggaggaaggaaggaaggaaggaagggagggaggaagggggagggaggcatggaggaagggaggaagggaaggagggagggagtgaagggagtcagggagagagggagagaggcagggaagaaaggagggagggaagaagaaggaaggaaggaaggaaagaagagatgagctgggtgtggtcatgtgcacctgtagtcctagctacttgggaggctgaggcaggaagatctcttgagctcaggcatttgaggctgcagtgagctaggactgcaccactgcactctagcccaggtggcagggcgggaccctgtctctgttttagaagagaaaaagataacgactaagtgtcatgaaaagatgtgaagaaatacaatgagatgcccgagtgaaggctctgaaaacacctgctcgagttcgaatgtgtgctctgacacctgactcgttaatgtccttggccaagtaactttacctgtctgtgcctcccatgccgatccgtacatgggggatgatgacagtagtatctgccccacgaggggttgttgagaggatgaaagtgggagtaggagaccagaaatgatgatcacagagatgctggttatcttggtcaggccccactcaagggtagctgataattttatgtcttacactggagatgacagtgacccatacacgcagcacagcactgcatgaaaagctggtgagtcgatacagagagtcatactgaaggtctaaggagggctagggtagcctgtagcagaatgagcgtgaaggctctgctgaaagggcattgctccctggacctgtggcgggatcctcggtagaaagctgacattgaaagattttgaagagctttagttaaaaagttaaaaacagcccagcgcagtggctgacgcctgtgatcccagcactttgagaggctgaggcgagtggatcatgaggtcaggagattgagaccatcctggctaacacagtgaaatcccgtctctactaaaaatacaaaaaattagccaggcatggtggcgggcgcctgcagtcccagctacttgggaggctggggcaggagaatcacttgaacccgggaggcggaagttgcagtgagccaagattgtgccactgcactctagcctgggcgacagagcaagactgtccccccacccaaaaaaaataaataaaaaataaaaataaaccaatgttggcaaggctatggagtaaagggaacgcttaggaacgcttatgcgctgttggtgggaatgtaaacgagttcacccactgtggggcacactttgtagatttctcaaagaactgagaaagcaactagcatttgacccagcaatcccactgctgggtgtatacccaaaggaaaataaatcgttcaacggcactgcgcccgtatgttcattaccgcactatctgcaatagcaaagacacagaatcaacccaagtgctcatcaatggtgacttggataaagaaatgtggtgtatatatactacggaatactacgcagccgtgaaaaggagggaaatcatgtcctttgcagccacatgagtgcagctggaaaccattatcctaagggaactagtgcaaaaacagaaaaccaaataccacatgttctcacttaaaagtgggagctaaacattgggtacacatggtcataaaaatgtgaacaagagacactggggaatacaaggaggtgggagggaggaagcaggataagggctgaaaaaattctacctattgggcgctatgcccactacctgggcgatggatccgttcatatgccaaacctcagggacacacaatatacccatgtaacaaatctgcacatggacttcctgtttctaaaaatcaacaaagattgtgagacctgcccagtggccagctggctgtgtatcttctccaccaatgaggctgcattacttcatcctcctctccctgggagggggagcaggggtgaggctgttaatggccacagtggctgactcacctcatggcgagaggaacctctctcatctgacttctttcccagccttggtcagatgactccacattgaatctggcatttatttcccgaggcaggaacctagatccagtttgcctcgagtcaggatagaccctttatccaggggctaaccagaaatcacagggcacagtgaaccactcagctctggctggctgtggccagtgagtgaccgcatggcctgagcgggccacctcctcctggaccgatgactcagtctcacgtgtcgagtcgggcaccaggagactcatacagagttggccctgtaattttcttctacattcctcttctccaaaaggaaaaataaacatacaacccttcgttacaaattttaattcccggttttctgtaacccagactcatgcctcgcttttctcggagacagacataagtagaacatcgctgcagatgctcacggtgtgtacacccaaccaagtcttaatcagaccagaggcggtcctctcttcacatttatacatgacagccacgttcatgttagcccaataactaggaccattgaaaagatacaattttttggctgggcgcagtggatcacttgaagtcaggagttcaagaccagcccagccaacatggtgaaaccgtgtctctactaaaaaatacaaagattagccatgggtggtggcgcatacctgtaatcccaattttttgggaggctaaggcaggagaatgcttgaacctgggaggcagaggttccagtgagtcgagatggcaccgctgcactccagcctcggtgacagagcaagactccgtctccaaaaaaaaaaaaaagaaaaaatacaattttcacttcatctcttcttcctgccattgcttacctcctgaggaagccagaattggtggtaaaaggccaaaagagaagatggcaggaaaaggcagaatgtgaagcatatcattagaacaagcacgggtgtgtctcatcagtaaacttattgagcaattactatgtgcagggaactgtggaaacaaaagggttaagacacagcccttactctctatacgtactctctgattaaggagcgagatgcagaagaaaggcaaatctaatagaaagtgggagttaatgctggtcaagtgatacatacagtggaaatcaccatagaagctgggaagccaggatagagcttcagcctgtctgtagtggcaggtgcccaggctggacagggaaggggctgcggtatacctgtatgggcgccaaatgccagaatcaaccaggatacaggaatgggttcctttccatctgtctgttttgctccttcctgatctattctgaactcacagaaaatagctataggtctagtggggaaagttatatatctaattttgattttttttttttttttgagacggagtcttgctctgttgcccaggctggagtgcaatggcgcgatcttggctctttgtaacttccacctcccgggttcaagcgattctcctgcctcagcctcctgagtagctgggattacaggcatgcaccaccacccccagctaatttttatatttttagtagagacggggtttcaccgtgttggccaggttggtctcgaactcctgacctcaagtgatctgcccaccctggcctcctaaagtgctgggattacaggtgtgagccaccatgcccagctagttttgaattgtttaaggccacccaaacatttaccttatgaagttataggatttggaataaatgttacaggagtaattctactttctcatcctgttcctcacctggaatgtcacataagtctaaacggagaaaaggacccgaagataaaggaacagctagaacaggaagtgcgagcataagaattcaaacccagggagctggcacaatgagtgccccgtgcccaggacaatggaggccacttgtgtctgcttggagccccaggcaagccatccacatttccatggcacaggggtgcagtcgatgagctgcattagtccttcgctgggctgtgtttctattagtggatcctctgaggctggtgctgtgcctgagatcattaagtcagatgcgctgaaactttgtcaaacaaaagtgcttagggcacagcctgaggctctgtctgcttctcaaggaattgcccatcagtctctgccaggcgtgggtgctcatcactgacacctgtgtctcttcacaaggggctgttgtagcaggagggatgaggttttttttgtttttgtttttgttttttttgtttggaagacagagtcttactctgtcacccaggctggagtgcagtggcttgatcttgactcactgcaacctccacctcctgggttcaagtgattctcctgcctcagcctcctgagtagctgggactacaggcacccgccaccacacccggctaattttttgtattttttttattttatgtatttatttgagatggagttttgctcttgtcactgaggctggaatgtagtggcatgacctcttctcgctgtaacctctgcccactgggttcaagcgattctcctgcctcagcctcccgagtagctgggattacaggtacccacgaccatgcccagctaatttttgtatgtgtagtagagacggggtttcaccatgttggccagactagtcgcaaatgcctgacctcgagtgatgtccctacctcagcctcccaaagtactgggattacagccatgagccaccatgccctgcctgaaagattagtttttattttatttattttttatttattttcttttttgagatggagtctgtctctgtcgcccaggctggagtgcagtttgcaatctcggctcactgcaacctccacctcccgggttcaagcgatcctcctgcctcagtctcctgagtagctgggattacaggcatgcatcaccacgcctggctatttctttttgtatttttagtagagacggggtttcgccatgttggccaggctggtctcgaactcctgacctcaagtgatccgcccacctcagcctcccaaagtgctaggattacaggcatgagccatcgcacctggcctgagggatgagtttttaaatgacttccatagctgtcattaggttctgtcagccactggaacacactgctttgttcttttcctcctgcttggaaaacgccaaggctattgccaatgtagtatcttcagcaaaggaaggaggcagctgagtcaggagccggaagtacagaaagaagccacagctcatcatgcctgatgaagggaattcagagcagattcctaattttcaaaaattccatgctttggctcttcataatggaaaaatgcagaattataagtttaaactcaaatgggagaagcacctgtgaattaatattttgtgaaaaacaaaacaggaaacaatataatctacatactgcatgacgttttatgtgtgaagatgcacatagaagagaatattggccgggcgcagtggctcacacctgtaatcccagcactttgggaagtcaaggtgggaggatcacttaagctcagttcaagaccagcctgggcaacatggtgaaacatcgtctctatcctttttttagaataaaatttaatttaaaagaatattggggccaggcgtggtggctcatgcctataatcctaacactttgggaggccaaagtgggggtattgcttgagcgcagaagtttaagaccagcctgagtaacatagcaagaccctgtttctacaaaaaaaaatataaaaaattagcagggtgtagtggttcacacctatagtcccagctattcaggagactgagacgggaggatcgcttgagcttgggaggtcaaggctgcagtgagctatgatcataccattgcactctggcctgagcgacagagcaagactgtctcaaaatcaatagtggaatattggaaggaaatacatcaaaatattagctgtgggtaatgaaagtagggaatttttttcttttcttttttttttttagactgagtctcgctctgtcgcccaggcccaggctggagtgcagtggcaccaactcggctcactgcaacctccgcctcccgggttcacgccattctcctacctcagcctcctgagtagctgggactacaggtgcccgccagcacgcctggctaattttttgtatttttagtagagacgggggtttcaccgtgttagccaggatggtctcgatctcctgaccttgtgatccacctgccgcggcctcccaaagtgctgggattacaggcatgagccaccgcccctggccaggaagttttttctttgtttccaatgtttaagtttctgtcagtgaacatgcattatggctttctttttttttccactttttatttttttgagacggagtcttgctgtgtcacccaggctggagttcagtggcgcgatctcggctcactgcaacttccgcctctggggtgcaagagcgattctcctgcctcagcctcccaagtagctgggattacaggcgtgtgacaccacacccggctaattttttgtattttagtagagagggggtttcatcacgttggccaggctggtcttgaactcctggcctcaagagatccacccgcctcagcctcccaaagtgctgggattacaggagtgagccaccgtgcctggccacccactgtgttttaactcagaatagacagtgcacaggattgttgcaacgaaatcccagcgcccctgcgccgggtggaggagctgggcaggaggaggacttttccctctccctgagctcggtgatccccgtctctccgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccggcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaacacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacaggtaggcacattgccgggttctggacatgcccccagagcagcctctgcccaccccttcctgggtccctgactccgtccccctccgtgtgcccctccccagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccaccccccccccccgcccacattgcttccccagcttgccggaggaaatcggcgagggccctgtcctgaggcctgctgcccggggccggtgggctggcccttcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctc

SEQ ID NO: 17460 - DNA, 14207 bp, Human; identical to SEQ ID NO: 12187

SEQ ID NO: 17461 - DNA, 24109 bp, Human
gtcttattgggttttggtctcaaaagtctatcattaaataatattacttttcttagcagcataattcacaattgcaaagatgtggaaccaacctaagtgcctgtcaactaatgagtggataaagaaaatgtgatacacacacacacacacacacacacacacaccatggaatactacccagccataaaaaggagtgaaataatgtcttttgcagtaacttggatggagctggaggccattattctaagtgaagtaactcaggagtggaaaaccaaaaaccgtatgttctcacttaagtgtgagctaagctatgagtacacaaaggtatacagagtgatataatggactttagagacttagaaggcggagggtgggaagggacctagggttaaaaaactacttattaagtaaaatgtacgcaactcaggtgatgggtgcactaaaatctcagctttcaccactatataattcatctatgtaacaaaaacccacttgtaacccaaaagctattgaaataagaatctttttaataaagaaaatgccacacaaaaataatattggttttcttctaatcctgaaggccaatataaaaggtaacaaaagcctgagctctttaattaatgggtacaagttaagacagaatcacatcaggatttgaagttgaacctgagctcaaatcctgttcccatcactgctagctctctgaggctttcctctcaactacaaagtggagatataatactaaacaagcttactgggttgcttaactaatatctagaacatacttaacagtgtttctattaatgcgagaactaactgtaagcacttagtaaagagtagtcattattaagcaatgataaataaaagcatttgtataattctttttttagcttttgaaagccttgcacctagattttctcatctaatattcattaaaaccctgaaaggccgatcatatccccactttagagatggggacaccaaaaaacaaagagatgggaacacctagatatatcagagatcctagtttttattttatttatttatttatttattttttttttttgagacagagtgtcgctctgttgcccaagctggagtacagtgacgcaacctcggttcactgcaagctccgcctcccgggttcacgccattctgcctcagcctcccgagtgagtagctgggaccacaggcgtccgccaccgcgcccggctaatttttttgtgtttttttagtagagacggggtttcaccatgttagccaggatggtctcgatctcctgacctcgtgatccgcccgcctcggcctcccatagtgcttggattacaggcgtgagccaccgcgcccggcctgatcctagctttttgtaggtgactgacctaggtggtacaagatgtcctgtacttgttcatttattcacacatacaacacatatttattgacttcttaccataaactgtttaaggagcctggtggggataccgcataaacaaacaagcaaaaatagacaaaaatctttgtctagaaatatataaatatagaacattttatagaatatatgacatagaaaacagaaaaaaataaatatgaaaatagcctaattttcagggttttcctttttttacatacccttcatggttaacggttagtggttaatggggattacccattaactcccaccctccttcccagctctctcccaagacttagtttcaggaactagaaaattctgattcagcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacaggtgagctgcttactcacgacccgcgaccccaagtctctgtcagcgcgctttgccctcagcatcggattccttcctaggaccgggagacctttgtgacttcccgggcactcccgacctctctgaagtgcgcttttatcttttggtgtaggagagactaccggcgaagaggaaatctttcctgaaggaggagttaagttttttgtgttagctgtttctctttagaaaaacgctctggagaagtggtagctttggttgattgtgatcacccagtgttctttgactctttagggactttgttaaaattcaggatttctaattttctgctgctaataggactgctgatggataaatcctgggaaaaaatcagccaagttcttcaagtctataacgtggcacctgatccttgacctagcttgctgacatcttttgaaagtgggtgaggtaatattgccacataaaagcacctgttaaatttcagtacatcacattctttcaggattatccccagttcccaccttctccaatacgccgtaccacattcctgcaatacattgtaacttatttttttctttgtctttcaataacttgagtttcctagcgggcaaacgacgggtcttaatcatctctttgttatccataccttttacaatagctgctttatgctagtaggtgctcaaaagtatactgaattgattaaaaacagcactaactccagatgtcttaaaagaaagatgttttgtgttttagaaacacagtggaaatttctgaagtaagacaagtttctggagcaagcttgggaggttctgaagacaaagctgagaatggaatttatataatttgtttaaagtgatcaattttattttacttttccatacagtctaagtaaaaccttgagccttaaaaaaagatgagatattgaaaaaatagtttgcacatttcttctgttggacttttcattcatatattaatgcaaaaaatttttactgagcacatcaaatgtgccaggcatagtgttaatgcagggagttagagtacacagtctctacctttgtggagcttacagtctagtggaaaaatcagataaccaacaaactattaaaatgtagtttaactgctaaggagaaggaagagggttttgtgcttgaacatggaaaatatatctaagttggttttaggaaatcaggaaagtcttcccagaaggtatgacactaaggtaacagtaggatccagtagtaaggaactattattctatttggttatatgcctttttaggtttgatttggaaatatagttactttcacttttaggagagtggtgatacagataataaagttgcaggtcatgctaagtgaaatatattctattcattacataaaaacaaagtctaatctttgaaataaaccgtgaacaatttaacataccccgatttgctaatgtgaaatgtttttcaggaatactctaggaccatcctgcagaaggagtgtaattgttcaaatgaacctaggaatatgatttgaacaaagtagatagtgcaggggaatatccttgaaggatgtgtagtttgactaaaaaatagttttcctacagtgggtggctgtgtgttgggggtaggggggatggaatctggtcaatttttaaattattgcattgaattccagtgttagcaaagaatacaaagtgaacttgaaagtctacttaatattagtggcccctactctctgccatgatactttattgaaaaattaattgatttattgttttttaattataaatttggtattgatttcatattggtttatcaagatgggatgctttgtttaattgacaaggaaagaaattttacacacaaatatttttgtgattgtagtgccatagtattttcctttaggaattttgactttgaataataaagtttgcctaaacttttaatgtctgtaaagatctgaatcttaggcttacttttactattttaatagtatacagaacatttataaaagcgcctactacataccaaacactgtgctaagcctattaagttcatttttttatttaatcctcatactaccatattagaacaggtactattaaaatctccaataatagataaggaagctctgaggcttagagaggatagatcacttgcctaaattcacagctaataagtggcataatgaaatttttcatcagggtttttccccttggcactgttgacatttggggatggataattatttgttcttggggactgttctgtatattgtgtaggaggtccagcaatattcctggcctctaccctctagatgccagtagtaccactacccttccccactttgtttgtttgtatgacgacaaaaatatttctagacattgctaaatgtctcatgggggcaaaatcaccccaattgagacccagtggtttttattaagtttttgtcgactcagacaaaaacttaataaccactgtactttagtgcctaaccactgtactttactgccttgttctaaggccttttaatgatgtcttacctcttaggagtccaggaataactttttaataaacagatatctcaaccaaacagttttatatttaatcaccttaattgtccaggccagataattcaatgtattttcatttttgtatgtttttgttttcttatcagtgtactttcagtatttacactgataatagatatcatattttaggtatttactaggtgcctgtacaagctgccatattaccgaagatggacagttattcagataatacaatagagagtaaaatttacaaaataatgtagacagagtattttatacagggtgtttcctctgtgtttaactgaaaatttagacttagggcaggaagagagatgagcttttcttctcaaatgtggactccctaactgataccctgtttatcttttttcctcattccttttatggcatgtttctccttttaggatttttgcaatttctttatctacctttctgttctgcctcaaaattattgtattttctttcattttcctctggcatcgtgaagggcagtccagacttgaagaaagtgttagatctcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataattatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagcttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaactgcacataatcgatacactggatgcaaatatgtaatgaatgaatgatttttcacattacaaaattaatttgtgcgtattatagaaagttcagtaaatacataaaagcaaaatgaccaaaatgttaacagtgtttattaactataatctgtactcaaattatatccattttggtggatgaccttaaacatatgtatgtgtgtataacattaaataataggtaataccgtaagactgtttcacctaattttttccacttaacagtgtttaatgaatattttctcatatcattaaactctatacagcattgttttaatggctgcatagtattccattgtatgaatatgccagaaagattattatttaaccatgaagattgtgctagcattgtgttctcaaggatggtaatgctaactgaaccagcatggtaaggtgttggttggcataccataatccctataaatacatccccagtgttgtatattggcagtctttacattgctgtttgcaaattcctgaaattgcagaatgcttttggccagtttcttatagttgatacagttgttagtctttttctcaggttacagtaatgtttacagtgcctcttgtaaagtcaaaggatttgtaccaatctgagtggcaattttttccatgtttcttcaactagtccttttaagattctcacctgcctttagcaaagaacatatatttaacacctgtggttgcagttatgtaaaaaataccgatgtcacagccccacctccaagatgctgacttaattggtttggtggtggagactgggcataagtagttttgtttttgagatttccccaaatgattctattgtgaagccaaggttgaaaatcaccgatctatgttgatattctttcttggcacttgagtagcattcccaacattatttgcatgctttttatctactcttgtgggttcagatctcttcagaatggcactggggaaacaaaaagattggtaagtaccattcaaatttaggaaaatagaatattgggcactagttcttattggctaaaagcatatgacagtattcactcttactggctggccatatattagtagtactgtttaatatgataattttgatataattattataaagtactgtttaatatataaaactgtacatacatacagacatacatatgttaatatagaactatttctcaaatatataacaaatatatgtcaataaaacaaataattgccataacagtggtattaaacaagataaatctacaaactaatacctcgactggactctgcctatctcccctggttcacctcatgcttattcaccttcttattcatactgaaatttccagttcaccatttttacatatagcttagaatcttattatcctgtaattgtacatttgctgatctgccactttatcattttattgttgcttccttgtttttattatcagcttagcagtacactatctacaattttaagatatcactttgtactttatcaaagttagacctcagatcctgggagaccctagcataaatacttttctacttaaatatttagttattaaacatctgccaaagggaggctattctttctatgtaaaataaataattccaaaataggattatttctttgcatcacatggcagtgtcctagtctgggttactatacaaaataccataaattgggtggcttataaatgacagaaattgatttttctagttctgcaaggtgaagatcaagcaccagcagatttggtgactattgagggcctattcctggttcatagatgtcaccttctggctgtttcctcacatggtggatggagcaagctagccctctggggtctcttttataaaggtactagtcgcattcatgagggctctaccctcatgacttaatcacctcccaaaggtcccacttcttaataccatcactttggggggttaggatttcaacatgaattttgtgggggataccagcaaacattcagactatagctgggtagctggcagaaagctcccctaccccacatgtggatggaaaaacaatgtctatttgcttcccattcttcaggcacttcctttccctgttggatctagtagattggagatgcatggttttcttcttttgaaatgacactgctggtttttccagtagatttgccccctctttttaacaaaaataattgtaaaagcagttagaaattgttcaggaaaatattacctgtaattataacatgtgaatgctattattttcatttttgtctgcatatatccctcgatattcaaacttttgctgtccaaacttgggaaccaaatagatttcttcagtaaagggtatctgacatcctaatctttgtctctacccttggtcatttttatgtaattgcagtcaaagtgttcataataatttgcagtcactagtacacacatttagttttgtttaaatgctaaaaactgtaacacttgtggaaggttctgctggatattccaacataaaaatgaaattcaccaatcttgttcctaggatattcccctgagtatagcacatgctgtgtagttctgtgccaataactgcaaatgaaatgggttaggaggagagtactgtcctaatagtggaaagaagactggattgaaagttaagagtgcttaagtgtatttgaggtatatgcttttgcttcttagcaaataactaatgcgatcatcttgaagaagtaggggttaggtcttcctctgtactctgaaagtaggttgtctttcctccgttaaaatgaatcttacttacctgtaaatgaaggacctcattcagagtgtcctcataatatggtgcttctcactaattgatacagcattttgtggaaaattcttaaatgaagatgtcttctttcagtctggccgggaccttcaacagtatcagagtcaggctaagtaactctttcgaaagttgaatgaacagtcccctaccagatgtaccttggaagcaggagccatgacttttcagtgagtgtaatcttgatttctttatgatcatttaagtgtgaaatacagtaacagaatgcctgataaaaaataataatttttaaaaagtaaagattacttaaaaatgttgtcttttgggaggagcaacttctctggctctaattctacaaaatggacatcttgttggttttttcagcatgcttacagtaatttaacctgttaacatgtgtctatgctgtgcccatcatgcaataatagataacttcttgctttaggactgtcttggagccagatatgtgtaggttagtacccttgctcaaacatttcctaacagtgtaactttgagcagctcacataacttctctaagcctcagtttcctctataaagtagtgaaaataaacataggaggtttgagaggattgtgagggaatccgtgtgtattacttagcatcttgtctgacacacatgggaagggtcaataattattagttattattattttgaaaaaagaaaattataaaagataagagcatcttaatcagtggttataaacgatacagctgatagaggactcaaaggaacattattggattttaaattatctacaaataattggtatttaatgtttaatacatgccaagtttgaagctgacaaaatgggaaggattaaaaaggaaaagagtacaagagcatcagaggaaaataaaaacggattagttaaataatctttgctattttagggacttagatagtaagataacttaggccagggaggaagctgctatgtttacttttaaaaaacaaaacaaaaattctctacctataaaagacaagtaaaaagtacatcaaaacaaaaataaaaccctaggcaattggctaagaaaatgttggacattatgttttatgatgtattaatttttataatatctgaaatattttctagaactctaattttcaacaccaaaaatagtcactcacttaatatctagtatcctcattttcaccatggtttagagaaccaagacctaggaaagttctcatggaattgagaagagattttcttctgcctgattcctttaggacattcataatctcatatcatcctttatttccatccaagagctattaagggtttattctttgccggaccttatattgagtcctgcatttaatgtccataccttttaacactgttctcttagtacagagagagacatatactcaaacaagtatactataatatcttcattgaaaagatgttgtaaattagatttaaatgaaatgttttgggaacagagagaaggaaggaacaaattcccatttgtagggggtaagtttgaagaaacgggacagaggaggggagtatatttaaagaagtttcacagaaaaaattatggtagaattgaacatatggaaatgaacaggatttctccaggtatttaaaagagcattaatggttagaaaaaacaatataagcagaagtccacaaatatgtaaagaacctagcatgttggaaaacagtccgccatttggtttattaaaatatatgatagaatgttgcttacacttgttttgaaaggctgtaaatataataccatggagtatgattttattttgtaggtattagggaacccttagagtttgtaagcagggtaatatggtcatctgtagtctctgggaataaaactgatggtatagaagatggtgtagactaaaagcaaagagaccagttaactcaggtgcccaagcaaggaataagacagctgtattattaatattattttaagggacctgagagatcatataatagtctttatcctttatggagccctaggatgcctcaggagccacatagaaagggcaaggatgggagtatatataatgctttgggcccctaaactcctccttatgttttaaattttttccttttattttcagttgacatgtaataattatacatatttatgggatacagagtgatatttcaatacatgtatacaatgtgtaatcaaatcagagtaattagcatattcatcacctcaaacatttatcatttctttgtgttgtgaacattcaaaatcttgtagctttttgaaaatacgtggtaagttatagctagccatatttaccctacagttctgcagaacaccagaactcattcttcctatccagttgtaattttttatccattaacttgcctctgcccatcctccccttctctctacctttccctacttctaatacccacaattctactctctacttccatgagctcaaaaattttttttggctcctacatatgaatgagaacatgccatatttatctttctgtgcatgactgattttatttaacgtaatgtcctccagatttatccatgttgctgctaatgatagaaattcattcttttttatggctgaatagtattccatggtgtgtgtgtgtgtgtgtgtgtgtgtgtgtgtgtaaaaaacacttttaaaatccattattctcttgatggacatttctcttgattatctatccatagatattatgaatggtgctgccgtaaacatgggggtacagataagtttttaacataatgagtttttttcctttggagaaatacccagcagtgggattgctagattgtatggtagttctgtttttagttttttgagaaacctccatactgttttccatagtgtataaaagttctcttttctcttcatcctcaacagcatttattgacttttgtctttttaatagacattttaactggggtgaaataatatgtcgttgtggtttttatttgcatttacctgaagattagtgatgttgagcattttttcatatacttggccattcgcatgtcttttgagaaatgtcaattctgttccttgcctactttttaattgaattatttttggttttgctgttgagttgtttgagttcctcgtatgttctggatattagttcctcatcagatgaatgaaactagatccctatctcatcatatacaaaaatcaacttaaagtagattaaagacttaagcataagaccctaaactataaaactactagaagaaaacataggggaaatgcttcaggacatgaacctgggcgaagactttatggcaaagacttcaaagcataggcaacagaaaagaaagtagacaaatgggactgtattaaactaaaagcttctgcacagcaaaggaaacaacacagtgaagagacaacttgcacaatgggagaaaatatttgcaaactcctacttaaactaaagaacctctgattttatctgatatatacattggccttctgaatataagttttgcttgttatatatacatattccatatataaatatatatatttgcatgtgtgtgtgtgtatactatggctaaaaagaagttggaaaaccacttagtagcctaacatttttctaagaatttctcagatgtgtaatcatatagccccttccagagtgcatgggcgctcatcatcacaaaagaaagtcagttccattgttgaaaagtttccagttgattacagagtcctcctggactgtaaattaaggagtcttattagtcttgtacccagtaaacattatgtcattaaccttacatttctatccacagaaatttccagttacagtgttttcctttgtggctggaaagagtttaaatatgtgtatgctagtttaccatatagaatcaaagggtggatggagtcacaactctgaatttttcaggaaaaagtcttaagtattaagcaaaaaacaaataaccccatttaaaaaatggacaaaagacatgagcagatatttctcaaaacatactagaggctagcaaactaatgaaaaaatgcacatcactaattattggagaaatgcaaatcaaaaccacaataagataccatctcacaacagtcacagggctattattaaaaagtcagaaaacaacagatgctgatgaggctgtggagaaaaaggaattgcttatacactgttcgtgggaatgtaaattcagccactgtggaaagcagtttagagatttttcaaagaacttaaaacagaactaccattagacccagcaaacccattaatgggtttatatccaaaaggaaacaaatctttctaccaaaaatcatgcacttgcatattcattgcagcactattcacaatagcaaagatatcaacctaggtacatgttagtggtggattggataaagaaaatgtagtatatattcagtatggaatactatgcagtcataaaaagaaatgaaatcatgtcctttgcagcaacatggatggagctggaagtcattacctaagtgaattaatgcaggaacagaaaactaaatactgtatattctcatttataagtttataagctaaacattgggcactcatggacataaatatactgaggacttactagaagaggagggaaggagggggcaggggttgaaaaactattaggtagtatgcttagtacttgggtgacgggattgtttgtaccccaaacctcggcattatgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggtgtgagaatcacctgaacctgggaggtggagattgctgtaactgagatcatgccactgcattccagcctgggtaatctgggtgatggaaagagccctgtctccaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggcaggagaatggcttgaacccgggaggcggaggttgcagtgagccgagataatgccactgcactccagcccgggggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactgttgtcagtgctattactttacagacaactttgtcttgctttttatgtctcaccagctacattattgagcagggggtgtgtgatttggttttatgtgaagctgccttccctaagaagttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatagtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaataagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaatttctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttttttttgtttttgagacagagtcttgctctgtcacccaggctaaagtgtggtggtgtgatctcagctcactgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgcgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaagatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaggcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaatagtttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtgactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacaaccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgctgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggtaccatagtatttggagcttctataggagtggagaggggcagctcattgttgagagttgcatgctgcaacctaatggtcagcaatgaaagaaatacttgtagaatgttcacttcagtgtgaagttttgttatctagttaatttatatacatatatcctttgtagatacatttctatctaatcttgttgagctaattaagaaataaggggtggggtaattgtcaacaaagggagaagaaagtggtttaagatcagggcagcagaaaaattagagaacaagaatatcataatatggctcctggttttctttataagaggcagtgggaagatctgactagatgaaatgtatcatcaaccaaactggcatctaaaatagaatgggataaatactgtatggggttattggaggcatattaagaaaggacacctaatttattttgggaagaagtatgttaagagaagactttctagagaaggagaatggggcattctaggaagagtcaatggcatgtgcaaaggcatgaataaagacagtgaggcatattttggaaatgtaacagcttgattcagcttagcccatagggtaagcatagacaacagaggagacttgaggaatgagaactagatgggtacactatcataaagggacttgtctatcatgctgaggagtttagaccatcttaatggtagtggccaaggatggcatcagatttatagtttcaagtgatcataatattggcataaaagatatattagggaggaagcctgaagtagggagatgaaaataaggagccatcaaaggcagaatgaaacttaggcagatttcaagtgattttcaaaaatgatgtgatcagaggtaccagataataactattacataacactttctttgttaggagcttatttctcacactgaccaaagcttttgaagtaagtactctttacaccactatataaataaaccttacaaaggattctgctttgaggcatgagagagt

SEQ ID NO: 17462 - DNA, 11389 bp, Human
tatcctatttagtgcctcagagggccaaactggctctagaatcatactgtatagggctggggaggggatgagggtccacttcaaggtctgtaaatggtgggtctattattaggtgtgtagttggggaagagtttatctagtttgctgggaaggctgctcatgggtctctgagtgggttcctcaacctgtggcacagaggagttagtgctaagtcacaaggtttcctcggggtctatagctgaaaccagtgtcttcatgtctgtctctggggtcatggttgagtgtgttttctggcaggtctgtgggcaggcagatttgcctcagactgtagttgagttgggctggagctggatccagaattgtttcaagatctgaaataaaactaaggtctgtgcctgcaggggcactaatgatgtctctctccaggtccctgtatgggcaaactgctctctagcatagctgagaagtgtcgaagccccttttctgtccaattaaaggatctgctgtgaaacctaggtcaatggtctcctagttgggacatggatgcacatgtcctccctctgtatccctgagctggcaagactgctcacagtccacagctgagaagggtgaaggtcaagattcaaggctgtttcagaaactaccgtggaactgaagtcagcaagcctgtactgctgacaaagatgattgagtctcacagcaatttcctgtgattaactcaggtcacagttgagaggagtttgagtggagattcagggccattttagtatcttctgtaggacagaggtcagcaagcatgccccagaggtacagatgtatatgtctcccaggaagtctctgtgggtgaaggactgatctcaagttgtggctgacactagttaaagccaagttagagggctgtttcagggtctacattgagactacagttgatatgcctacctcctgagacactagtgtgtgagtctcctcctgggcccctgggcaaatggttttggcagcatgaccaaggcctaaatggggctgaaggcaagcacaggaggatgggtcccttttcaggtctggagatggaatcactgttggtaagtctgccacttggatgcaaatctattccctaaaacaaccttcctaggtcttgggttccactggcattttacaaactcctacttgaattccaaactccctcaaaggaacttttgtctgtggatggctgaaaaattattgttgctgtgggggcatatgtgtgggggaccacctattctgccaatttactgactttcctcctagtaagattttaaaattactttttccccatacatagtttgacttcagtttttgtcatttacaactaaatatttctatgaaagtcgacataatttgttatggcggaggatgaataaatgaagaatgtaatgaatagctatttaatatttcaatttctggtatgctaatatatttcaaaattgattaatattttacctatccaagatatttttatcaagggtaatctgaagattaaataatctatttttaaaaattaagtgcaaaaatttaagaactaagagaagttaataatataactttggcaatgatgctttttgtgccagctacaatcaattgagtaattactgcagtaatttttcagaataattaaggaaaaaatcagtagatatcagttgataatattactatgagttttagaatgttttctattataatggaagtgacataataaaataatataaagaaaagaagtatgcaatgttaagatttagcaacctagtctaaaaggcactcttaacaaggtgagggttgacaatgttcgtgatcaagacagaaaaaaaaaaaattctcataggcacttgaaaaatgaaccaactaaatgacacactttcaaagtcaaccttgtacttttaatagaccaagtatcctatattttggaggtgtgtgatgagataaaactgatttcacaatagcccatgtgtagaatttcctgttcaaaccttagtaacacgttgatgagaaatctactttttccactcttgactcactctgagccttcacagggcagtctgcgaagattgcaggcattgtttgttcttgtcttggatttatgcctttaaatttcaccttttattacacagctatagcaggcctttttatgagactaacctggcctctccactaaaggatgtgtgactttctggggacagaaggtatgtattgctactctccaactctctactagcctacctcatttagtgggtgatttcaagtgctcaatatgatacaaaggaggtataattaatatacaataaaatcaaagtagaatattgctgtcttcatttgaataactcagggtaaaaacctaaaatatgaaatatgttgaaggatttcttaaagttttcaaattattgtttgtggaaatctagtgggtttgttgatcaatatcgtttaagggaaagctattaacatcacaataatgaacaattaattttgtattttgtaatcagtacatcatgtatctttgaataataatttatatttagcttagccattaaagattattaaaataaatcaatcaattgatgaaagccaaatacaattcctcagacacgtagattagagaaaagcagtttttatttttaataaaaatcagaatgaggtagattacataaaatgctaaaggtattacaaagcaataaaaatactttttaaaaattgatcaaaatattgcaaaaaaagatgtagcgcatggacataggagacttatctgaagatttattttccatgctttaactgacatgaatcagaaacagtaacataacaattgtgactaaaataataattaaagtagctaatgcttattgagaactttaagtgccaggttgagtggtaaatgttttacatgcaacgttttatatgttcttatgcccattttagattaacaaactgggttattaaaaatagaataactttttaaaggtcgcacattataagtgtcaaagctagaattaattctagatctcactgactccagagcccattgactaaatgatttaattacgttatctgaaattttacaagtacttatacaactaaagtggcctttactcactttgacaaccataaaatcattctataagtttaaatgaaatgtgctttaacatgaattacctatacttttatttatcattttttggttcataatttagccaggaaataaattaccaattactaattaaattaccaatacttctgtaagtattaacaatttatgtagtgttcctaatactatttaggttatgcataagttaactgtgtcacatagcattttctgtcatatacaaatatttaattttttataatttttaataaataatttttaataatttcttagaacatttcagccattaagaaaagaccatttaattacctctattgattttcattaatgtgtataaattactaaataaaagtaatgtagtgcaagaaatttttatatatatatatgtcaactttactattactcatgtgcagaccacatagtcttaaccattactggatttcaaaattaacataaaaatgagtgcagaagtttttctaatacaacattttaatttttaacacaggtaaaacatcagactttaagaaatatatttttattcctgaacttctttattccttagtaatttattgcttctcattgccccagcaataatattttgtcaaatgcagaaaatttatcttttttttttgagtcggagtctcactctgtcgcccaggctggagtgcagtggcacaatctccgctcactgcaacctctgccgcccatgttcaagagattctcctgcctcagcctcccgagtagctaggactacaggcgcctgacatcatgcccgactactttttgtatttttagtagagacggagtttcaccgtgttagccaggatggtctcgatctcctgacctcgtgatcggcatgcctcggcctcccaaagtgctgggattacaggcgtgagccaccgcgcccggcctaaaaatctttttttaaaacaaatattcataagaaacgtgtttaggcttgaagaaaatcagagaaagaactttagattatttaatgcaaaatgagctccaatactcgttctccacctcacccttttaattgcactagggaatcctgtatataaaccatttattaacttcttaactactgttattatagagtacagtccctgacatcacacactgcagagatggataaccaaggagtaatctactcagacctgaatctgcccccaaacccaaagaggcagcaacgaaaacctaaaggcaataaaagctccattttagcaactgaacaggaaataacctatgcggaattaaaccttcaaaaagcttctcaggattttcaagggaatgacaaaacctatcactgcaaaggtaaagcatttaaaagatcctcaatataacagtctaggatgtgcagcttggggtacaggaatgtggggaaagagaagggagtgctcatatatcttctatttgcaaagatcagaattccaagttgagatatgctatttcaatgtaaagtatgaagactgattgaactcattgttgaagtttgtagtctttgtcaaataattcatggagcattatttttcctgaaaattcaatggtatattattctgagaaaaagattacaatgggagatgagggtttggggtccaagtttctctgtatgattcctgtgcattcaggttctcttgtctgtgaatcttctaaacgactgtatccacctctcctttcgcactgttcccatttctctccctgcagatttaccatcagctccagagaagctcattgttgggatcctgggaattatctgtcttatcttaatggcctctgtggtaacgatagttgttattccctgtaagtctattttcgaagattacaaggggaattttcacgttaatgattgaatgtgcctctaaacatttcatattttcagggaatagagttctcattgtaatgtatatatttggactaaatgtggaatgattattctgaatttgtcaaagaataaatgaaagaataattgttgaaagtattcgcttctgatgcaatcgtatgtatatatttggatttcataactcaaaaatatgttctaggagtctgaaaaaccttactgagaaatagaaattaatttttgaaagtagttaaatcaagaattataagaactatatgagatggtgaaatttggttctttagatctatgaaatacttttccaaaaaaccaccattactttatcaaatttttcttaaaatcaattttattccatattattctaactctaaataatacaaaaaaattcaaacaaaaacttaaaattattatgattgatttagatgctaatttttttacaaagattactttaatttttctagctacattaatacagaggcacaacaattcttccctgaatacaagaactcagaaaggtatataataatttttaaagttttaatattgtacagtttattttttcttgatcttaggctgtacaaaaataaaattttgggtgaaaaattataaaatttggcaataagtgttcataaataaaattagagtaaggcattcacttgtcatcaactataagtaaaatcactatgctttctttttatctgttgtgttcaaattcttactgctataatatgataagatacaagttatttattgttccttaaaaatcagattagttcattgatttttcaagacatgtatagagtggatttttgtttgctggtttgctttatatgggaacacaattaggagatgaaaggctgaccctttattgcgcatgtgtgtataagtgactgggtattttgacactatatatttaccagcccatgaagatgtatagatatgttgcatacatataggtttatatgtttgcaaatatgtgaactaattttcatttttaaaaattcatattggtctagatagtaattcatatctttatttagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatggtaagatgtaaatgttttaaacactttatgaaaagcttctttcggtcgataatatatttgtagaaatcatccatatgtgtgggtatatacatttagcttatatgttttcaagtttatgtagtatttaattgattgacttaataatgttttaaaattcatatactgctaatgtacttttgattattttcagtttttgcttttcatggaaaaccatgcttctagaaatgctttcaatccacaatacattttgctatctaattttatcgggcatgatgtgatctggtcatgcagattgatcacaaagtgaatgaactcctgtgatacaagtcagatcatgaaataaaagtttccagctctagtagttccacccctgtgtatgccctcatcacttatcctgactcctctccaaaacactgtcttgacttttaatgttataaataacgtttacctgcttttgaatttatataaagggaatcatacactgtgaatttcatgtctgtgtttttcactcctatctgatatttatgcaattcctccatattattgcggttatctgtcgtttattactgttcactgctgtagtatgtacaaagaacactaagaatccattcaatcctgtgtctctggatggggaagtgagtctcatgccctcagggacaaagaggaccctgggtggtgcactggtagtcattgggttcctttgctgatcctcctcacccacatccactctggtgtctcttggtatgagaaggaagtacttcctctggctgtattggtagcaagtctcctggtagatcatccttgccagtggtaccagccttgcctgttgttgcggaggggactccccttcaatacagaacaggagtgagctttgctgggcctcctcctattgccaggttgggtgtagggaaacagcaggcctaggtcaccttcttctgtcgtgtggaggacttaacatgctcgctcggacacttggttgatccctgatgctagggtcccagacaatttcatctttctctttccacctttcagagttctccattgcttttgtctttcattaatcccagagtttatagttgtttttagtagggagtagcagagagagacgagtctacaccacctggtcaggatcactgttattccaccaaaaccaaatcagataaaaaagtgagggcttatctagttaaagaatggtgtggtacccagaaaacccaatatgtagcttccatgtcatttatttctgaatgacaacctctaatttctcttctaaatctccaactctgagaaatatagcacaaaaatagtttgatttagtcacagtatctggaggaatgaatgcacagtatcaggagacttatttaaatccttactgtgtttattcagtcaattggggtaactattataatgcaagaattaaaacttctttattaacatgagaagaataaaagtactaagtataaacattgatgggttcatttatatcaaaattataaacatttatgaaagtttttggcactgcaaatagtggttttcaaatttaatatattgtttttgtaatgttttcataattattatttaagtgaaaattctttcttttcttttagaaatttctgtccatcatttcaccatcctcatggattggtgtgtttcgtaacagcagtcatcatccatgggtgacaatgaatggtttggctttcaaacatgagtaagttgttttgtatggcgctatataacaatatatatataaaggataaattcagaagaataatatgaataaatctatgtggaatcatagagatgaagaaagatgtggaaagttagtgaaatgctgacataaatattttacaatagaccatagtagtccatatatttcaaccgctcattggtcagctagtaaccttcttgattatcagatggaccaggggtgtccaatctttggcttctgtgggccacattggaagaagaagagtcttgggccacacataaaatacactaacactaacgatagctgacgagcaaaaaaaagaaaaaaaaaatcacagaatgttttaagaaagtttacgtatatgtattgggccgcatttgaagctgtcctgggtcacatgcggcccgtgggcagcgagttggacaagctcgagctggactatcagggaattgcagtgcttgtttttattaaaaagccacgcttactttttttcttaagaatatcctcaaagcacaagagtagtgctgttggcatattgctataattttgttattagtagttattgttgtcaatctcttattgtgcctaatttataaattaaattttatcacagttatgaatgtgtagagaaaacataatctctctataggttctgcactatctgccgtttcaggcatccactggaatcttgaaacatatccctcgtggatgaagggggactactctgttgagtgttcagaataatgactcttactaatattatgaaaaatttaattacccttttccatgaaattcttttcttacagtacatggaaaatgctttcgtctcatgaatcatttgcttaaaatgtaacagaatatggatttttctccattacaggataaaagactcagataatgctgaacttaactgtgcagtgctacaagtaaatcgacttaaatcagcccagtgtggatcttcaatgatatatcattgtaagcataagctttagaagtaaagcatttgcgtttgcagtgcatcagatacattttatatttcttaaaatagaaatattatgattgcataaatctgaaaatgaattatgttatttgctctaatacaaaaattctaaatcaattattgaaataggatgcacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctcagggaggttgaaataggagatgaccactaattgatagaacgtttctttgtgtcgtgatgaaaactttctaaatttcagtagtggtgatggttgtaactctgcgaatatactaaacatcattgatttttaatcattttaagtgcatgaaatgtatgctttgtacatgacacttcaataaagctatccagaaaaaaaaaagcctctgatgggattgtttatgactgcatttattctctaaagtaatttttaaagattagcttctttataatattgacttttctaatcagtataaagtgtttccttcaatgtactgtgttatctttaatttctctctcttgtattttgtattttgggggattgaagtcatacagaaatgtaggtattttacatttatgcttttgtaaatggcatcctgattctaaaattccctttagtaatttttgttgttataaatagaaatacaactgatgtctgcattttgattttatatctacttattccactgattttatatatttaaatctattatgtcaactattgatttatttctgggtgttctatataacgagcaattttatctgcaaatgatcacacttttattttttttaatccatgtgctataacttagttttattttcatttattttcactggctagggttttatacccatagttgaatagaaggcacaatcaaagttctttgtggatcatatgcatcattttctggttttggcaaaaaatacttcaacatgttatacatatttaaaaagcttggtgttttttgcatcctatctttctcatatcgaagcagttttataatactattttctaatagattttatcaattgtaacatttttattaatttgtatccgttggaatgatatatgttttgtttatataacattttataaacttttattttttcaaatgttaaaccagcctttgtttctgaaatagatccatgatgatcattgtatatttccctcataaaatatcagtgctggccgggtgtggtggcccacgtctgtaatcccagcactttgggaggctgaggcaggtggatcatgaagtcaagagatcgagaccatcctggccaacgtgctgaaaccctatctgtgctaaaaatacaaaaattagctgggcgtggtggtgcgcacctatagtcccagctactcgagaggctgaggcaggagaatcactttaaaccaggggtcggaggttgcagtgagccgagagggcaccactgtactccaacctggcgacagagggagactctgtctcaaaaaagatgaataaaaaaaaattagcgcatatatattttatgtagggtaagatttgtttcttcatccatgttcacaaggatatttgaccatgtttttattcatagctatatacttgaaaggttttgatatcaaggctatcttgggaagaatttctctttttctataacctagaagcatttgttgagagtactgctttatttttaaatgttataattcactagtaatgccatctgagtttgtagactatttttctaggaaagtttatgtctaaactgaatttctttaatacatggtgggatatactcagatttctatttgaggtactgcatttggtaatgagtatgtatgaattttctatttcatatagacattaaaatgtaatgaaaatagttttattgcctctaaataactgtaaagaccataatggtattgccatgtttaatctagaaataggccagttgtggtggctcaagcctataatcccagcactttgggaggcatcattgtgcctggcccttatcaattttttaaaatgttaaatttattatttttgtggatacgttagtaggtgtatatttttagtagtcgttcatcaagttttaaaagcattttcaatgaaaatacctttggccttgctgttctctctattgtaacattattctttatcgtgattttttactgtttattcatctttttcttatacatcacttgtatttaattttagcttttctatttttaatttattttagtgcattcaatggtaatttaatttttaggtcatcttttgtaatatatgtacattgagggcaatcggtttttacaagagagattttcattctattttccttataattcatataaaaattgtgaccattcgttttgataatttatttcacccatatgttatttagata

SEQ ID NO: 17463 - DNA, 11389 bp, Human; identical to SEQ ID NO: 17462

SEQ ID NO: 17464 - DNA, 4331 bp, Human
  misc_feature (1)...(4331): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgtgttaattgaacacttggcaattgctttcttagtttaccccattccagattacttatcctattgaggaaatgaagacagaaaagattggtggctttattatatgttacactgatgctttgggttagagagcatgggttgtataaaatattttaaaatgtggatggataattttagaccagttaggatggctacattagagaatccaaggcaatgtctgccattatctttacaacacacactgatttttttgtgtaccttgtcattatgtaagctgcctacagggctgtggtaagtcacggacagggttaaggagaagggtacatgtcgagaaactaaatcacatttggagaggagatgtaacaaaggtagggttcagaggtttactggtaacaattccaaatttggaatgaaaaagttactctttgtttagcgttcaagttgggagtttgccctgcaagagacagtcaacaactgacttcactcgaatgtgcttggaaagggaagaacttaaaccagccatgaacaggagaagaaagccaggttttctggaaacatcgccaaaacccaacaatttctcagaatgttcagaggcgccaggggggtgtttgcatttcaatggaaaaagttctgaaagcgcctttccggctgtgacgacataacccacacgagaacatgcctctcgcaaaggatctccttcatccctctccagaacaggagaagaggaaacacaagaagaaacgcctggtgcagagccccaattcctacttcatggatgtgaaatgcccaggatgctataaaatcaccacagtctttagccacgcacaaacggtagttttgtgtgttggctgctccactgtcctctgccagcctacaggaggaaaagcgaggcttacagaaggttattccttcacgaggaagcagcactaaaagcactctgaatcaagatgagtgggaaaccatctcaataaacacattttggataaaaaaaaaaaattctgaaagctctggaaactattctgttttactttctcattgaaaggcaaaaagcatggctgtaaataagagacagaagcacttgctatggctttgttaagagtgaagaaaagggacctctggaaaatttgaattgtccaatcctttgccacagagccaagacaaagtggtccaagtcataatggcaaatagaaaataaaagtacttcctctctgagagaagaaatagaagtagcagtttttatgggggccctggggtgggtgtgggcattcactatcttcaatttcagacctcttgagtttaaggtgcctttgagagctggaggtagatagcaggactgaaaagctgggtatagattcaggagttgttggctggtccctgcagctggattcatgggccttgatggcactgcccagggagtaatttataatattactcttaataacgtatcttttgtgatttaccttgaatctagagagaagtgcagttatatttcttcacaccatcaaggagacctaattgtctccagtcactgataagataaatgatgggagagggtggggtgctcaaaagtcagtcttttctggggacacaggtcagtgtgtctctcctgggtccctctgtgccacagctactcctcttaaatcttgattcaagggcttcagaagctaatggcatagttatgagaggggtgaagactgtgactgcatttccaacagaccctgaggacaattgggaagaatgagtacggagtcctactatccagtgccatctgccccatctcactctccatccttccctttgcccttccaccttcagttgttcattcaacacgtgttttctgagcacgatctgcgctccaggcactgggctgtgtgttggtggtatagctagcaagacagatttggtccctgatcttatggggcatccttggggacagggtggggtagggagatacaaataagaaaaccaagaattataattatacttatgggaggtaatgagatggagaaaaaacttggtgcatgaaagtgcaagaaaaaatttggctcaggaaagtatgaaagaggaatcctggctcgcaggtgagggagggtatctgggagaaactgaaccaggcagaatcatttctgtttcctgtctccgtgacttatttcctctctcttgaatattcttctccattttgtttgtctagttaacagaccagggcatggagcaagctggtttaatcactgcatcaaacagaagagtagatacagataagctcattttacagattaagaacctgagctcagagaatttaaataatgtgccaagttaacacagctattggtggagctggtgtctcaaatctctgtcttagtcatgtctggcttttttcagctgcgtcatatatcaagcaatctatttctggtttaatgtccgttaaatgaactgatgtcaggaaagcaccaggcatatgcctgttacaagagagtatggtggttaagaacatggacttttgagtcagatagaactggttatgtgtcctcttctgtcgttttctctctgggtgacctcggttatcttattttgtttttctgagcttcagtttccttatctggaaaatgaagataataacaacatctaccttgttggattataggaaatgcctgtagagattccttaatgtaaatatgttctccataaatattagatatttttattgatttaggcgctgaatatttttgagcaatttctatatgataagcagtttttaggtaagtatttgtttcttattctgcttttttcatctctttctcctcttccttctctctcacaacatgtagcaaagttaaatgttcaatggcaataaaaacgagtgagaaaaaaagagaaggataagacaattgagagatagaaatgggaaagagaaaagagaaaattaagtggaggcaaaggcaaagaaagaaaacagaagaaaagaaatcacaattatgggtaacagga

SEQ ID NO: 17465 - DNA, 71879 bp, Human
catacagtccaggaccctccaaatatttaagagatcttttccctctgttatcaaggtgccttttacaagtttctgtgcatcacagaagcatattataagcagtgggtttctagaagctgggaaccaatcccgttcttctgattttcctgattatctagctcacctcatgtagagctaggtacataatttttgttgtttgtttgagaacgattgttctggcctttcgcttatcctgagccaaacatttggatctttcatgtttggtataaagcgtactagaaactagagcagagagacttagcccctggtttttggtgttctcatttgaagattttggggcacaacaattggatttgtgtctctgttgaactgaatagtggtcatttggaaatgagttaaaacactacagtatatgttttagttgtctaattatagttgtatcaataagacattttctgcaagtgcagaaagactctttgactctgtagacaagaaggctcaggagatgagtttagggggcattaagtttgttattagcctaatgtgtaatagctgtaggagtgattccttcttgattttccctgcccaaacagggagcagtgtggaattcatcatggcagtggttaggtgtgttttgcttagcctatgattagcctgttggttacattggcttgccttgcatgaaaaaatgtctgtcaggtgactaccaataacaataagagctaacatttgaatagtataccttaaaaatacacattataccacttcagaagattatctgtgaaaacagatatttttattctaatcacataggtaaggaaaaaatcttagagaagttaaggtagccaacatcaaacagcttgtaaggagcagaggaagaacacccccaaattccattacaaattccttgcactttttgtcttaccattctcaaaggtagaggcattctagggaatctaaatatgaacaaagcatggaccttgctctgaaggatcttttaaacctaacaggcgcatagtcttatgaatctcttacagacaacaaatcgagagaagagctaaggaagtacgtaaaagggcaaaatggcctacaaatagagggtcaaggttggtatgacagaagtaggatttgagagaggtggatgttttggaaacaagaaagggagtgaccagaagaatgactatgggaaagcactgggtttgttgtagaggtggaattggcctagtttggctggagcatgagctgcatgaaagaaagtaaaataaaataatggcagctagaactcaaagatagattagggccagattgtgaagggccttgaatgccacatggaagaacattctgtaggtattttgggcaggagatgaaaaatgaccctacagaaggcccaaaaatgatgataaatggttaaatatgtttaagttaccaatctatgctaatcttttaagaaatgttatctcactgtaactatgaatagtgtactgtgtccattttgcagatgaaaaatgaaggctcagcaagattaaggaaactggaaatgtcaagagctgcagctaggacccagacttgggtctgttggattctaaatcctgttctgtgtctcactgtgattgatatattgtcacttcttttattaagaactgataaggtcttaatcctctgtcaagaatatggctgtagaaaaaggatgttttcaaagttgtgaagggactgcttctcaccatgttatgttaaggaatgtaatcactacccaacttgacttgtactgttctctgttttgagaccagagctagatgggaaattaaagaattggatgatgttttatttacatgcctgatgacatcaatacatgctcatagcaaatgcctttgttttcattttcagtatctaagcttattggccctaagtaaatcttaggttaggtagagctcagttcccaggggcattcaagattcataaagaagtgatatttttcccagctaaaatatttttcttcttaccaggttctctacttaaaagacaatgactactgatgaaggtgccaagaacaatgaagaaagccccacagccactgttgctgagcagggagaggatattacctccaaaaaagacaggggagtattaaaggtgaggccacaaagctgagtgacatacaaggaaacctgctgtctggaaagattatagcatctctttctgaggggggctggggtggataatgtttattgatggttactaagtgccaaacactagagctagattctcattttgtcttcataacttcaaggttttttttaagagttgagtctcgttatgttgcccaggctggtcttgagctcctgggttcaagtgatcttcccatctcagcttcctgagtagctgggattttctttttaaattaattaattaaatttttgagagagggcatctcattatgttgctcaggcaagtcttgaaatcctggcctcaagcaatcctcccacctcagccttctgagtagctgggattataggcacgagccactgtgcccagctagagattttaatttttaatcccagattatagatgttgaaattgagactgggctaggtaaattaacttgcctaatatcatatatcttagtaatgcagatttacctggggttcaggtccaagttatatctcactctaaagggctatatttccctattctcagagtatacaaataggttactattttaatgtatccttttagtacactaaagctagctaatgacaattttgaagactttttaaggaaagaaaagctaacttgaaaaattcaaaggggttttattttattttattttattttattttattttattttattttattttgagacagagtctccctctgttgcctgggctagagtgcagtggtatgatctcagctcactgcaacctccgcctcctggattcaagcaattctgcctcagcctcccgagtagctgggattacaggcgcctgctaccatgcctcgctaatttttgtagagacagggtttcaccatgttggccaggctggtcttgaactcctgacctcaggtgatccgcctgccttggcctcgcaaagtgttgggattacaggcatgagccaccgtgcccggcccaaaggggtttatttttatatataaatattgttcctgtgtacagtgaagatatcttttgcgatttcctcttagaatatatcttacttttgaattagctttcctacttattaaagcactatacagtcattcaccatataatgacatttcagtcagtgacagactgcaccttcagcagtggtcccataagattataatggggccgaaaagttcctatggcctagtggtgccatagctgttgtagcatgggtagtacagtgtattatgtgtttgtggtgatgtgggtgtaaacaaacctactgcactgcagtcacagttatgtatagtacataatacttgataataaatgtttatattactggtttatgtgtttactatactttctatcattattttagagtgtgcttcttattttttaaaaagttaactgtaaaacacccttggctgagtgcagtggctcatgcctgtaatcccagcaccctgggaggccaaagcaagaggatcacttgaggccaggagttcaagaccagcctgggcaacatagtaagacccctatctgtagaaaaaaaattaaaaaaattagccaggcatagtggcatgtacctgtagtttctactactcaggagactgaggcaggaggatcatgtaagcctgggagttccaagctgcagtgaactatgatcataccactgcattctagcctgggtgagagtgagatcctgtctcaaaaacaaatgaacaaacaaaaaacagccttgggcaggtccctcaggaggtattcaagaagaaggcattgttattataggagacagcagctccatgcatgttactgtcctgaagaccttccagtgggacaagatgtgttggtggaagacagtgatactgatgatcctgaccctctgtaggcctaggtttatgtatgtgtttgtgtcttagttttaaacaaaaaaaagtttaaaaagtaaaagaataaaaaatttaaaaaacagaaaaatgcttatagaataaggatataaagaaagaaaatatttttgtacagctgtacagtgtttgtgttctaagtgtcattacaagagtcaaagctaaaaaaaaagtttacacagtaaaaatgttatagtaagctaagattgatttattattaaagaaagaagaaaaattttaaaataaatgtagtctaggtgtccagtgtttataaagtctacggtagtgtatggtaatatcctaggccttcatgttcactcactgctcactcgctgactcatccagaacaacttccagtcctgcaagttccattcatggtaagtgttctgtataggtgtaccattttttttcttgtataccttttattactgtacctttttctatgttgagatatgcttagatacacaaataccactgttttacaattgcctgcagtattcagtgcagtaacacaatgtacaggtttgtagccttggagcagtaggccaaaccacctaacgtgggtgtgtacaagtaggccaggccatctaggtttgtgtaagtacactctgcgatgttcacataaggatgaaatcatctaagaacacatttctcagaacatatccctgtccttaagcgatgcatgactgtgtgtgtttcttcactctatagttaatcattttcacgtgcatttcttttgttttgtttcttacaacaatgtggtgagacaatcagagcatctcttgattcttccatcttataagtgaataaactgaatctgagaaaggttaagtggctttagtcacattaaatagttatttctcctacaccattgttaacacatgtaagttttgtatagttaagttttgtttttcctgaaaagattatctgatgcattctgaatattaccaggatgctgagttttaatatctcttgtgccagcagtagcaagtaagaatttttgttttgtgtaactttgcttatgtgaaagccttctgtgcctggatctcttctgaatatatgtgaattgctattatgtgctaagtcaaattttggggacttgcagctatagaataagggctttatgctatagatttacatcctattgtctttttttagaaggcttctcaaccttgtagctatagttactcatcctaaattccaggaagcttctagaaacagtggagactttgcaggctgtcctcagcatctccctgcctctgtttacgacttaccctttcatcttttcagagtgcccatgcccagagaacatgatccccaacttgcctcagaccctgttctgttctagggagtaaatctaattgcaagatttttaggcttattaagaaacatttgagatttgaagccctttaaattatatcatttatcattgtctagagcctcggatttcaccatgaggcttttggttaagatttaaataggtctagtaactgtgcaagctagggcaatttagttaacctctctgtgattaagttcctgtttgtaaaattagaataataatgccatcaacctcatagagttattaggattaggtgaagcacttagcatagtgcctgtcctatagtaatctatcttattaactattacgtatttttaaaaaaagaaccagtgctggtttggaaattcagtaactatctgaggaagataaaagatggatttatattttaaaaatgaatagaacctagattgtgttcttaaggcaactctagatttaggtacaaattcatcttgctagggaagcctgaagtgataccatagtaccacttgctggtgtggatggctctctgactctctggtagccattcatcccacatgcccagttactgtttatagtcctagaaatgcagattccttccacgtgaggcttacagttgagcatagcctcccaaataccacatgcagttcgtgaacatgagcacttgtagaatattgtgtaatatcttttagattaatgttttgagactttttttttcttttgaagtcctagaagggcagtagtgtttctttgcctttaaagaatatttggggctgggtgcgatagcttataccagtaatctcagcactttaggaggctgaggcgggagaatcattggaactcaggagttccaaaccagcctgggcaatgtagcaagatctcatctctactaaaaataaaaaaatttgccaggcgtggtggcatgtgcctgtagtctctgctactcgggaggctgaggtgggatgatcacttgagctgagtgatagaggctacagtgagctatgattgtaccaccgcatgcactctagcctgggtaaaagagcaagaccctgtctcaaaaaataaaataaagatgtttgggcttttgagttaagaaagctgtggaatttaagttcacagtgtttatgtgatatttatgttaggtggacggtatacttgtaaaaaaagaatttaggagcaaataatcgaattatttaaataaaactcaaagcaaactccttccccaaaaagatgttcatcagatgttagctaccatcctctgttatctaccaaaaatgattaatttggcatagattacaaattaacaaattacaccatcacacacctgggtttgattttcttttcccagaactgaccaaatacattagcagcttgctctgccaagaacaaaataaatacactggattttacagtagttaaatactttactagaaaacaagttattcagtatcatatcaagcagtgcaatgatactcatgttttttacagatagactatgtttcaaataataggaaatgtaacctgttttaccaggaaattgggctttctgaaaataaacaagcagaatctagtcaggagctaatgtttttagcaaaggagggaaataaaattacacctttgaagctttgcttaagcttctttttgaatattttaaaagtccaccattctttctggtctaagtccgtgtgtatatggactagctcacaagcctgtgttagagagtttagtgtcgggcgcggtggctcatgcttgtaatcccagcactttgggaggctgaggcgggtggatcacgaggtcaggagttcgagaccagcctggccaacatggtgaaaccccatctctactaaaaatacaaaaattagctgagcacggaggcgcacgcctgtaatcccagctactcgggaggctgaggcaggagaattgcttcaacctgggaggcagaggttgcagtgagccgagatcgtgccattgcactccagcctgggcgacagggcaagactccgtctcaaaaaaaaaaaaaaaaaaaaaaaagagtttactgtcaaaatatagggcattaaaccaatgaacaggatttattggttaattctttgaaggaataaatagtgcgattagcaataaaagtagatataacataaaagacaagttggtaaaggacagttttctaacaatgagttattgtgaggaatgaagggaggcattagaaagaatggataatagtatatttgcatatctgcctggatgtcttgggatggactgtgtgacctttttattctctgattacaagtaaaaagtttgacctcctttttcttaatgtttgtcttttctagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggtaagagggtatttttttgagttgtgttttacttagctttattactatttgtaatatataggagcagaggattctatcctttctaaaagtaaagaaattttagagtagtagtactcaaagaatggtctgagaatccctagggctccctgagatctttttagggggtcccaaatgtcatttattttcataacaatactaagatattatttgccattttactgtattgacatttatttgcactgatggtacaaaagctgcagttgtaaaaaaactgctggttccttaacacaaatcaaggcagtggtaaccagctgttccagtagtcatggtattttccactgccactccttcactatttacataagggaaaaagctagtttcacgtaaaaatgtcctgataaagcagtaaaaattattagttttattgaaacccaatctttgagtttcacatcactttgatattctgtgacagaaagggaagcacgtgtagagcacttctgtcccccaaagtatgatggttgtctcaaggaaaagtacttgtgctcttgttttagttgagatctgaactaactgcatttatttcatgagataccatttttacttgaaagggcaaatctgattatgcagacttgattcagtatttggcaggtgtttttctgagaatgaatggagtaagtctgtcatttcaaggaaaaacaactgacaatgttttttgccattaagttttcaagtaaaaattatagtttaggagaactcctatttgccactgtgggcttatttgccactgtgggcttgacagcttccgaagacttttctgatgagattggtgggtattaatgaatgtggttttaaatatacaatgaaatgtgtccacatttggaagatctgtataactaagaatgaatattttctcagtgaccaatgcaagatgttacaagatcatgtgtgaataaacaattcattcaaagttagaccaacagattttaatgtaacagtatgaaaagttcactgatacactttcagtttccacattgtaattgacttttatgaatcttacaagttgtacagttttgatgtagtatcagataattatattcacaattatctaaaaggttgttaaagggctcctacccttttcaactatctatctttgtgggtttggattttcttctctatgtacttcaaccaaaattgcaacagatgaatgcagaaataggagaatctggttgtctcgtgttacaagtcaaacacatttccacatgtataacattctaaaacaatgacactcgtctcactaattttttttttattttggaaaatacaaaatatacaaatactttgtacaaaattaaattacttatattaacatggggttattctaaaatgaattattaaataactacttttttactaaatctcagtagatatgtcaaataaacaagttctttggagtcctcaatttttaagatgttaaggggtcctgaggaaaaaaggttgagaactactattttcaagtattaagtatgatttttactaaattattttcaaatgccttttttttttgagacagggtctcgatctgtcacccgggccggctcactgtagcctcaacctctcaggctcaagtgatcctcccaactcagccccgcaaatagctgggaatacaggtgcgtgccaccatgtctggctcgctctgttgcccaggctggagtgtagtagcaccatctcggcccactgcagcctccacttccgaggttcaagcaagattatcatgcctaagccccccaagtagctgggactacaggcgtacaccaccacacctggctaatttttgtgttttttgtagagatggggctttgccatgttggccaggctagccatgaactcctcacctcaagtgatccgcccacctcagcccacccaaacacctgggattacaggcatgagccaccatgcccagcctaatttttttttttttttttttttgtagagacagggtttcaccatgttgcccaggctagtcttgaactcctgggctcaagcaatctgcccgcctcagcctcccaaagtgctaggattataggcatgagccaccacacctggcctcaaatgctgttaaatgtctttagttcatttaatgttcttattttttaatcttgtaggaataatagcccatacatcaaattaaactttgtagaacatgtggcttattggaagttggtggctgagttacatcttttattcttgtctgccacagacaagcaactgtagtttgttcctagattagggaaaaaagtattccccctattcaccaccatggctatgtgtggacttcattcccttgtccttcagctctgtatctagttgaattgctaactaagcatggatctggaaaggaaatatagtaagcagaaactgaggagttactttctgtctcttgccactcagccttccctgcttcctgtatcatttgtgtgcctggtgaattctgcttcccgtccagctgtgctctttccaagctccagttctggccacgcccctgctctcttctcctttgggtctttagtaggttaatggctcatgagatattaattttttgtttgaataagatagcagtaaaaatcaaatacagtcttgtggcagataattatgacagttattttagaattttgttgttgttgttgttgttgatttaggcatatgaacctccagggctgccagaatgggtgtggcatcattatttaggtgacctaagagtgactgaccttgtcagacccccttgttcctgccacctgctaaatccttactctatccttagaattcctgtcttaaagaagctgagagttaagataacaggtccttttagcagttatcttggtgagcagaattaagaattgttgagaatttatattggtatcttctctactgagattttctcagtaaaacactatggtgaatgagtttcctggaattttaagcagagtaagaagattttctgagttatttttttaaaatacaagttgggagaaaaaaagaggcaactttcagttgactttgtacctctgacacacctgtctagagtcagtgcggtctcatggaaaaagcttccagccgggcattaggaagccagggttcctgtcttccctgttccttgtggtgtgttaacatgagtaagccacttaatcttacctgcttctgtaaaaagaagtctgtggagagcttatgtgattccattcttgttccttctgtaaagaatgcgggaacaaaaaccataaaagactaataccaacacaaagagacccttagaggcctccttaagatggtaattggaaatactaggatagagcaatatacctctggtaaaacatctataacataacgtatttagttgcctacaaaacaagaaacattggttaggcagtttatagttttgtggggttttttttttcctttttttttttttttttgagatggaatctcactctgtagcccaagctgaagtgcagtggcgtgatcttggctcactgcaacgtctgcctctggggctcaagtgattctcgtgcctcagcctccccagtatctgggacttcaggcgcgccccaccacgcttggctaattttttgtgttttagtagagacagggtttcaccatgttgcccagggtggtctcgaacttttgagctcaggtgatccgcctgccttatcctcccaaagtgctgggattacaggcatgagccactgtgcccagactatagttttatacttatattttatagcattaggtagtttatcaaaatgaagaaaataatataaatggacagtagtataaatattattcattgaactccattgatcccttatattgtacctctcccaagggaataaatagaaatatttcaatggaaagtcatcctaatttggggattctagtatgacttcagtatttaacatagaactataagagcctatctgtaaaaatcccattgaaaagataaacatatcataaaatacacaaattcaagctatacctacacttgctttgtatatgtcttttgctttgtgtatgtctgttgcttttatcataccatctttttctcttttctttttttttttttctttctgagacggagttttactcttgttgcccaagctggagtgcaatggcatgatctcagctcactgtgacctccacctcccaggttcaagcaattctcctgcctcagcctcccaagtagctgggattacaggcatgcgccaccacacctggctaattttgtatttttagtagagacggactttcaccatgttggccaggctggttttgaactcctgacctcaggtgatccacccgttttggcctcccaacgtgctgggattacaggcatgagctaccgcgcctggctagccgtaccatcttttaaactctattctttactttcttcatctaaggttatgataatcatatatactacatatattatatatgattatataagtatatattattatgttgaggattaagataatgtacaccatcgcctagcattcagcctaacaaatggtaagcactcagatgttgattattattgtggcagtgttaggatttttcactggttttataatggaatggtaaaagctgtgttataacatcttgggtcctgacttcatctgttgactatgcatgcgtacaaaccttggaaacaatgctcagccatcttgcttagccccaggaagttgggaaagacagaatcaatctaagggaactgattattactactgtggaatatgttacagaaattagagtgaagaggtgatgatttctcttactaggttttcttaactaaatattagaggttgtgaattattagaactggtcatagcccatttaaaaagaagctgaattaagaacaaggattttcatacatacttctataataggggttctgttcttttaccctactccccccagcaaatatattttcactaaaatggaagagggcaatagatttggaggatgaaagaattatttctaccctttttttttttttttttttttgagacagagtcttgctgtgtcgcccaggctggagtgcagtggcgtgatctccgctcattgcaacctccgcctcccggattcaagcgattctcttgcctcagcctcctgagtagctgggactacaggtgcatactaccatgcctggctaatttttgtatttttagtagagatggggtttcaccatgttggccaggatggtcttgatctcctgacctcgtgatccacccacctcggcctcccaaagtgctgagattacaggcgtgagccaccacacccagcctcaatcttactattttttggattctttgtacaattagtataatttaggtgacaatcatattaatatttgtgtcgaagccactttggtttttttattgaggtattatttacgtataataaagtttacccttttaagtatatagtttgatgaattttgataatatttctgtaactaccaccacaatcaaaatataaaacaatttctttaccctaaaaagtatttttatgtccttttgcagtcactttccttcctggaccctgagccccaggcagtcactaacttggtttctgttactataattttgccttttgtagaatttcatataaacagaatcttgtattatctttggtgttgacttctttcacttaacataatgactttgggattcatgcatgttgaattcctgagaagtattccacaatttgggaatgccacagtttgttcacccattcaaaaataggacatttggttgtttgcaatttggggctattcagtttttcatatccttattaacacgtagtattgtcgatctttttaactttagccattctagtaagtatgaagtagtatctcaccttggtttttgtttgcatttccctgatgactagtgatgattgagggtctctcttcttgtgcctagtgggcatttgtatgttttcttttgtaaagtgtctgttcagatcttctgcccattttaaaacatcagttgtttgtcttactgagttgtacttaaaaggacaagcactttggcaaatatgatctcccagtctatcttgcctttttattttcttaattggtcttcggaaaagtaaaagtttttacttctgattaagtcagctttatcagttttttcttttatggtttggttacctactgttattaaccatttttggtttgatgtgattttttgtttactatattacagactaaggtacagagaagctcggtaaattgcccaaggctatacagtaagtggcagagccaggattcaaatccaggtagtctttcttaagttatgttagatcttaaggtttaaaacatagcccaaaccaggtacagaaatgaagtaggtcctggttagcagtatttatcgagtgcctgatatacagtagaaatttctctttttttttgagacggagtctcgctctcactcaggctggagtgcagtggcacgatctcggctcactgcaacctctgcctcccgggttcaagtgattctcctgcctcagcctcctgagtagctgggattacaggcatgcaccaccatgcctggctaatttttatatttttagtagagacggggtttcaccatgttggcgaggatggtctcaatctccagacctcgtgatccgcctgccttggcccccaaagtgctggtattacaggggtgagccactgcacccagccacagtagacatttcttaccagtaatgatatgtcatagtaaggtttatcaaaagcactggcgcttgtgttcgctcgctctctctctctctctctctctttcttcctcctcctccctctttctctctctctttctctccagagacttgctctgttattggggctggaatgcaatggcaccatcataactcactacagcattgaactcctaggcttcagtgatcctcctgcctcagcctcccagagtgctgggattacaagcatgagtcactgcactcagccaatatattcttagtatctgtttacttttttttacatgcagtttaggagcattcaggagatttttaaggaaagcttttaggctaaaatatttaatttttttaattgtccccaaaagtgtgagccagaaagacagcaaactttaagaaagtacttactttggtttttcctggtactttgcgatagaggaggaatgcttccaatttccactgctgagtggatatcagggaggagctgatttaggctgtggaaagctgagcaaatttctcactccatttaaattcgatattacatcatgcctttgttctctttttgagtacagtgttgtggtgctatagttctttgcaaagagtaattaaaacatgacccctaccttcaagtatgtaacaatttagtctggcagagttgatccttaaggctgtcccaggacagataatgctaccatatctgttttctttccctgtttgtttgtttgtttgttttaattataagccatgaaggtggggagggattatcctgtgattagttctcttagtagttagagaaatgacaaaaatacaatgtaacataagatatgaacactttaaaagagtcttaaacataaattactgtaatctcagcagtttgggaggccaaggcaggaggatcagttgaacccaagggttcaagaccagcctggacaacatggtgaaaccccatctctacaaaaaatacaaaaattagccaggcgtggtggtgcacgcctatagtcccagctttctcaggaggctgagatgggaggatcactggagcccaggaggtccaggctgcagtgagctatgatcacatgccttcactccagcctgggtgacagagcgagacactgactcaaaacaaaatacataaattaatttgtttaattcatgattagttactattggtagggagtagggatgattattagagcccttttatagctattttaaaataaaactaggccaggcgtggtggctcatgcctgtaatcccggcactttgggaggccgaggcgggcagatcacctgagtttagaagttcaagaccagcctggccaacatagtgaaaccctgtctctactacaaatacaaaaattagctggtgtggtggcacatgcctataatcccagctactggggaggctgaggcaggagaatcacttgagcctgggagtggaggttgcagtaagccgagattgtgccattgcactccagcctgggcgacagagcaagattccatctcaaaaaaacaaaaacaaaaaaacctaaaatatatgaggaaaaggtatacaggaaaaataatttgctttatttagtataaaaagaagaaaggatttctgtattatctgttatatgaggtttttcttatttttaacataaaaattagcagaatatgcaagtagttaaaatagagatcagaaattggtactgagtcctaggaatccctcaaggaaggtgaagcaggaatgaatcagatgcatttttattacctgaagcttattagtgattaaccttgtttgtcagcttttatattttgaaaggaaatcttttacagttaaaatatttacctttcttgttcttttctactcccatatgaaaaagtaattttttttctgtatgatatggtgtagctttcatcctatagtgtgttcaagatgctcatattcaaatgtaaatgtacatttaaaaggtagtgatttttcaacaagggtgccaagaccattcagtgggagaaagaacagtcttttcaacaaatggtgttggaaaagctagatatccacatgtaaaagaatgaaattgggtccttatcttacaccatctgcaaaaattaactcaaaatggatcaaagacctaaatgcaagatctaaaccttgcattagaaaccttcccataagaatatggaggaaggccgggcacagtggctcacacctgtaatgccagcactttgggaggccgaggcgggcggatcacctgaggttaggaattcaagaccagccctgaccaatatggtgaaaccccgtctctactaaaaaaaaaaaaaaaaaaaaaaattagctgggcatggtggcgcatgcctataatcccagctacttgggaggtggaggcaggagaatcgcttgaacccgggaggcagaagttgcagtgagccaagatcacaccattgcactccagcctaggcaacaagaacgaaactatgtctcaaaaaaaagaaaaaagaaaagataaagaatatggaggaaaggcttcatgacattggattttgcagtggtttcttggcatgacatcaaaagtacaggcaacaaaagtaaaacaattaaacataaattactgtacatcataaattaaacataaattagaatacatcaaaattaaaaacttttgtgcatcaaacagtaacagaatgaaaggcagcctatggaatgggagaaaaatgtttgcaaatcttatatctgataagggattaatacccagaatacacaaacaactcctataactcaacaaaaacaacaaaatagcccaatttaaaaatgggtaaaggaccagttgcagtggccatacctgtaatcccagcattttgggagacctaggtgggagggtcacttagacgccaggagttcaagaccagtctgggcaacatagcgataccctgtctctaaaaactttttaaaaactgggcaaagggcttgaaatttctccaaagaagatataaaaatggacaacaagcatatgaaaagatgttcaacatcactaatcattagggaaatgcaagtcaaaaccacagtgaagtattaccctcataccggttagaatgggtactgttaaaaaaagagaaaacaacaagtgttgatgaggatgtagagaaattggaacccttatgcgctgttggtgggaatgtaaaatagtgcagctgctgtggaaaacggtatggaagttcctcaaaaaattaaaaatagagttaccatgttgatctagcagttctacttgtgggcatataaccaacagaattgaaagcagggtcttgaagagatatttgtacactcatgtttgtagcagcattattaacagcaaccaaaaggtggaagcaactcaagtgtccttcaatagatgaatagataaacaaaatgtgatataaacgtacagtggaatatttacgttttaaagaaaaattctggcagatgctacaacatggacgaaccttgagggcattatactaagtgaagtaatccagtgacaaaaagaaaagtactgtctgattccacttatatgagttatctatccagagtagtcaaattcataaaaacaaagtagaatagaagttgccaaagattagggaaggaggaaatgcttaatgggtataaaattttagttttgcaagatgaaaaagttctggagattggttgcacaacaatgtgaatatacttaaaaatagtgaactgtgcactttaaaatagctaagatggtaaatgcttttttttatccccccacaattaagcgttttttttaaaactcaaggagaaaacattatgtagtcagaatgttctgaagtggtcactatagtctttactataaatgaaactgttaagtgattaaaatgttgtatcttaaaatatgttatataatttttttaaaccagaaaaaagtgtaacattacagaaggaagaaaaagtataatgcattgcttttatactgggctttgtatgcttttaaactttttcacctgcctatagttacatacgtataaaaagcatttaaatttagtaatagctatattatacatttgtatacatatatattcttgttttatattttattacaaatggaataagactcctgaaattgataaattgtgtataagctagtaaaactgaagtccagatcaagtgtaagaataaattgacgtggccaggcacggtggctcacgcctgtaatcccagcactttgggaggctgaggcaggcggatcacgaggtcaggagatcgagaccatcctggctaacacgatgaaactccatctctactaaaaatacaaaaaattagccaggagtggtggctagcgcctgtagtcccagctactcgggaggctgaggcaggagaatggcgtgaacccgggaggcggagcttgcggtgagcagagatagcgccactgcaccccagcctgggcgacagagcgagactccatctcaaaaataaataaataaataaataaataaattgacattatgtattcttggtgtgtttttttttgagacggagtcttgctctgtcgcccaggctggagtgcagtggcgcaatctcggctcactgaaagctccgcctcccgggttcacgccattctcctgcctcagcctcccgagtagctgggactacaggcactcaccaccacgcccggctaattttttgtatttttagtagagacgggatttcaccgtgttagccaggatggtctcaatcctctgacctcgtgatctgcccacctcatcctcccaaagtgctgagattacaggcgtgagccactgcaccggcctattcttggtgtatgttacctatgactgagatcctgaagatgaagaatctttaaaatgtttatgctttgggggttgggcatggtgactcacacctgtaatcccagcacttcgggaggccgaggtgggcagaccacttgaggtcaggagtttgagaccagcctgaccaacgtggtgaaaccctgtctctaccaaaaaatacaaaaattacctaagcgtagtggcacgtgcctgtaatcccagctacttgggagtctgaggcacgagaattgcttgaacccaggaggcagaggttgcaatgagccaagatcgtgccactgcactccagcctgggcaacaaagtgagaccgtgtctcaaaaagaagaaaatatttatgtttttggtccagtaattctacatctaggaatttaacctaaggaaatgtgtagaagcttgcttaaccctctccagactaattgatgctctccattctgtttgcatatatactgagtgatacaactggtttcttgttctgtggtgtggtctcacacattgctcccgtcagtgagtgggccttgtcagtgccctgcagccacagaccactaggaacacacctatagttgaacacgttggttcattacttgtgagggaggatgcacaccatgcgaactgtggagtatctcagtaagagtgttaggaggaatattttataggacttgtgcttgtattaggtgattttggggagtttaagaaagcagagctttctcgattggatgctgttaggatgtggggtgattgatgtttgggtatcttaataaatcttattaggacgtgggccaactagagtagagtgagaccaaagctagaactggtagagaagcagcagtcactcatattagccaggagagggggatgtttggtattttgtgaaaatgctcagtgaccttgtttttttcctctgggcttagacaaaaaaaaatttttttttcttttttgaaatggagctggggtgcagtggcgtgatctcagctcactgcaacctccagctcccaggttcaagcaattcttctgcctcagcctcccaagtagctgggattacaggcgtgagccaccgtgcccggccagacaaaattttgaagtatttttgttttgtctcacttgaacacagtctcagagtgaccttgtctcatgttgatattttgcgagattgtttatgtcccacaggagaataatatggcctccctatgatccctaggccagcttcaaacagcactgaggtccagctgtaagtgttcaagcagtttccagacgttggggaggctttttctttctcaaactcttgttaagaatcagttgaagccaggtgcctgtagtctcagccactcagaagctgaggtgggaggatcacttgagccaggagtttgagtccagcctgagcaacatagcaagaccctgtctcttaaaaaggaaaaaaactgggctgatgcaatggctcacacctgtaatcccagcactctggaaagctgaagcagaagtatcacttgaggctaggagttcaagaccgacctgggcaatgtagcaagactccatatctacagaaaatcatggtggtattcacctgtagtcctagctactagggaggcagaggcaggagattctcttgagcccaggagctcaagaccagcctgggcaacatggtgagactgtctacaaaaaaaaaaaaaagaagaagaaaagaaaattagcccaatgtggtggtacatgtctgtggtcccagctacttgggaggctaaggtgggaggaccgcttgagcctgggaggttgaggctgcagtaagctatactcacatcattgcactccagtctgtgtgacagagcaagaccctgtctcttaaaaaaaaaaaaagtgatgtagccatttcgtaaagacagttgggcaataactatcaaatttaaaatgcatatcacctttgcacttccaggaatttacattccaaatatacttatgcaaagtaggcaaacatacatggacaagtagtctcattagattactgttggtaatatatgcatcaatagaagattgtagtattatacacccattaagaatgaggtaggtctatttgcatttattatgatgatgatgtctttcctttatcaaatacatattatgtgccgggcaccgtgccatgcatttgatgtgttttatctaataactctttatttatttatttatttttgagacggagtctcgctctttcgcccaggctggagtgcagtggcgctatctcggctcaccgaaagctcctccttctgggttcacgccattctcctgcctcagcctcccgagtagctgggactacaggcgctagccaccacgcctggctaattttttgtatttttagtggagatggggtttcaccgtgtgagccaggatggtttcgatctcctgactttgtgatccgcccgcctcagcctcccaaagtgctgggattacaggcgtgagccaccacgcccggccttatctaataattcttaaaacaactattaatatatggcaagtactgttattatttacattttgcaggtgaggagactaagcacagagattaaataacttgcacaagtttacacagatagtaaagggcaaacttggtattcaaatccaggtattctgaagttagagtatgctgcatttttgacctctaaaatgtacatcctcctttctactgatggagaaagaggatgaagatatataataaatgaaaaagtagtttagaactgaatgtctagtttgctgtcatttgtattttaaatttttttaaaaagtgacagcacacagtaggataccaaagaaacgtaacagttacttataaggagcagatggatggcctttcagctttcactttccatctctttcatgggtgttttaataataggcatgtattacttgatttttttttttttttaagagacagggtctcgctctgtcacctagtctggagtgcagtgacataatcattgctcactgtagcctcttactcctaggctcaagctcttctcctgtcttaacctccaaagtagctggagctacaagcatatgccaccatgccgcactaattttttaaatttttgtagagatggagtttcactatgttgccctggccggtcttaaaactcttgggctcaagtggatgctcctgctttggccttccaaaatgctgagatgagaggtatgagccactattcctggccacttacatatatttttaactgaaataaatgtagctgacattttgaaaagttgtaatatttaatgaagattaagctaaagtcatgaataaaaaatggtttatctatccctgcttacatactgttatgtagggtttcccttgtcctaatatcctaccaccagctcacttcaaattcacttcctctggggttcatctcttatctgatcctacttttgaatacttacatttttgtttttgttttttgagacaggacagggtctccactctgctgcccaggctggagtgcagtggcatgatctcagctcactgcagccttgacctcctggactcaagtagtcctctctcctcagcctgctgagtagctggcaagcaccaccacgcctggctcattttttaaatatatttttttgtggagatggggtttcaccatgttgcctgggctggtctcaaactcctaagctcaagggatctgcccgccttggcctcccaaagtgctgggattacagctgggattacaggcgcgagccaacgtgcccagcccccagatacttaatatttctgattgacagagtacctcatttgtcatttagcctttttttttttttttttggagacagagtcttgctgtgtcgcccaggctggagtgcagtggcatgatctctactcactgcaacctccgcctcccaggttcaagcaattctcctgcctcagcctcctaagtagctgggattacaggcacgcactaccatgcctggctaatttttgtatttttagtagagacggggtttcaccatgttggccaggcttgaattcctggcctcaagtgatccgcctgtcttggcctcccaaagttctgggattacaggcgtgagccaccatgccccaccaaaatgtaatttagccttttaaatggcctaaattttctattgtttccgaaaggacttgatactgcttacagtaagataatgatgcacatcataggaactataaacattgagattacaattatatagcctaatatagttctacaattgagcagtaaatttaacttagtttcctggaagtaggcaaaaaataaaatattttaagttctgtagttgtggtttgacaaaaagacacatatgtttttgtttaaaggaacatttttctgattctaaattttgagaagaaatgtgtttcatggacccttttatgcaatttatcctgttctggttacttcttgttttgttgttttttttgtctacccaactaaattataagcttccttaggacacactctatttttcaatactatttttgttctatctctgcctagaaaatttgcgcttattatagttgaaatgataaattaggcaacaattgcaacatagccatatttcatggataatgttaccaccagttttcaaagacttaatttttgagtagtttaggaatttatattactttcatccctttcagcagggaatcctttttgagacagggtctcactctgtcacccaggctagagtgcagtggcataatcatgactcactgaagcctcaatctcctgggctcccaggcttaagctgtcctcccaccacagcctccggagtagctgggactacaggtgtgcaccatacccagctgtgttctttggttctttggggtgttttttttttttttttagagatgaggtcttgctgtgttgcccaggctggtgtcaaattcctggactcaagcagtcctcccacctcagcctcccaaagtgctgggccgatcaacagggaatcttttgtgatagccttcaaaaaaaataatttatttatttgtatgtagcactctgtcatcttgtagcccatactttctagctgagtatgtagtatgaaaaactggaaattagaactttggttttatgaaagttaaatctttttaaatagggcttatagctttcaactaccttttcctttcccttaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgaggcaagtatgtgtgtgatgttgccttgtcagcatctgctctacaataggaatggctttgaagcaacaggcagtgggaaaaggagctaagcttgctatagagaatcagatccaacttacttattttggagcatggcttcttgaattgtttcccacaaacccaagggtgcgcgtgccagtgctttcttagaaacgtgtttctagcacaaaaaggtcatatccaaataaacaaaagacgctacacttagaaataaagattctggtccatggtgtgagtgtgacatactcaaaattgaccagagtacaggatggaaatgttggcgataaatgttgaaatatgcctatgtcacgttgcggggtatttacatattataaaaatttatgtgtcacagatctcacttctctagaagccgttggtggtgataaaacattattcatcctatgttgaattacatatatttggcaaaacttgatttttaagaaccaccccagctaggtaaaatacacctttaatcagtcgtaggtcacatccatgagatttattcttacattttgagaagggaactccataaacccaggatgggaaagttgtggcctcaaacaaaatagttctacaccagcaccttgtagctctggctttttgcccacagggtagttttcctagtatttcctatctttgcactgcagtcccttaggatatagttctagacattagcattacatgaaattctttccaagtatggaaaagtatagtgggtttttttttttttgctacttttccaataattaagatgcataaatgaatgtatatattttaaaacagctttattttgtaaaatgaaataattggttgcccttgccttcacatatgttcagttggctttatttggtcttttctcagctgaattccttttttctttctagattgagctccttgatttcaaaggagaggatttatttgaagatggaggcattatccggagaaccaaacggaaaggagagggatattcaaatccaaacgaaggagcaacagtagaaagtaagtattaaagtaagagggaactagtccttaaaagttgggccatttatgtggacgaaatggagacttaaaaaaaaatgtttgtagaaatgaatatatcggctgtgcgcagtgactcacgcctgtaatcccagcactttgggaggtcgaggcgggtggattgcctgagctcaggagtttgagaccagcctggccagcatggcgaaaccccatctctactaaaaatacaaaaaactagccaggtgtggtggtgcacgcctgtattcccagctactcgggaggctgaggcatgagaatcacttgaacccgggaggcaggggttgcagtgagtcgagatggtgctactgcactccagcctggatgacaaagcaagactctgtctcaaaaaaaaagtattgaatatatctcaaagatagtcttagctgggcacagtggctcatgcctgtaattccagcactttgggaggccgaggcaggaggatctcttgagcttaggaattcgagaccagccaggacagcatagtgaggccccatctctactaaaaagcatcaagagaattagtcaagtgtggtgtcacgtccctgtagtcccagctacttgggaggctgaggtggaagaatcacttgagctctggagatgaatgctacagcagagagccgtgattgtgccattgtgcttcagcctggacaacagcaagattctgtccaaaaaaaaaatagtttcaggttcaacatttatttaataattttatttagtaaatattaattcaacatctacgtgtcaggcatgctaccagcctctacaaactcaaaaatgaatacaaagtaattccatccacaagaaattctcaatctgtggactctctggtgtgccaacaactatattagttgcctgatatgtttgttcatttatttctcacaaccttaagaggtaaaatttcttgtccccagatgagaaaagttaattcagagatgttaaataaattgcccagggttacagagttactaaacagagcagtagattataatcccttttaggactcaaatacatctcatcagctgtcatcaagattaaaaaatagttcatcatttagatcaatattggataataatgttcattctattccatatcaggagacctaggttcaagtcctgctttggtgtttattgagtaacctgaagctattccgtttcttcatttgctaagtgggagtaggggcagctctgaggactgagatagctaactcttcttccctcccagagcaaattatatgtaccactgtgtatactacttgtcactttacattgtaatcagtatttgcccatttctcccagtatactttgagtgcttgaggaccagaatctttcttcatccttttgtgttcagcatttcctgcagtgcgtgacacacatttggtgttcagtaaaggctttctgcatggataagtgcttgagaagtgtcattagtgagctgaaatccttcaaaagagagttgtgagaaaacagagaaatacttccattaagaacaaaaatcaaatcattcaacaaggatgggaacatgaactattattataaaaggtctgtttaaaataattatttcaaaagccaggtgtaatggtgtgcacctgtagtcccagctacttgggaggctgagataggaggatcactagaggccaggagttcgaggctatagcgtgctatggttacaccagtgaatagccagtgcactctagcctaggtaccatagtgagaccttgtctccttaaaaaaaaaaagtaaagagttcatttaaacagaaaacaagaatagctgagtttctttcttttaaagtatatactattttcaacccatatttcatttctacgagtctggcaaatcagtttaaattctgttgttttgggaagcagttacaaatattatttatcccaaattgccatttgggataagtttttgaatacatgaagagctttaaatgtagaataccagggaaatagctccagactaggagttgggagatagggttccagcctcagccctggcctcaggctggcttcaactagacttcacctctgggcgttagcttccttcctatgcagtgaggcaagcttgaacctcttgatttttaaggtcctactagccctaaaactccatcatagaattctaaatatttacaaaagttgtaggaatgatagaaaatcatcttcactatattagtaagcacttaagcttgtctataatgtgtattttaaatttttcttatgaaaaatttcaaatgtatgtacaaaggtagaggtttactcctatggatacaggcacaccctagattcagtaatttataatatatatttttaaactggagggttttgtcaactaagaggaaaaacttttcccaattatagacaatatcacaaaattaccgctgtggagatgactttagagcagactaaattaaatcagatcttgcttttggtaatacttgcgatgggagtcaatttttttttaactttttgttttgaaataattttagaattacagaaaagttgcaaaactagtatagcgcgttcccttatatgctttacacagcttcctctaaatgttaacatcttacctaatcacagtacatttatcaaaatcaggaagttaacattgatgtagtaccagtaactgttttccagatcttatttgaatttcaccagttactacactactgtcgttttctggtctaagatcaaactcaggatccagcattgtatttactttttttttttttttttttttttttgagatggagtcttgctctgtcatccaggctagagtgcagtgatgctatcgcagctcactgcaacctccacctcctgggttcaagcaattctcctgtctcagcctcccaagtagctgggactataggcgcacgccaccatgcccgactaatttttgtatttttattagagacagggtttctaacatgttggtcaggctggtcctcaagctcctgaccttgggtgatacacccgcctcagcctcccaaaatgctgggattacaggcatgagccaccgcacccagcctactctactattttgaatacaactgaccgttttgtagaatatccctcaatttgggtttctgggatgtttttagattgaggttatgcattttttgaaaataccactgaagtgatgtgcctttcatcattatcaagaggtatatgatattgatgtctcattactggtgatgttaccttcgaacactgggttaaggtgggaaaccatgtttcactactgcaacgttactattttccctttgtaattaaaaagtattaggagtgaagtactatcttgttttgtatcacaactttacacactcattttgacatttgttgatttttgcttgcaacagttattactgtggcatttgactaatggtaaattttctattgctgttattctctctacattaatttgaatcctactgtatatttattcagtttatttatatcattatggatctgtgtatatttattccataagttattattcattactattcttatttattttgttgttcacattgtcccagatttgaccattggaaactcctttaagtttgtttttgtgtcctttcaatattatccccattttttttaagtgcttccttattttctggtaccacaagacactcatggctcatcttaaaattttcctgccctagacctggaaccaaccatttctccaaagagccctgattccttttattggagaaaggcatttagaaaccaagatctgagtgctaggtttgctcctgctatgggatatcatcattcctagacccacttagcagacagagagatagagaatatatggacctcaacatacatacgtatacatctatatgtatttctacatcagcctctgtgtgtgtgtgtgtgtgtgtgtgtgtgtgtgtagttgttgttgttgttgttgttgttgttgtttgcgacagagtctcactctgtcgcccaggctggagtacagtggtgcaatctcagctcgctgcaacttccgcctcccaggttcaagtggttctcctgtctcagtctccggagtagctgggatttacaggtgcctgccaccacgcccagctattttttgtattttcagtagagatgggatttcaccatgttggccaggctggtctcgaactcctgacctcgtgatctgcctgccttggcctcccaaagtgctggaattacaggaatgagccaccgtgcccggccagcctgtatgtatatgttaaaaaccagggatactcactggcagttgcagttccagttccaatccaacaccacaagtttatttgccctttgctcatttgaaactccattctccagaagtgagaaaatgctctcattctccacagcatactcattgctcccatcctagtgtatatgtaagatggttttagaattgctaacctagacccctgtgacaaactgactttaggaaatatttgtttatagtaccttttgtcatcagtcttatagtgtatattcaaaacacttgctttccaactgaggtaacttctttcttcctcacccccttcaatgtgattatgttactcaattgtaacaaattattcatttgttaccctgtatattccattttgggttcctgccatgctctggttaattttaattattcgttttattttggatatgtgaaacattaccatgattttaaactatataaaaaacgatatactcaaaagtgtcatttccccctcatccttattaacctgttcccacttccccattatttccaccctattccagtctcattagttatatcattagatcctggtttttcttcctgtattttattacgttttatgtcattttatttttttctgtttctgttaacaaagggagccagtcgtggtggctcacacctgtaatcccagcactttgggaggctgaggcaggaggatggcttgacctcaggaatttgagaccatcctgagcaacatagagaccttgtctctgcaaaaagtttaacatttagccacatgtgatggcacatgcctctagtcccagctacccagaagactgaggtaggaggatctcttgagcccaggagttcaaggctgcagagagttgtgatcatgccactgtactccagcctgggcaacagaacaaggctctgtctcagtttgaaaaaaagagagaaagaacaaaagaaagggcaatgactaatcttttgtctttcatcttgttagaatgtactttcctgggaaattttagattaaatggttgattttactttttcactcaaaagaccgtcttggttttctggaacaaatctatttcatagaaatttattgtgttatactttcatttatcaaggttaaaatgtcctggtttttcctcctttaaacaagttagctatctgggggaggagaaaaaagattaccctaaaggtggtcctgttcaaaaccaagatcaccttgttctttttgaaatcttctcagtctttactggtttgccttttctttatagcatcaccaaatacacttagatgtgaaaccagatataaaacctggaactaggccaggtgcggtggctcacgcctgtaatcccagcactttgggaggccgaggtgggcagatcacgtgaggtcaggaatttgagaccagtctggccaacatggcaaaaccccatctctactaaaaatacaaacaattagctgggagtggttgtgggcacctgtaatcccagctacttgggagggtgaggcaggagaattgcttgatcctgggaggtggaggttgcagtgagcagagattacgccactacactccagcctgggtgacagagggaaactccgtctcaaaaaaataaataaataaaataaataaaacctggaactaaagccggctatagagtgaacaagaacaatagacactgatcacccattacaatatgttgttatagatacgtgatttactaaatttctgtcatttctgtgtaaagagacaatgaagtggtatggaggaggggacagatagactttgtaagtgatggacttgatttttgaatcttggaattgctacctgatacttttatgactttagacaagttacttaactacgtggagcattcagtttttttaatctgtcaaatgggaatagttttcactcccacaggttgtgtgacagtgataacggtttggctgtgtgcctacccaaatctcgtcttgaattgtagttcccacaatccccacgtgtcgtgggaaggacccactgggaggtaactgaatcgggggggcattttctcccatgctgttctcatgatagagtgagttgtcacgagatctgatggttttataagggtctggcagggaaaccctgctggctcttccctcttctgccgccatgtgaagaagggtgtgtttgcttccccttctgccatgattgtaagtttcctgaggcttccccagccatgtgaaactgtaagtcaattaaacctcttttctttataaattacccagtctcaggcagttcttcatggcagcgtgagaatggactaatacaaacagttacaaagaagagtgtcagacatttagtggacacttaatttcttctaccctatatattgtgtttcactaatttgttttgcttccttttaattgatctaaggaaaaagatccttgactcctctttttctttttctgttgcccaagctggagtgcagtgggccaggctggagtgcaatggcgcatcttagctcactgcaactgctgccttccgggttcaggtgattctcccacctcatcctcccaagtagctaggactacaggcacgtgccaccacacccagctaatttttgtatttttagcaaagacggggtttcgtcatgttagccagactggtcttgaactcctgacctcaggtgatccacctaccttggcctccctaagtgctgggattacaggcgtgagccactgtgcctggctgactcctctttttcttatctcctacatgtcatccatcagcaaatcctcttggctctacctaccatggttattagagacctaaaattgtctctaataacagtcttcaaattaatgatatatcttaatagtaatcttatctaaatcacatttctcaaggttccggggaaagaataacattatggactcaaaaaggtttttactgaattgtaaacttttacttccttttcataatttgtctctgtgtggaagagaaaacttaggttagtttgatgggatttattctttctcaaggaaattttgatttttactctttatatgaggatcctaatggttacaaatcagtttttagaatctgtccccctacgctttttcttgtgtcagttaagatgaccatcttgtaatttttattcaaagtttttctttcatttaaaaagttactgtgttctaaggtactctaattgatatgattatgatgactgatacttcagtctttaagtttaattgcaggtcttggctacattgctacttttcagctttgctttcttagaaaatcaaatctgacttacataaggttctaaatagctaccagttactcttcccccatcccccagtctctcacatcgtctgatttgtcaactttagtggttggaagaggcccatcaaaatgctggctgtatgtggttctctcgcctctcagtactttcagccacatttgaatgcaaagaatgcagacagtcagcagtatttttaaatgtgaaattttcaacagagtgttctacaggttccagttgttggcgtacctcctttccctctccaaatctcactgaaatgatagatggagggaacaaagattttcaaaagaagaagaagagatcaataatagtgctggaaaggagaggaatgtaagagtggatcagaaattatggagaatttctggaatatgtaaagttgatgaagttgaaccaatggaaactagtctcagcaaatccaacccgagacaggtgtaaagaggacttaagcagaggtacacactgttcttctcaacaggcttaggcggaactccaagctcatggtcatctggtgtgagggagcccaagcaggctatgcagcaatcatcagggttgttataaaacaagatggaacagcggggccagtaaacctccagtgcagtagttctcaacttttcctgaatttagaattacctagggagcttttaaaaattctgacacccagaccagttaaataagaatctcacatctcagaagatggaactccaggcacaagtatttttttttaaactcccagattattctagtttgcaggcaaggactgaaaactactagactacggtctgactgtgactttttctcccaagctaaaaccagtaaggccaggttctaaaataaaatagaaaaataataaaataaatttaaaaataaataataaaacaaaatgtgcctcaaaagactccaagtgttaggacttcgactagggaaaatgaatgtattttttgaaacttttttttttttttttttttttttgagacggagtcttgctctgtcactcaggctatagtgcagtggcgcggtcttggctcactgcaagctccgcctctcgggttcacgccattctcctgcctcagcctcctgagtagctgggactacaggcacctgccaccacgcccagctgattttttttgtatttttagtagagacggggtttcaccgtgttagccaggatggtctcgatctcctgacctcgtgatccacctgcctcagcctcccaaagtgctgagattataggtgtgaaccaccacgcccggccttttttgaacttttaaaacaaatttaaaggggaaaaaagtgtaaagacagcttttcacagtaaataatactaaagtgttctgctcctaaagtcaactttcctgtgcccatcatgcccagctcatagtaaatgcttaataaatatttgtgaaatcttcacccttagatccccgcaatcagcccatccttttgcagaaaggcctgccatggaaacatatccaactgcttagaaaaatggtgccagctaactatagtcatttgatcatccagaatccttcctttataatacggccagacagcaaagaatcatcagcaaatatcacgaaaaaagcagcactaaaatggactaacagaagaagtagaagagaaccttaaaaatactaattattgtcttcagaaattgttaacaggacatcagattcataagtcaaaaagccaacttccctgaaaaaggaaagggaggacaagaaagtttctggaagttagagcatgattaatcaaaactgaaactcagaggaagggttgaagagcaaaatggacagtccctgaaatcaggtgatctgaaagatagccaaggatttctcagaacacaagaaaaaagagggatgaaaagtgaaaaagaaattagaagatatggataataaatccaggagaggtaatatgcatccaatcaaacatctaatagaaaatttcctacagggaataaaagaaaaagattcttaagatcgaaagggccagttgatagtggtacccaggaggaaggagtggtttttcacccagatatatcctggtgaaatttctgaattctgcagcttacaagaaaattctgaactcttccagggaagaacaagctatgtacaaaggaataagaatcttattcattacactaaagacaatgcttttgatcattgtctatagctatgtgtattttgaacctagaattccgtactcagcccaactgtcatttatgtatgagaacaaaattaactttttggaatttgcagactcatattcttttcgaaaaaaatactgtgggatgtaccaaaacaaaaaaataagtcaagaagcaacaactcaaggcataagaaacagtagcgagaaaaaaaaaataatttccatattggatacatttatcctgaaagatctctgaagcagtagagctgtaatgttagaagtaatattaataatgaaacagtctggcctgggcacagtggcccacacctgtaatccctacactttgggagggcgtcacttgaggccaggagttcaagaccagcctggccaacatggcaaaaccccatctctagtaaaaatacaagatttagccaggcatgatggcacatgcctataatcccagctactcaagaggctgaggcaggagaatcacttgaacccaggagacagaggtggcagtgagccaagattgtaccactgcctaggtgacagagggagactctgtgtcaaaataataataataataataaaacaataataacagtctggattctgggttattttaacaaaaggtggtgaggataggaaatgaagaggggaaggcaaaattgtctaagattattttcttttttaaaacattttttggagatgaggtcttgctctgttgcccaggctggcatgcagtggcacagttgtggctcactgcagcctcaaattcctgccctcaagccatcctcccacctcagccaccggagtagctggaactgcaggtgcacacccagctaactttttttatccttttagagacggggtcttgctatattgctcaagctggtcttgaactccagggcataagcgatcagcctgcttcagcctcccaagtagttgagattacaggctcgtgtactaccacaaccagctgccttaatttcttgttccaggggagattatgctgattaattcttttattttaagattcaggggggacatgtgccagtttggtacatggatatattgtctgtaatgccgaggtttgggcttctattgaacccatcatccagatagtgaacatagaatatagcccttgtacccctccatccttttttgcttttggagtccccagtgtctcttgtcctcatctttatgtctgtgtatactcagggtttagctcctacttataagtgagaacatgcagtatttggttttctgtttctgtgttaattcacttaggttactggcctccagctgcatctgtgttgctgtaggggacatcctttcattcttttttatggctgcatagtatttcatggtatatatgtaccacattttctttttttttttttatttcaagtctgtcaagctattctttatttcggagagagggcagggcagagtgctcagtccttggcagcggcttttgtcatggtggccaggacattgctcagctcctcctgcttcctcttggtgcatccccacccttgtcttgatgaacttgagggcccatttgtccttggagaccttcagtaactccatggtgcaccgctcgtatggggtgaagccacacagctctcagatcatgtccggcacgaacttggtatatttggtcaggtgcctgcagcagtggctgtgcctgggcgtcctcatgttctcggtcaccttgtggcccttgttgaggcccatggccatagggcagcacagagccatggccgctgctctccaatggtggccgtggcagaaggaagcccacatttttatccaatccaccattgatggacacctaggttgactccgtgtctttgctattaagaatataactgtgcttaagagtaagtgctgtgtgtggctcatgcctgtaatcccagcactttgggaggccaaggtgggatggtcacttgagcccaggagtttaagaccaaactgggcaacatagtaagaccccatttctacagaaaaaaaaaaaaggccaagcatggtggtgcatgcctgtagtgccggctactcaggaggctgtagtgggaggatcatttgagtcacatttataccactgcagtctaacctgggcaacaaagcgagaccctgtctcaaaacaaaacaggctgggcgtggtggcacatgcctgtaatcctagcactttgggaggctgaggtgggtggatcatttgaggtcaggagttcaagaccagcctggccaacatggtgaaaccctgcctctactaaaaatacaaaaattagctgggtgtggtggtgggcgcctgtagtcccagctacttgggaggctgaggcagaattgcttgaacctgggaggtggaggttgtagtcagctgagattctgccactgcagtccagcctgggcaacagagtgagactctgtctcaaaaaacaaacaaacacacaaacaatgctgcagtaaacatgtcagtgtaaatgccagctatctttctgatagaacgatttattttcctttggttgtatacccagtaatgggattgctgggtcaaatggtactttgatttttagttcttcgagaaatttccaaaactgctttccacaggagctgaactaatttccattctcatcaacactgtttaagcattcccttttctccacaaccttgccaacatctgttcttttttgactttttttttttttttttttttttttttttttttttttgagacggagtctcattctgttgcccaggctggagtgcagtggcgcgatcttggctcactgcaactcccgcctcccaggttcacgccattctcctgcctcagcctcccgagtagctgggactacaggcgcccaccaccacgcccggctaattttttaaaatatttttagtggagacggggtttcaccgtgttagacaggatggtctcgatctcctgacctcatgatctgcctgcctcggcctcccaaagtgctgggattaaaggcatgagtcacagcgcccggccttgactttttattaatagtcattctgactcagttgtgagatggtatctcattgtggttttgatttgcatttctctgatgattagtgatgttcggcattttttcatgttcgttggctgcttcttcgtgtcctttgcctactttttaatggggctatttgcttttttcttgttgatttgtttaagttcttttctggatattagtcctttgtcagatgcataatttgcaaatgttttctcccattctgtagtttgtccatctgcttcgttgatagcttattttgctgtgctgaagctctttaattaggtcccaactgtcagtttttctttttgttgcatttgattttggggacttaatcataaattatttgcctaggcaatgtccagaagagtattttctagcttttcttctaggatttatatagtttcaggccttacatttaagcctttaatccatcttgagtttgtttttgtatatggtgagaggtagacgtctggtttcctatttggatgccttttatttctttctcttgcctgattgctcaggctaggacttgccgcatactgattgctgtggctcagtaccatgctgaataggagttgttaagagtggacaccctgtttttttccagttcttaggcggaatgcttccaacttttgcccgttcagtatgatattgacggctgggtgcagtggttcacacctgtaatcccaagactttggaaggccgaggcaggaggattgcatgagcctaggagttcaagaccagcctgggcagcatagtgaaaccttgtctctactaaaaataaaaaaaattagccacacatagtggcatgcacctgtagtcccagcttacttgggaggctgatgcaggaggatcacttgagcctgggtgatacaggcttcggtgagttatggttgcaccactgcactccagcctgggcaatggaataagaccttgtctcaaaaaaaaaaaaaaaaaaaaaaaaaaaaaagatattgtcataggtggctcttattattttgaagtatgttcctttgatgcttagtttattgagggttttttataatgaagggatgttggattttattgaatgctttatgctgattgattctgaacattgataaagaggtatatatatatatctttaaatgatttgttcagactttaatggaaagtactagtaagaatagcatgtagaatttccaaatcaccccatgtggagtggggaaatagaggaacaaggaaaacttcatcaattgagcaaaaattgttttaaaaaataagaaaacacgggccgggcacggtggctcacgcctgtaatcccagcactttgggaggccgaggcacgtggatcacgaggtcaggaatcgagaccatcctggctaacatggtgaaaccccatctctactaaaaatacaaaaaattagctgggcatggtggcgggcgcctgtagtcccagctacttgggaggcaggagaatggcgtgaacccgggaggtggaggttgtagtgagccgagatcacaccactgcactccagcctgggcaacagagcgagactccatctcaaaaaaaaaaagaaaacactgtgtagaaaaccaaagacaagaataaaaccactcatatcagtgattacaaaaaatatgaatgggataaagtcacctattaaaggcaaaaggtctcataaagtgagaacaacaacagtatctagctatgtgttctttataaatgaaacactaaaatcaaaaaggtaccaaaaattgaaaatagaggaaagattacgtctgcccatattgagatctgatggagctgtgagactttacatttttgtttttcatatgcttttgaagtatttatgaatgtcctgggatataagtctaggaataggagcaaattcttgaaaccattttattatatgttttcacaaaataatgtaatatggtacttggtctaaagtggccagtgtttattctttcaaatattttggatttatataatttctttcttccaaaaagttatcttcaagtcttcaggtagaataaaatcatagtagaaaataagtctttctggccagccatggtggctcacgcttgtaatcccaacacttcgggaagccaaggtgggagggttgcttgaggccaggagtacaagaccagcctggcaacatggtgagaccccattcttaacaacaacaacaacaaaatagccaggcgtggtggtgtgtgcctgtagtcccagctactagggaggctgaggaaggagagtagcttgagtccaggagtgtgaggctgcagtgagccatgatcacaccactgcactccaggctgggcaacaaagtgagacccccaactcaaaacaaaaacaataaagaggccgggcacggtggctcacacctgtaatcccagcactctgggaggccaaggctggaggatcacttgaggtcgggagttcaagaccagcctggccaacatggcgaaaccccatctctactaaaaacacaaaaattagctgggcatggtggtgcgggcctgtagtcccagctacttgggagtctgaggcacaagaagtccttgaactcgggaggcagatggttgcagtaagtgaaggttgtagtgaggcaagatcacgccactacactccagcctgggcaacagaacgagactctgtctcaaaaaaagaaagaaaacagtcttttgttgctgctgctgctgttgttgttgttacaaaaaaaaaaaaaattccagccaattggccatttattttagaatagtattaaaaaacaaagtttccatatcaatataaaatttgtatagcttcctagaatttattaaaataggaatactaatagattcaaaaaggaaaatttgtataaattagtgaaaattaccaccctgtccttaatgccctattttaagattagtcattaaataaatatttacttgctggccctgaactctgtgctgggtactgtgaggcacaaaagaagtacaagatactgcctttgcctactaagaattttattcatactttgacagctttctgtgttgaaccagtaaatgttttcttacacagagctctaaaacatgtttaatctggtataatttaccactaggcacaggaaaataattatagctaacattcctttagtttgtctctgtatatccacacttaacaacagcattttcacatgatagacaccctgacatatgaatgaatgaatgaatgaatatcaggtgctagattaaaagctctaattcagtatctaatttaatcctctcaacaattatcatttagctagtgtattatccacattctatcagtgaagaaactgagcttcagatcactttaattaccttgcccaaagtcataattgaagtggcagaatgggactggaatccaggtctaactcaagtgctatagtggtgtgaagggaagactggtaagggttggtgttcatggagaatttgttgctgggtgtatacttcttgtttagatttcctgttttgaaaacattcaaacttgatcaaccaaaagaaatcatttgcataaatgttattcagttccaggagccaggttccacgcctgttagcatctgtccgtcagttctgtaagcaatcttacagtggtgtgtgttcatcctaagtagtacaaaacagtgcagaggaggaaggcggacagcttaggggaaatctgaccaccatgcgtgttggaagtatttctcttgttctcctgcttttagaaagccatctctgcttgctttttcagggggttattaagatcctactctcttggatactgtgctctattaggcaggagacacaggcagaaagaagctcacttggcatgaattaggcaacagagaaaactcttgctcagtgggagtaacctgtcacaacctggttttctctggccagataaccagtcttgtcgagtagtaatgccattacaacattcccattcagatcctcatgacccagtaattgttttgagaatgagtgcaaagctatcagacaccaactactataattagaaaagggaaaaatagacacttaccagagctaatgtctttaggctggagcatttacagctttttgttttttgttttttaagttatggagcctctttctcagttttgcttcctaaaatacaaattgcatggtttaggggttcttgcatttcatttttgttactgctgtgcactctctttccttttttcccccctattttaatcggagtacaaattgctgtcagcacatcgagttcatgtgccagccacattcagaacagggtgttctgtgctcttcaaaacaaaattgctctagggcagtaagagaacaataagtcagagctccagtttaagtgatgttttgcagctcgcttgatgtggttacactccgattgcgcagctaagcttgggtaatttggtttggtttgactttgtggggatttggaggacctccctccccctttaagttacatagtctttaagtcaagaaaaaaatgttgtctctttttaacttgtttatttctttctctaccaaaaaagccctaagtagaagcatcctgtatgtacttttattctctttgggcatgtcatagatgatttacttcccgtaaatcatgctggttgggattagcaacagacctcctgagccctacaggctgcactcccagtgagtcacgatggttattattaaatatttattaagttagtatttgcactaaaagatgccaggtcaaaaagcaaccacagggcttccacagccagagctgccatggtttttgttctgttttgttttggtaggaatttttaagataacattaaaaagaataagtggagctataggagctaggctcatctgcatctgttaccgcaatcagggcccctactgtggcaatcagcagtctttccgtggctccaagtggtgtgtgagttcttgtcagcagtctcgtagaacttttcacatcagtgttccaagtttagaaaccagttaacccagcaatgccctttgctacttgtagatgtagagaatcaatgggctgtattcaccatgaggctgtgatacctccttttactctgacattccgaatgttgtcagtattacaaggcgatggttttggttttttatataaactggggtgtatatgtctggatgtatatccgtttaagattttatagtactgcagggtccaattgtgaagggttagatttaccaggaaaaaaaagattagtccacatgtaaagtagaaaatatttataagagctatcacaaatgtttactgtcctattacagcatcagacactagttctgtcatttattgtctctctgagaagactagctacaatgaatgttttgctttcttaattatgcctttgttacagtttgacttttttttggcatggttacttcatttatctttcccaacatgtttattagtagccaatctttttccctcactaatgatgggttatcacatctaaagagaacttctgaaattactcatttaattttaatatcaagtacatacatcaagctgaaaaacagcctaggaaactaacgcacaggcaggaatccttgcagagtctctggatttcctgttttgaaaacattcaaacttgatcaaccaaaagccacaacaaatgtactgataatttcctcccccactaaatgtactctccttaagggaggaagatgatacttccaacaataaacttcagacaaaaaaaatctgttaactaagttgtgagctactaggacaataaatctctatacttgagacattccacaatacatgagaaatttactttgctcagcaaatctttttttttttttatgaaaagtgttattagtctaaatttcttgggcagagttttaaatatttagaaatgcaaactttttagaactcttaacctccttagaaatatcaatttttactccagtaaaaatatctttttttttttgagacggtctcactctgtcacccaggctagattacagtgccgcaataacaactcactgcagcctggaactcctaggttcaagcaatcctcccacctcagcctctcgagtagctgggacttataggtgtgcgtcaccaccctcagcgaattcagtaaaaatatcttaagcctcagactccctgtagaacctctctagtatgcatgtacagtcatatgctgcataacattttgtttaacagcagattgcacataggacagtggtcccgtgagattataattccatatctttaccttctcaatgtttagatacacaagtacttaccattgtgttacagttgcctacaatattcagtacaataacatgctatacagatttatagcctaggagcaatatgctataccacttagccgaggttatagtaggctgttccatctagatttgtgtaagaacattctaagatgttcccacagtgatgagaatacctgatgacacatctctcagaatgtatccccatccttaagtgaagcatgactgtatttgaaaaagtttaaatttgaatttattttttaaatgttttccaattcagaatgaactttcaatttgctacaagttaattttatctagagcattctaaaagtaagtctaacagaaggaattatcagcatttatgagtgtgggacataaactaaaatgccatatgcgagctctaccaagccactccaactctagcccttgtttggaggagctgactcaagagttaggccctttctagtttggcccaagtttcttagaccccattctgtgtctgcaaggggaacacatcaagatggtattaatactggtgagttaaaaaagagtagtgagtactcacttcggcagcacatatactaaaattggaacaatacagagaagatttagcaaatcgaaaaaagagaagaaaagggtagaacgctttagagcataaatgtccaggggacatttcggcccctagtgtctacaccatttctgttcattcttcagtttttctcatttctcaggcctgggctaggggtaattcaattaaattattaactgcaggaattagatttgaagctggtttctggactatactgatattgagagtgatattaccaggtcatagaatcatagaattttagagcttcattgagatcatgtagttcaaaagtagaataagttagatttgaatttttatttggaaggtaatagttgttttattgggcatggaatgagtataacagaacgagtgatttttagtctctctacaagttgttgatctaaagtagatcagccagtgttagaaaagaagcattttaggaaatctctagatttgaatataggctattatgttacagaagtaggaataaaggattttctttcttttttatttttatttatttatttttttatttattttgagatggagtctccctctgttgcccaggctggaggctggagtgcagtagcgcaatctcagttcactgcaacctccgcctcccaggctcaagtgattcttgtgcctcagcccaagtagctgggattacaggcacgtgccaccacacctggctattttttgtatttttagtaaagatggggttttgccatgttggccaggctagtctcaaactcctgacctcaggtgatccacccgcctcggcctcccaaagtgtgggattacaggcgtgagcaccgcgcccagtcaggattttcttatgaaatccaaattatcatattgcttggtgactgttatgctgtcataccagccatccatttttcttattacatcaaaaacttaaaatagaatacccttaatattaaaagtagttgtaaagtttcagagaattgtttttcctagaaataaagagtctaggccagacctggtggcgcatacctgtaatcccagcgctttgggaggctgaggcgggtggatcacctgaggtcaggagttcgagaccagcctgggcaacatggtgaaaccctgtctctactaaaaataacaaaattagctgggtgtggtggcacacacctgtaatcccagctacttcggaggctgagacaggagaattgtttgaacccaggaagtggaggctgcagtgagcagatatcacgccactgcactccagcctgggtgagacagagcaagactgcgtctcaaaaaagtctaactcatcaagaaaaaatagatatctgtatgcattttttctattttgtcttaaaatatgagaaaaagcctcttattttaatatgaaattactctgggaaagagcttggtaaattggggtggaacggggaattaggcctcccaaaattgacctcctaatatttcaggggaggttattaagtaatttgatttgtgaagttatagtagactattgattctttcacactttacatttattatttccagtaagggatatagctaagatagttattgatgttgttgtctttggatttaccatttttattcagatatatttgtgaatgagattaggactcttaaagaagaaggagcatctgtattcatttaatctttgtatatcattggagaaatagccatttagttggctttttggcccaagcatctgaagccaagatgcagttacagatgtttatatatttgatattaaatttgtggcatttgataactttattaaataattcagcatctcttgactttgtattataggtgaggaaacttctgtcacatagtaggcttagaataaacctgtgtttctggtttgttacctactaaactgtcttattgatacaaatatcagtaattacaagtttaatttagaaatatggttgctcctaaactttcagactgggtagactaagcttcaccaagacacactgtgtgtgtctcttgatgaaatgagaaaggggaaatggtatttgctacattgtcgaccactcatttatcacttcactgaattagccagtcctaagaagcagctctgttgactctcctgtctccttgccctcagtccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaaggtaagcagcataccagtttggaacacagtgaagtcacctaaaggacagggatatgcttgctttttcattcagtgttttggcattttcagtgaagttaatccaacaacggaaacaattaaatcaggctgcagttagtcatcacgtaaattaatgggccttacaatatcatagaggtttgtgagcatgtttacttgattgatatatgttcagaacaggtcttacagccactttttgcttttgtgatgatttgttttgcctgcagtattgccaagacaggcagctatggacccctctcatatgtggttctcttaccccctcttcccttttctctaagttaggcaggaggcaggaaaacatgggggttgggagtcaaagaagcatttggatgatttactaccacttgaacttgtgccacttgttcttatacagagtccctgaaaaaaaaagcacattcttcctggatctaaaggcaacagagatgactcattttttgtctaagtttttcccatcataaggatatccattagcactttcaagcttagaaccatcagacactgacagtctctcttgtgaaaacatgtttagtagtatttttagatctaaaattataccatgaatccaactcttctgtcttgagaaacagacccctgagagaacccggggtgttttgattttgtctgcatgagagtgcatctgcttatctagtgtatcctccctccggctccatggatttcagacagtgggattctgagttactgagaatcttgatgacctgcacttgccagtaggtgatgttaagccttttgtggtgtcattttatagactctgtagtaatccaatggcagtttacctttgccccagcacttgatccataatcatatatatatatattttgagatggagtcttgctctgccacccaggctagagtgcagtggcatgatcttggctcactgcaacctctacctctgggttcaagcaattttcctgcctcagcctcccgagtagctggcattacaggcacccgccaccatgcctgtctaatttttgtatttctagtagagacgaggtttcaccattttggccaggctggtctcaaacgcctgacttcaagtgatcctcccgcctcagcctcccaaagtgctgggattacaggtgtgagccaccacgcccagcccataatcatatttttgaggtgatctagccatgcaactaccacttgaaaatccttccaaagtgctctaccttgaactcttcatagccgtcactgaggcaccctttgtataatggcttctttttctctacctggttcctctttccactaactatagcccccacttcaatgtgtcttatttatattaatatttactctatatttgtagtttattcttaggtgaaactaattctgtttctaggagatactccttaaaattcagatagagcatagaaaaagctatctcttccatatccaaataatctctaattacttttttttttttggtaacaggatctcactctgtcgcccaggctagagtgcagtggcacagtcacgctcactgtagcctcaacctccagggctcaggtgatcctcccacttcagtctctagagtagctgggactacaggtgtgtgccaccacacccggctactttttgtattttttgtggagacagggttttgccatgttgcccaggctggtctccaactcctggactcaagtgatccgcctgtctcaccctcccaaagtgctgggattgattacaggcatgagccactgcgccaggccatctctgattacttttaatcagcatttcaaaattacagtagttctaaactcagagaggtggatttatgtgtaatgtatattttcaaaatttaagctcccttaggataaattctgtatgtattatgacaacataatgttataggaaccagtttatatacattacattttagcctggctgacaaggcaattgtggggacagatgtctcaagtttagtgacaaagaaaaatagaaattgtctttaaattttttaacgcaaacagttcttttcagatttaaactgtttgttgtatcattagtggttacactttgctctgtgcgcttggccaaggcacttaaccctcctaagcttcagtttcccctctgtaaatggggatgacagtatccatctcataaagttatggagagctaaataaaatcctgcacatatagggcacacatgagcccgcagtgtgtgagcttttgttgctattgtgacggctcaccttctcttccattttaccctcggaccacaagaaaaaggaaatcctgtttaacatgagatcaatctttcagatcttttcaggcataaaagttgtcaataggttttcataaatttctaggtataaaagtttatgagttttatggaaataatttagcatatttagaaaggaacattatttttgttcaaggtgttggtatgttggagaattatgtgaagtgcattctctgtaatatgagactgctgcatatgcattgcgtagtactacatatatatgtagaaaacccctacgtgctatatatgtgtgtgcgtatgcatactgtgtgtatagaaaaccccctacatgctatatatgtgtgtgtgtatgcatgctgtgtgtgtgtatagaaaacccctacatgctaagcatgttttcagtgcaggcagtgaatttacttgttttattcagcttcccactttcataaaacattgcatctaaatgttgctataagtatggctgttgcagaaaatatctgcaaatagctcttagtgtcatctgtatttcattctccagaaaatttccaaggcagaccttctctgtgactctgatactctgatagactctcgggaagaatgttttctttctgtccctcccccaccccccgagacagggtctcactttcacctaggctggagtagggtggcataatctgtagcctcgaactcctgggctcaagggatcctcccacctcaagctcctgggtagctgggactacaggtgtgctccatcctgcctggctgatttttttcattttgtagaaacagggtcttactatgttgtccaggctggtctcaaactcttgggctcaagcagtcctccagcctcagcctcccaaagtgcttgggattacaggtgtgagccaccacacctggcctagaatgtcttcataataagaaagtcataaaacatttccagacaatccatttttctttctcctcattgggacaatatcttccctttgtattgttttaaatactgagactaataaatcttttttgttttaggtcaagtgtatatagtgttaacttttttttccgtcctttccttatgtttctgtcacgcatgaaccccaaacaaaaacacaggctattggtcaggcaaggtggctcacacctgtaatcccagcactttgggaggccgaggcgggaggatcacttgaggtcaggagttcgcgaccagcctggccaacatggtgaaaccccgtctctactaaaaatataaaaattagctgggcgtggtggtgcatgcctgtaattccggctactcgggaggctgaggcaggagaatcgcttgaacccaggaggcggaggttgcagtgagctgagatcatgccactgcacgatgcctggggtgacagagtgaaactcttgtctcaaaaataaaaataaaaaaacagactaccaagagccataatgtctagttatgaggcagtatgagtccaaaaaacctgattttctggggacacacagggtctgaatttaaacctggctctaccactgcctgtgtgtgacttctcaggaagcactctgtgtctttatctgcaaaaagggagcaattggtaagagcttgtagtccaagtgcttcttatatgcacattaaggcttaatggtcattcatagtcattatttgtatctctattctctggaggaaactcttaattcaagggcattaacgctgaattccttctgttaccatagtctagattatcttttggttaggtcttgggattcctcttgtggtgttttgtttttcagtcagatgagttgggtgccctggttccttcttcacccaggctgacaactttctgtgtaatatggaagtcagggtaggtgctgccagaatatcttggcgtgggcttccacctctgcaggatcatgtgcgccacacgtatcttgactgaatcgcttcattttaacctgggagagattgtagaaataatatttttctttagtcttctttaatcccatcaataataggacacttggtgcctcccttgatacagccccacattccccacaggcagattttctcatcctcagcactgttgacactttgggcttgctaatccttggtcatagggggctgtcacgtgcattgtagaatatccagcagtattcctggcctcttcccaccagataccagtagcacccccatagttgtgacaacccataatatttctagacattgccaaaggtttcctggagggaagaggagttaaaatcaacctggttgagatctgctggtctaaggcaaatgccagatcatttgttgcatttgcaactgcttagcacaggactccaaatataacatgctctcagaaaatatgtgcttagcaaggactcacctacctacctgggtagttaaggaatttttttaaaatttattagatggcagaaacaaggtagtaggtatatacatctaagagctcaaagtagaaaattaggcatcacttcttaaaattggtcactggtaattatgtctttgtggaagataccctttgccccgctcctcattcctaccagctctcgtatctctattcctctttttggctccagcttccattttctgtgtaacagtggaggtgagtgagtaagcatttttattcctggaaaatccaggcaaagggtaaagaaagtggtgcaagcaacaaaatttgagtgttcccactctagtccctttgccccagagaaaactggaggtattagattaagtcggttttgacatctttcaacctgtaccttgaaagcttgagtttactaagttttttgtaataccatttcatatattaaagaacagctttgcttgcaacaaatgggaacataatatatttcagtgaacacttgactaatatgctgggccttgttctaaacaaacactgggaaacaggtgaaccagacagagctctgctacagctcccattctagtaaatatctgcttcccgaatacatttaatttgctggagatcttacatgatcccaagaaaacaaatgtatatgtcctcagttatttttttcagtaagttttggctaaaaggtatagaatcctacactctgatagctataagccataagaatatttctctagaggaggtgtcagaacttgctagggcagctatttttgagtatatcattatgttatttgtgtttcttcatgtgcttttaaaaaaacttaaatagtgtgaaaacttttctctcctgatgtgtgagcctttccccttcacttatgtgactggaagtggtactactagaagtgacagcactttaaagttaaaagcttattaaaacatacctcccgtgagtaccactctaacaattacagtggctgtgtcttctctgtcctttttgctgataaaacttaggggaaaattcctggcagctaaatcatggccattttattaaaaaaaaaaaactagatatgaaatcaagtagagaaaaagacagtgacatttaaaatcccatgaatcaagctgccccaaggagtacaggtgttgcattacatgtgaatgtgaaggagaaaagaaaactaaacctagcctggtttctaagaaaactgtagcagtgaagatacttcacactgtatcttctggtcaacatctggtttgtcttcagggtctctgacacatgtagcttgcaaatgatagctctgttgatgcctcaaaatactgaaggaagtgcctggaaatacaccaatccttttaaagttttattttttactctccatttcagatatggttttggagaggcagggaagcctaaatttggcattgaacctaatgctgagcttatatatgaagttacacttaagagcttcgaaaaggtgagaaaataccaacttccttaaaattatggtaggtttcttctccatccacttcctataaatcagtatcttatcttagtaggtggtatagatagatggtgtttattcattatcaagtttgtctcttgcctccaacactgctgctgaagaatagaacaactgacatagcacagctgatatacaacgaaggagctccgtgttcttattttgttcctatgtgtcagcttttttttttttttttaacttttttgggtagaatccaagacttgttcccttatttgttcctagacttgttctttttgtactttttttttcctgggttgaggacagaaaggttcacgttctgccaagtggctccttgggggagtggggtgcagcttttcagagctgaacggattgtacccttcacaggagtcacgaagaggcctgcactgtggctccaagttgttatcccaactgcaagtcctcgagggccactaggctctgtgaccagagatacaagaaagaaagcagctaacccgaagccattttttttttatacttctccaagtagagaagagagagaatttgtcagttgccttggattccagaaacagcatgcctccttgaacatatttccatctcagtttcactctggaggctcccagcagcagccgacctggacacacacagcatatacctgagctaggtatgctgttgtcttcggccacgtgcccctggcatttccaaagccccaccctttgtggagctcaaggactgcatttgtgttccttttttattcctgcacagtgctacctccacgttctgtacattcaacttttttttttttgagatagggtctcactcttgtcacccaggctggaatacagtgagcgcgatcatagctcactccagcctcaacttcctgggctcaagcagtcctctcacctcagccttccaagtagctgggactacaggcacacgctaccacacccagctaattttgtttattttttgtagacatggggtctcactgtgttgccccagctggtctcaaactcctgggcttgagccatcctcctgccttggcctcccaaagtgctgggattgtaggggtgagccactgtgcctgaccacattaagcacattaatataaatggaaacatgaccatttatattttgttagattcagaaaagaaatcattgtcctgtgggcctgtacctttgggctaagaaagtgaggggaggcctgctttgggattcacccccagtagtgacattcctaatcatacctcttctacttcatgttcccccaaacaaacatatgtctggttatgaccactgattgttgtcatgtaacctcttctgaaggcctgctagctcagcactgatcccccaatgctgttgtcatagcatatggtgtttttttattgttaaagagagagaagataatctttagcatgtggttatttagacctatggctttactatttccatttttgtaaagcagcctcttgccccttccttctcgtggcccagtggacattgcttatttaggagcactctcccagtggtgtgccacagcaagcctgtgctctgtcatcactccaagagtatattcatgcactgctgcttggtatatttgaaatcacatgaaggtatatgatgttgtttggggcaatgtgatttaatcctctgccttgttaagaatagactaggccaggctgggcgctgtggctcacgcctgtaatcctagcactttgggatgccgaggtaggtggatcacctgaggtcaggagtttgagaccagcctggccaacatggtgaaaacccatctatgctaaaaatagaaaaattagctggacgtggtggcaggtgcctgtaatctcagctattcgggaagctgagacaggtgaatcgcttgaacccaggaggtggaggttgccgtgagccgagatcatgccactgcactccagcctgagagacagagcaagactccgtctcagaggaaaaaaaaaaaaatatatatatatatatataaaaatatatatatatataaaaatatatatataaatatatacacacacacacatacacacacatacttatattccaggcatggtggctcacacctataaatcccagcactttgggaggccaaggcaggattacttgagccgaggagttcaaaaccagcttgggcaacatagtgagacccccctctctgcaaaaaaatttaaaattttcctgggtgtggtagcacattcctatatttccagctactcaggaggccaagataggaggatggcttgagcccaagagtttgagaccagcctgagcaacatagtgagaccccgtctctaccaaaaaaaaaaaaaaaaaattagctggacatggtggcacatgcctgtggtcccaactactcgggaggctgaggcaggaggattgcttgagcctgggaaatcgaggctacagtgagccgcgatcgtgccactgcactccagcctggacgacagagcaagatcctgtctcaaaaaaagaaaaaataaaagagtatcctgtctcaaaaaaagaaaagacaacagagcaagatcctgtcttagaaaaagaaaaaataaaaaaaaattccataaagactgaagccaacctaagaaatacaaagagacttattaactaggtgttctttgtttttgttttttgggtgctaaaacctggaattgaaccataactaggtttttgagtaatttgagctacattattaggaagcagaattacatgagttgccagaaagatgagtaacccttttattattcacttttaaaaagtagaggatagtcactgggcgcggtagctcacgcctgtaatcccagctgaggtgggtggatcacctgaggttgggagtttgagaccagcctgaccaatatggagaaaccccgtctctactaaaaatacaaaaaattagccgggcatggtggtgcatgcctgtaatcccagctactccggaggctgaggcaggagaatcacttgaacccgggaggcagaggttgtggtgagccaagatcacaccattgcactccagcctggacaacaagagcgaaactccgtctcaaaaaaaaaataataataataataataataaaagtagaggatagcaggggctgtgacaccaggaacacacactcgttatcttttgaatagagagaattttagttacccatttaaacttcataatttatatgcagtaaatagcactgaccacacccactgtcacttttcctaaaggctcccagattgttctcttgactctggtccttctaaatccagcttgtaaatggcaagtgcagttatttctggatttgtatctgtaatggtggaagtaataatacacacaatacaagctagcagatgataatgaagtcatttatttatggctctaaagtgatatttttgcatgagctttactcccaattatgttttgcttgaagtcccccccagtatacatctgcaagttgatacaatttagcagtattattagtatatctggttgttttagagtggcaagacaacctgacccagaattttgaaaattctgtatgaatatacaaactacaacttgactacagtcatgttcccattttagagttgaaaaacaggcttgagagaaacagcctagtggagaggtttgcagagggagataaggcatggccttaactttgtgtgggttcaccttgtatttctaaagattcactttgtagcagtgcttaccagagtacgttccttactgtgtttttgcggctcctctctcttgagcaacattgttcaagctacagcttggtcatgatggaaagtgagttcttcaaacagtatgaagaagcactggcctagcagtaaattggcactgacacacaatttcaacagccagagtgttttcagtttggagtatcttctagaattagctgctctttgttccaataggcctcaactgatgcttttctctctgttcatctaaccattgtcacaaatttacacacaggccaaagaatcctgggagatggataccaaagaaaaattggagcaggctgccattgtcaaagagaagggaaccgtatacttcaaggtgtgtgagtccctatgcaatcctttccatctcaaagaatttattcaagtgttggtgaattgtgctgatattccctactctgaattttgtcaacactgcttggtaagaataagctgcaatttttataaatctgtcattttcaatatgaaaaatggtgagaaaacaatcatgtggaaaaaaaaaaaagtacagattcctcttttacacattctgctctagattgtaaccttccatacaggcagaccaggtctggcatccccacccaccacagtatcactcactcctaaagcatcttgcttggtacatagttggcactcaacaagtgtttttggaatgaaaaaagaatgaatagaataattgttagcaaagaatggaattcataagggtaagtttcacatcatttttctttcttcctttttttttttttgtatgagagacagggtctccctttctttcccaggctggtctcaaacttctagcctcaagcaatcctcccacctcagcttcccaaagtgctgagattacaggcgtgagccactgcaccgggcccatcttcctttagactgtcttgatgaagtcactagagcatatgataaaaggagagaggacatgcacaaatttcaaaacaaactgacaggagagtattgattgcttctaatggccaagatgattcctgcacacttgcttttatgaggaatctccggatattcctgaatgatattcatcataaattgcttctcagaaacccttcttggagcaactaggagtgtgatattttctcacttagatcttaaacctctagatgtaagaaaaaaagaaaccgcccttcattctgttttaatcagtgttctacccattgcttccccaccccaaatatatgccttctccatgtcaagcagaaagggcttagtgatgagaattagagggagaatgggagttctgtcaaggtttctttcgttttctgccactgcaatacagaaattagatgtttttcagcagtataaagcagtgaggcataagtgtactttaacaagtctttatggggcatctgctataagacatgctattattaagttacaaccttgtcaggagggaggagtggcaatgttaatccaaatgaaacaactagagaattatgtaagaatatataatcaacccaaaattaacacagccagagggcaccatgtgttttcagaatttgagctgagacaatattgggtcatgaaatcagttttgtggaagtgtattgcaatatgttataaggatcagttttgttgcataaaactttgcttgtgtatgagtaagtactggattgcatatttcttactgtgggtggtattcaaacaaattttaaatcatgggtttagataagtataaatatataaatatgttatttatcattatttactatgtatactaaactcttatggatcaccagaaagcatgggggtatgatagaataagctcagaattgggaaaaatgggctttattgctcttcaaatgatttagtcatttaaggtccaaagaggttatattttcaagtgaaaaataggggagttagatgttccccaagtttctttccagcctgaatttctgtgagtttctaaactctcaagaacaagtgttatttttttggttttgttttgtttttaattctaattgaggtatattggatacttctaaactattcaagtaagattccaagtgggttatttgtatatccaaatacataatacactagagggaaaaatgtttctacaaaatttcttaagatcgtgagtccttaacagtattttctatatttccgaagtccataaaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgcttctcctgggaagaaagcatttctaaaacaaactagttgaggagaattgttcaacctctaaactcttcagataaatcgggctttgctatattttcaccacccttgctgttccaagataccagtaatgtgatttagaaacaagccgtttatgactctaggatttgatgttttaaaaaaaattcctaagaagagtccaccctgtctttcatctctttcctttagtgcagaatttttcaacctcagtactatcaacatttggagtgggataattcttgattgtgtggggctgtcttgtgcattgtagaatatttagcagcattcctggcctctgcccattagatgccagtagcatcctacccagttatgacaactaaaaatgcctccagacctgccaggtgttccctggggggcaaaatcaccccccagttgagaactgctttagtacctcagaagcagggagtacaagacagacttttcgctaattggaagttgaagtctaaataaagttacatgatatatatgcaagagctttcaaaaaattaaaatgccctatgtgaaggaactattaagaagtctaatacctgttttttgtgttttgttttgttttaccatggccttctaccattctgattattcagaacttattgaaatgttaagatctaggtttttgtcctccctggctcttcttttctttccctatacaatatattaggagataatcagaaaagttaagttaatcaatgcattagagagggaggaggagagaggatgaagaaatgaggcatgacaggggaaatgcctgtccttcctatctcatctcagtgaaacaacacttttcatttccacccacacattttttgctcccaatgatagcaaaaggttttgttgttggtattgtttttagagagagagggtcttactctgtcacccaggctggagtgcagtggcacaagcatagctaactgcagcttcgaactcctggacttaagagatcctcctgcctcagcttcccaaagtgctgggactataggcgtgagccaccacaccactttagaaaaagtcttgattccatatttacattcctttgatttcaatatttactcaacaaacctttattaaagacctcttggtgctaaaccctgaatattccaaaagggagaggacaatgctgcctgtcctcaaagaccagcaagagaaaaggcagtgacagaaagaaaatgccgacctgaaactggtgaggactttattcttttttttttgtagcatccaaaaaaggagtggtaggcctaagactatgacaaaatttaagtattgtcttagcttgggctgccacagtaaaataccatacactgggtggcttcaacaacaggaatttacttctggagactgtaagtcccagatcaaggtgttagcaggatcagtgtctggggagggcctctcctctggttccttgtagctcccttcttgctgtgttctcacatggcctttccacatgcatgtgagtggagagagggcagagggcagcaagcacccgagtttcttcttataaaggctctaatcccatcatgaggccccaccctcatgaccacatctaacctaattccctccccaaatgctccatctgcaaatatcacattcggggtgagggcttcaacataggaatttaggatgggggacacaattcagtccatagcaaatctaatttcctcaagaatttcagcatttaaaataaaatgccctggtttcgtgttcttatgaatgacctgtatcacacacttctgaggcagagagggtgacagactttgattttagtgccagtcttccctctcctaagtgagtgacttgggaagaaggatgttcgagggatgtagcctggccctcattcacacccaggccctccagctggaacaggtctgccccatcttcatcaccagaaaatccacaccagggcttcctttctacaggcagagctcgtttcttacatcacccacttgaagtcctgtatcacaggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaatttaatgtcctaataggtctggctgctcctctgccatctggcaggatgtatcatctgtggttttgagcttatcacctcctcaaaggagaatccccacttgtactcctgtttctatttgcgtatttaccagcgattccccagtgctttcatttaccttaaaatcacagtggacacattgtctcagccctggaggggttttgttttgttttgttttgttttgtttttgaggagtctcgctctgtcacccaggctggagtgcagtggcatgatcttggctcactgcaacctctgcctcttaggttcaagcagttctcctgcctcagcctcctaagtagccgggattacaggcatatgccaccatgcctggctcatttttgtatttttagtagagacggccaggctggtctcgaactcctgacctcaggtgatccacctgtctcggcctccaaagtgctgggattacaggtatgagccactgtgctcagcccccagcgtttctcatatgagcatgtatatatatatatattatatatatattatatatgtttatatttatatatattatatataactgacagacctttctgatgtatattgttttatagttgttatttatgttgtatgctactatccaactattcatattcccattgcctatagatcaggggtcagcaaactacagtttgctggccaaatctggtccctgcctgtttttgtaagtacagtttaactgaaacacagctgcacccattgatttacatactgtctagagcagcttttgcactacaaatgataagaatttagtagttgcaacagagactggttcaaataggattggctgtgtttggaactagcacttgccagaatgtaatatttgctgtgaagtgctgaaaagaaaagtaacttccttttcatttttttagtggcatagtctaaaactgctcacaatccttttgaaagactaaagaataggccaggtgtggtggctcatgcctgtaatcccagcactttgggaggccaaggcaggcggatcacaaggtcaggagttcaagaccagcctggccaacatagtgaaacgctgtctctactaaaaatacaaaaaaaaatagctgggcttggtggcggccacctgtagtccccagctactcgggaggctgaggcaggagaatcgctggaacccgggaggcggaggttgcagtgagctgagatggcgccattgcactccagccctggagacagtgcgagactgtgtctcaaaaaaaaaaaaaaaaaaaaaaaaaaaaaagactaaagaatattagcaccaaagaacatagcccagaagccttgctgtactacacctgctgaagggatggatggaaatgctgcagagcagcactaggcagtgctcaggcactgccccaaaccagcccacaggccatcgaggcctccaagggagtgggaaaggtacctggagagccatctccagaaggaaagaaagaaaccagctgtaccagggtttgctggaggggttgcttcactttgaggatttgcttttcttttgtaccccctcaagagctgagtacaagtaatgacgcttttttatcctagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggtaacatcgtgtctcctgtgagatggactttagatactccagatcttttctccatctctgtcttttgcttcctctcagccaaaggttgcaggatttttcattttgcttttttttatttatttgaatgtttgggattatttgtttctcagtatgaattgggaaattcagcaagatttttattacagtcagacttttatgatacctagactgtttatcataatgcattctgaagaaaagttttgattaaaattaaataatttttatccacgaccttccttataactgtagtatttatatcagagtagacgtataactcctcaggttcagtttaataagagaagatttaacttaagcttttctggactttaacagactgcaactgttcatataaagcatatatataggtcaatttttattataatcatttattcactgatatgcataaataatatgaaaggtccacagagcatcagcagcctttttatttttacatttgtcttattaatactatctttggtcttttgagtgcttacacacagtactctataacagtggtttatcatctgtatcgttatgtatcgttctgatatatttatacaccagccgatactattttaggtatctggtctcagagtgaacagtatatattatactgtgggtaaaagtaaaaactaatcattggatgtatcttaaaggtagacataaaaggataagaaaagcaaggcaactattttgtacattctttgtgagattatttttgaattttgtggatcagtgtttcctatcgcatcctctctcccaagaccagttattaattttatatgtattttttcgtttttttcatacagagcggagagagagagagagagagtgtgtgcgcgcgcgcgtgtgtgtgttttgtttgttttagagacaagttgttgctattttgcccaggctggggtgcggtggctattaatacacatgaacataatgtactacagcctcaaactctggggcccaagctatcctcccacctcagcctcctgagtagctgggactacaagtgcatgccaccacacaccctgctaatttttaaatttacttttgtagagatgggggtcttccaaagagctgggattaaagttgtgaggtaccacacccagcacagccttgactacattatttttctgtcttctattgacagaagcagtcatatagcatcactattaaccctatctttggcaataggaagcctgttctccttattttcctctttttttttttttttggagatggagtctttctctgttacccagtctggagtgcaatggcacaatcttggctcactctaacctccacctcccgagttcaagcgattctcctgcctcagcctcccaagtagcttagaccacaggtgccgaccaccacaccaggctaatttttgtatttttagtagagacagggtttcaccatgttggcccggctggtttccaattcctgacctcaggtgatttgccacctcagcttcccaaagtgctgggattacaggtgtgagccaccacaacccagcaattttcttttagctttgttgattatatctttctctttaaagaaggttttaatgtttatgtagtcagatttgtcgtctcctttctagttagaaaagacttccccacaccaagattataaaaataactgaagccaggcacagtggtttacacctgtgacctgtaaccccaggactttcggaggctgaggcgagaggattgcctgagcccaggagatagaggctgcagtgagctgtgattgagccactgccctccagcctgggcgacagagtgagaccctgcctcaaaaaaataatgattatattttacatattttaaaataaaaaataattgaaacattttatggttttttttaatatgtaaatatggttgatctagaatttacttttgtgcttacaatatgaggtaagaacttttttttttttttttttttggagacaagagtctcactctgtcacccagcctggagtgcagtggcacgatctcagcccactccaacctccacctccctggttcaagcaattctcctgcctcagcctcccaagtagctgggattacaggcgcctgccaccatgcccagctaatttttgtattttcagtagagacaggatttcgccatgttggccaggctggtctcgaactcctcacctcaggtgatcacctgcctcagcctcccaaagtgctgggattagggtgtgaaccactgcacccggccttaactcttattttctatgtggatagctgccatcctggccccgtttattttaaagttaactctccactgattcacattaccacctttgtcattttcaaatgtttttatatgcagacacatgactgtttctgaatgattcgttctgttccactgagctgtttgtccacatgctagtaaccaaactgtcttaatttcagtagttttaaagtttgtctttttctctggtaagacaagtgcctcttatttttttcttttttcccaaattttttcagccattcttgggcacttatttgttccaatgaactttaaaatgaacttctcaagagccccctctcaaatctccttgggatctttctagaaattgcattaaatgcagaaaataatttgggtagtaaattttgatcagtagtatgtaattatcttgagccccatttttttaaatacactttttccatctcctttggcaagagaactttggtaagctgtttactgaatttattaaaattcgtcctttctaaaatatagaccatctattcctaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggtgtgtgcagagcctgatgactgcaggtggatcaagagcctgaccatgcccctttgattttaggggacaggaacagctaaacaacccaagaggctcaagagcagggaaaacgatttccaatctaatctgaggctgctttggatccaaaggtcgagtagggcagttccagtcaccaaaggcacacgtcatgagagatgagaaaactaaattcccttcagatgtattagattggttcaaaagtaattgtggtttttaccattactttcaatggcaaaaacagcaattttgcaccaactccccccgcccgccccccgggcccctgcccgagtcagagtctcactctgtcacccagactgtaatgcagtcgtgctaacatggctcactgcagccttgacttctctggatcaagtgatcctcccacctcagcctcctgagtagctaggacaagcacactaccacactgggctaattttttaaaattttttgtaaagatagggtttcactttgttgtctaggctggtctcgaacccctggcttcaagggttcctcctgctttggtctcccaaagtgctgggattatagacatgagccaccatgcccagcccttttgtcatttttgaaaaattgtaaacccatcaggatttttttttcaagtaagacttacgattttcccaggaaatgggatgttataggagccccatcatcacacctgttatcttgagggtcggcagccagcctgaaaaatgtggcaggagaggtctgtctgcagagagggcggcctccctacagcatagttggcattctggtcctgtccccagtctccaggaatgcccagacttcattatcccacagctgtcccatgtgtcaaccaaagaaaggtgaagctcccactctaactattggtagcacagccctgacctacccagctagatatcctagagaaaatcattgcaatacctcgtgtttgggacctgatacacagtctggaggagccaggaattatttcacttctttattctctaaccttcttgattgcttatttcttccttaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgttttttaaaaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctactaaaaatacaaaaattagccaggtgtggtggtgcacacctgtaatcccagctactcaggaggctgaggcaggagaatcacttgaacctgggaagtggaagttgcagtgagccaagattgtgccactgcactctggcctgggtgacagtgagacttggtctcaaaaaaaaaaaaaaaaaaaaaaaatcagaaaatcggcaatggacagtatcatcctacactttgctctaaggtgaacctgaaaccaacattggggtgaaagtggcagaacaatgcatcattgctaaaaagaaccaagtaatgggaaaaataaaaaggttttgttttttcattagccagcggatatttcacctttttaagctgattttaaggtaggctcgacttgcaaaataaaatttaattgtgcccttt

SEQ ID NO: 17466 - DNA, 27555 bp, Human
acatagactgctggggattgggtttgatttgttttgtttttttaaattccattttgataatttttttcctgctctgggtggtggtggcacatggatgaatgagtatttaataaaagttccaaatttccacctgggtccctccatcctttcagctctaggcccgggtggcagggttggtcaaatcaggctatcagccctgtctccctggcacaaaccccactcagccttggtgccagagtggtggggctggcctgccagggacacaggtgggaaggaagcccagtataagataaagccctgaggagctgctggtggcttcttgcccacagctgagcaggtgggctccagggtagccaaacaggaccagggtgaccgctgcttccaggctctggctgagtctcaggcctcatgtgattgagctgggggaactcttttcctgccttttcttgtgaaatgtagtcagagcccctccaacccagccacccccaaatcacacagtcagcttctccaagagggcaaagccccaggttagagtgaggctgggggacacctttgccaaggttactgagattcaaggagcagagtctgatgcctctggagctgaagtcttggctctattacccagctctgggggtgcccacctaggtgcctaggactgtgctgtgggatttcaaagccacaatcagaccccactgaaaagtgagttggtgagaccagatcagctccagggggaagaagggatacaggggaaggcacttgatgggaagaagctctgggtttgactctgcctacacaggaacattgcagggattggtggtgcctcttttcctctctctgctgtgatggatatgccccaaccccttcctgcctcctaggattggaaccccctcctctgatccaggcatcctctcccaggatgcctagaaagctcccatttactcttgccaccagctccttgggaagagaggggcgggggcgtgcttccaggcaggaggtattcccagcaccttacttggagggatttttatttggcttagggggtagggggaggtgtcttagaattggcctgagcagatgtcttcaacatctgtgaccaccattcctggtgtgggcgtgtcccagtccttttggacactggatctgaagaaaggaagcactgacatggagggccctgaatcccaagcctgctgctgctgggacccttaaagttgaggtgcaccacaaggctcacccccatgtgtttcaggaagtttccagtgtcttcagggctactggggctagagtgggcagtgctctgagtaccgtttagagccagtgctgaggggatagggagccagcaagtcaagtgccacatcctgacctggagaggtgccctggcccatttccttctccagctttgtgatgttgcctttgtttccttccacttggatggagtcccaccaccatggtaatgttaagtagcaccaaaagctctacccagagcctactatgtgctttacgtccattctcagacattcttacaacacggaggcatttttcctgctttacaaatgaggaaactgctcaaggaggttaagtaacttacccaaggcctcctatgttgaactaggactggacctttactctgtctgaccccaatatcaggatgagcttgctttttccctcagcaagctgcgtctgggagccctggaaggctccagaagcctccgggtctgaggaggcttctaaaagggcctcacatgccccgggagccacgtggatacagaacgagggttcccgctctcagagagttggtccccagttcccatgcagggagtggagcctctgagcactgccagaacaacaggcagggttctcgacagcacagagcctcacgcaatgtgcaggcaggtggtgctctcgctccaccacggcacctctgcggtctctgcagccgtttgcatttcctgaaaccggatcttagtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgaggggcacccgggacccgggggaggacggcagatgcaccacaccagcccctgccgcctgggagccaggtgtggacactgtgccactccaggggcacccagccatccagcgtcccgggcctggggtcggggggctggtcctgggtaactgggccaacgtagcctggtagatgccgctgcccaccctccagagacctagtgaagtgtgtgcagaaaccttgcgcagaactgggccccacaactggaggccaggaggttctgagggccattatggggttctgagggccaggagccaggccacatcccagactctgtgtgatgagcacacacacctccacagagtcatgcttgggcacgcagtgtgctctttcttgctgcttcctcctgactttcaagagaaacagttagccagtgcttggcagtcatttcctctggagctgagagaggcataaaggggccgcccccagtcccaaacctgtctggcctgtctaaccctgccccccaggtgggacagagctgcggagtgggtgaggactgaggaccctattatactgctacgcagctcacccccctatccaccacacatatcaggttgggaaacttaccttaggccttgagacctcaggtagggaagggggagaatctaagcccaggaaaatcccaatcaatgattgtcctgaagtcaatcatctggcctagacaatttctgggaggccaaggagtttttctctctcttcctctagtcctccagtagtgctgccttccctaccctagttagtggggaggaagcaaggccctcagccactagaatcagcgaacactgggggaaaggagcaaggtaggcctcagctctctaggacctgccataggggtgccttcgttcactctgcaagtacttgagtgcccctcgtgaggctctgtgcctggcatgtggctaggcactaaactggtgtctccctgccccatcctccaaaggagacgtgtggtctcaaggaaacctccattcttaatgaccgaggtagagggtgctggatacctgagagatgaatgggacagaacagttattgtgccccaccaccgttccaaccccctactttactgaacttggatgtgaggaacttgaatatcccaaactggtcctatgttaaattccttacctggatttgtgagcatctaatagatgatttcactcccccaggaaggagagcccactactatcttttgtcacctagggagaacctcctaacaggcagattcttccttacatcctatttaaatctcttgtattgcagatcatgtcatttggttgggtcctcagtataaatggaaaaaagtcgatcatccaaaatccatttctgcaaactctgtgtcccacccctacctcccaccctgtccctttaatatcttgccagacaataccagcccccgtggctttttgcttccagggtaacattttccacttctgtattacctgtggccactgagacctctccaggctctctctgcccttcacatggaaagtacagcctttaagtggctccccttttcctggtgccatcagccagtaaagcctcctagcttgagcctctgtcttgccctctaaaagggccactacccactccctcatccccacaggttgcgtatttctagggaaatactccatggagagcttgcatgcttgaactgtccactgtctgtacctcatcacagctcatattgaacctactgccagcaacatctctggtcacacaggatcaattatagagttccctcctacttgacagaaaacttgtcaactctggaaacctgggctaacaatgggagtctcaggggccaagtgggggtggggcggaaatggcggggctcctttcaagcccataatagtgaatattggaagaggaggaagtagtgatagtgttggggggcggggattccagcaaagcaaaggagtaatagagaagtggtcaaaaggcaaaggaggaagtagacgagagagttatacaagcagggcccacctctccccagaaaagacttggggatgagggaaaagaccttggagtcaatctggttttttgttgttgttttagagatgagatcttgttctatcactcatgctggagtgcagtggtgcagtcatagctcacgacagcctcaaactcctgggttcaagcgatcttcctacttcagcctcctgagtagctgggactacaggcacatgccaccacgcctggctaatttttttattttttattttttagagcctgagtctcattatgttgccccggctggtttcagacttctggcctcaagtgatcctctggcttctgcctcctgagtagctggaattatagtcttgagccacctcactgggctggttactaaaaccatccctagcgttagggtcctgggttggaacctggcaagagacctgcactagcccagggcaagatgtgtcggtgcgtgacatttgccacttctcccctaatgtgttggtagacgggctcccagtggctgtcctgggcaaacccacgatgaggccagagggtaggaggaagaacagcacgtcctctgagaaaagcccaaggagtagggttgtttctcctggaaaagagaaggcttgagggaaaaaccagatacttctttctctctttgaattcttgtagaaagtacaatggcttcatccagttgggttgagaacagagaaagtaaaccaataggaatggcactcctgcccaggatggatttaggttgaacacaaaacttcccaggagttgagggctgtgagttcttgcaaggttcccaaaaccgcctctaaaaacctttggaaggtagccatcctgacagagggctatagagaggggagcccttgggaatgatgtgtgtcctactgaacacaccctcttacccaggggagcagttttgattttagaactagtggaggatcagctgataatttggcctccttccccactgactatcaggcagtggggtgaaggggtatgtagatggagcagtgtgtctctggtttgatgaggatctttgggtggcaccaggcctaccacttcctccttgactggcaggagctgggggaagggagggagggtagacaggggccttccagtctcctgcacctccagctgatattcagggcagtcctggagcccagagtgagactcttgcccactgagaatcaatgagcttcaggttttgcctcctctggagagggacaaccaccttctccttagtggaggaaaagttaagaacagctccagtccaaaaacctgctggctggctaggatcattagctttgtcctgacccctgtgtgctactggtctccccaggctaggatttgtgggtagggaggggaggatgatttaatgatgtgcagagcacttgactcagaaccacgcaggcttggatccgtactgctccccatctgggtgactttaagcaagtcactgtccatcttcagtttctcatctataaaccagggggttgatcaccaagctgtcctacaaaactaaagaataaattctgtacctcaagtaggtaaaattggtctatgatgcagcctctcctttcccttaactgggcctctgtctcctttgatgcccacacccaacccctacagccccttcttgctctcagcaggtgacacagctaatccaaagattcccaccttttaaaatttccagtgttcctccatgatagtagttatgcttttctagtaacccactagaatacatttggtaactcttaaaaggagctgtgtctttttttttttttttttttttaagacagagtcttgctctgtcacccaggttggagtatagtggtgcaatctcagctcactgcaacctccacctcccaggttcaagtgattctcctgcctcagcctcccaagtagctggaatcacaggtgcccaccaccacgcccagctaatttttgtatttttagtagagccggggttttgccatgttggccaggctggtcttgaactcctgacctcaggtgatccacctgccttggcctcccaaagtgctgggattacaggcgtgagctactgcacctggctggatctgtgtcttttaaaaggatcacttggaacctagattcatttaaagaccttgctgggcaaggtggctcacatctgtaatcccagcactttgggaggccatggcaagagaatcacttgagtccaggagtttgagaccagccctggcagcatagcaagaccccaactctacaaaaaatgaaaaaaattaggcatgatggctcctgcctatagttcctgctactctggaggctgaggtggaaggatcgcttgagcccgagaggtcaaggcttcagtgagccatggttataccactgcattccagcctgggcaatagagtgagattctttcttaaaaaaaaaaagtcaatttaggagagaattctttctgaaatcattgctgggtgcttttatggattcccaaaccctggggatcctgaaggctggaaactacagaatcagttcttgctgactgttgccaacatggacctgacacccacacttgagtttttaggatccccaatccccacacttgagttttagaggatcccccaagtcctgagaggagaactactcccctacatgcctccagaggaaagagtgaatagatgaagcatctcaaaggtcagtgactgccaactcagaggccagaggctccctgggtttgtggagactgtgggagtcctctctgaggaaacccaaatggcaacttgtgaaaaatacacctggaccccacccctggaaactctgagtcagtaggtctgggctgggcgggcatgtttcagtttcaccagttccctgggtgattgtggtgctcagccagggccagtgcactgtagagatcaagagcagggctttggagtcagaccttgggcaagacgcttcctctctctgagccttgatttcctcatctctaaaatgaggataatgagagtcccctgatccagggctgaggactgatggagatctgcaagtgagctcctgctcacaactcctctgtcactgccatttcctttgcagcatgacccctcccctagtcacaccctctctccacccccaacccctaccgcacccaggcacaggaagctgacagtctgaggtcggcccagctctctggagagaggccctgagtgtctgggcatttaattcttccttgtcctactatctgacagcacgcgggggtcagagtctctgccctgggttcttcaggatccaatggcaaaagtgcaggtgaggtgcaggtcttagggacagtacagggcgacagaactaagctcaaataactgtgctgttatgtggcaggttctgtcctgggtcggggagggcattcataggtcctctcctaagactccctttttagagagatgaaaactgaagcccagtaaggttaatatgctcactgggatttagtcaatctctgtctggcttttgtattttgtctgcttcttcccatgaagtgtttaagttcattcaagagatacttaatgagcatccattaggtgccaggccccgtgataccacagtgaaaaaaacgcaaatgtttctacccttgtggtgctgacattctagtcagaggaggcagataataaactaaatgaaatgtacaatatgatgaaagatgatacatgacatggaagaaaataaagcagaaatgggtagggatcatggaggtcaggcaggattgggttacaggtttaaataaggtgatcaggccgggcagggtagctcacacctgtaatctcagcactttgggaggctgaggcgggtggatcgcttcagcccaggaattcaagaccaacctgggcaacatagtgaaagcccgtccctacaaaagatagaaaaattaggcccagcacggtggctcttgcctgtaatcccagcactttgggaggccgaggcgggtggatcacctaagtcaggggttcgagaccagcctggccaacatgttgaaaccccatctctactaaaaatacaaaaattagctggatgttggtggcaggcacctgtaatcccagctactcaggaggctgaggcaggagaattgcttgaacccgggaggcagaggttacagggaactgagatcacaccattgcactccagcctgggcacaagagcaaaactacattgcaaaaaaaagaaaacacacacacacatatacacacaaaaattagccgggtgtgatggcgcacgcctacagttccagctactcaggaggctgatatgggaagatcacctgagccagggcggtcgaggctgcagtgagctgtgattgtgccactacacttcagcctgggcaacagagtgagacccagtctcaaaagataaggtgatcagaggatattccacctggtcagggaatatatattccctgagaaggtgtcatctaagtaaaaacagggaggaggaaagggtttgagccatgcagtgacctggagagaaatattccaggctgcaggaacagtaagtgcaaaggcccttgggcaagaatatgcttgacctgctggaggaacattaagaaggcagaatggctggaggcaagtaaacaagagggatgaggtcagagaaggtgcagcaggccaggtcacatggggcctggaggcctgtggaaggactcgaacttttactctgaaaattatgggaaaccattggagcatttgagttagactttaggagtcagtcagaaacattcagtgaatgggggacattatactatctttggagtcaaggttgagattagagtcattgctgccctcaaggaatgtagaacacccagaaatgctcacacaaacagtgaacagcaaaagaatattattatagagcaacttaatagggcaaattaataactgggttaatggcaccctttttcatccctattgttttaaattttatcctaaagacaatatattctcctggtttaaaaaaagaaaacacacagaagaatataatgttaatgaagaaattcggggctgcgctgtggtagctcatacttgtaatcccaacactttaggaggccgaggcaggaggatctcttgagcccaggagggctcttcctgcctcggcctcctaaagcattgggattacaggtatgagccaccatggcctgggcaatataatgggaactcatctctatgaaaaaaaagaattttttttttttttttccagacagggtctggatctgtcactcaggctggagttcagtggcacgatctcagctcactgcagccttgacttcctgggctcaagcaattctcccacctcagcctcctgagtagctgggactacaggagtgtgccgccacacccggctaattttggtattacaaaaaaattttttaacttagctgagcatggtgacacatgcctgtagtcccaattactcgggaggttgaagtgggaggatcgcttgagcctgggaggcggaagctgcagtgagcagaaatcgtgacactgcaccccagcttaggcaacagagtgagaccccgtctctaaataaataaacaaaaataaaaatgaatttattataaaattaaaacatgttagtggtaattttttttttgtgggggtgtgtgtgtgtatgtgtgtgtgtgacagagtctcactctgccacccaggctggagtgcagtggcactatccttcctggctcacctcaaccgccacctcccaggttcaagcaattctcctgcctcagcctccctgtaactgggattacagccgcctgccatcacacccagctaatttttgtatttttagtagagatgaggtttcgccatgctggccaggctggtgttgaactcctgacctcaagtgatccgcccacctgggcctcccaaagtgctgggattacaggtgtgaaccactgcgcctggccaaatttgtttttttgtttttgtttttgttttaatttttagatggagtttcactcttgttgcccaggctggggtgcaatggcacaatctcggctcactgcaacctctgcctcctgggttcaactgattctcctgcctcagcctcccaagtagctgggattataggcgcctgccacaatgcctggctaatttttagtatttttagtagagacagggtttcaacatgttggtcaggtgggtctcgaactcctgacctcaggtgatccacctgcctcggcctcccaaagtgctgggattacaggcgtgagcccctgcacccggcccaaaaaaattttgaagtaaagaagaatataatgttggccgggcgcggtggctcatgcctgtaaccccagcactttgggaggccgaggcgggcggaacacctgaggtcaggagtttgagaccagcctggtcaacatggcaaaaccccgtctctactaaaaatacaaaaattagccaggcatggtggcgggcgcctgtaatctcagctcttcgggaagccgaggaaggagaagcacctgaacccgagaggcagaggttgcggtgagccgagatcacgccattgcactccagcctgggcaacaagagtgaaattctgtcttaaaaaaaaaaaaaagatgaaagtttctcccctcactctggagaggtgatcactgttaacagtttgtgagtcttctagattctttctgtatacaaataaacaggttgaaccatatgaaatttctgacacttgattgttttgacctactgaaatactagtttcatataattcgacctaatctttgcacatgtatttgacaaacatttcattctgtagcttgctttttttacatgccagtgtagtatgcatatctttcaatgtctgttcatataaacataacaaagatcacccacaacttttattaagcagtgcactatgcaccaggtactcttcactcaaaacagcctttggagcagaccctatcattatcctcacagaggaggagactaaggtgttggagaattaaacatttgcccatgagcacacaagtgggaaaagtgaaatctttccagctacatacagtggttcctgacatggtatacctgtttcctactggaagagcctcagtttgtctccattttttcatattataaacaatgcttaatgagcattcttgtatctctcccatgagtgtctgtaggttggatgattagaaatgctggggtggccgggcgcagtggctcacgccctgtaatcccagcattttgggaggccgaggcgggcagatctcctgaggtcaggagtttgagaccagcctggccaacatagcgaaattccatctctactaaaaatacaaaaattagccgagcatagtggcacgcgtcagcaatcccagctactcaggaggctgaggcaggagaatcacgtgaacctgggaggcggaggttgcagtgagccaacaccgcgccactgcgctctagcctgggcggcagatttggaccgcgtctcaaaaaaagataaggacacgggtagtttgaaaagaggccaagagacagcagatgagaatatataaaacttgaacacttgtcacttcagaagtggtcagtggatgttggcattattctcttgaggtggtcaccctgggttttaagtgctaggcattgagccagtggcaccccttagagtggggattggtattctatgaccacagatgtgttaggcaagactttcctggaattagtgataaaaccaaactcaaatggcttaagggagaggggatttattggctcacataaccaaaaactccagggataactgcccagagggaaatgagggaaaaaaaggaaatactcccttcctgggatctcccacttcccagtttgccaaggaaaactgagccccaggaggacactgaggcaaagtctcaatactttctccccctcctctctgaaaagagaataaaatgaaggcttggcacacacaccatctccgagacagtgctagctcctgcctcctaggaactgattccaaggtgaactgctggtggtggaagaagcccttcaatatagcatgtattgattgcacttgatgtacaaaagaggacatagatgctgagggacataaagatgaacagagaccttgtctccagagttcacaatccaacggaggagggagacttgacatcagtattctagtaggaaggcaacctgtgaaccaggcacatttagtttcaacctcagctctgccatttactcttaaaatttccaaacctctgtgtcttcacctgaaaaacaggcttaataatatttgcgtatataggtgattgtgaagactagaaatggggtataaaaagcgctttgactgggtgtagtggctcatgcctgaaatcccagcactttggaaggtccagatgtgaggatcacttgaggccagcagttcaaggccagcctgggcaacatatgcagacctctgtctctaccgaaaaaaaaaaaaaaagttttggccgggcatggtgcctcaggcctgtaatcccagcactttgggaggccgaggtgggcggatcgcctgaggacaggagttcgaggccagcctggccaacatggtgaaaccctgtctctactaaaaatacaaaaattagctgaatgtgatggtgggtgcctgtaatcccagctacttaggatgctgaggcaggggaatcacttgaacccaggaggtggaggttgtagtgagctgagatcatgccactgcactccaacctgggtgacagagtaagactccgtctcaaaataaaataaaataaaataaaataaaataaaataaaataaaataaaataaataaaataataaaataaaataaaataaaataaaaaacagttttaattaaataaaccacctcctacagtgaccggcatatggtaagtgtgcaatagtaactagtgactttttaatcatttacactgcttgtgacaaatgctataatagaattaccccaaggagattttattttcaccagatttcagatttcaacccctttattctaatatcatggatttgttcaacaaacccacatttcccctgcacaccattatgaccactatcccttctaagccttgccctctccatgtcatggaccatttttcatgacccttctttgagccctctcctctcccagagcagacacgcttaggtgataggcacactgcagccaggacactgagtctttgatggaaaccatgataaattggcagcttctgccctggggtggcagactaagtccctgcaaaccctgcaaactgtctagcattgtgggaagcacttgggctttggaatctgatggagatggatttgaactccaagctcttgttcagtgtgggtcttttggcaagttactgaatcccttgagcctcagtctccctgtctgtagaaagaggacaccaatacctaatgaagtggctaagagtataactgcatgggtttgaattccagttctgccagctgtgaccttgggtgagaaatatctcagggctgcaggagttttcatttgtaaaatgggtatatgagtagttgttatggtggttaagcaaatgatatgtaaagtactttagctcagtgcttggcacatagtatataagttttagttattactgaactgaacagtgtgtgtagagaactcagccaggatggggtgaggacaagcagagaggtggggagcagtcctctggcccagttttggttggggtgcagaaagacacactgccactctactctatcccaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggggcccagcttgtagggagcatctgtaacctctccccacttttccagcctggccagcagcctaataccttgccactccaactcttcgcccctgccataaactcctacttctgcctgctctgtccgtgactgctgtcccatcacgtccctcacatcccagccacctgcccccttcctgtccccctcaattcaccttcaatgtccctcatctctaatgaggtgggccccaccctacccataaccttccaccgaatccctgcccggccctcctccagcttccagggttctccacccttcccagactgtccccctgaactccccctccaactcctccaatctgtcactgtgtttccaggttcttggctcttagcttcctgctgggtttctccttctttgtcctctgggctgaaagactagagttaatctgttgtcagggggcctgggtgggtgtgggtgtgttgtggagggtggagtggttggaaccagctagttacctggtaatcagctcagggatcccttgagttagggccctggacttggccaggtggggagcaggggcatagatgaacccaagaaacccagctggagcctagtgtcgtggtagagctgagatatgcagtcagctgatttgcagccctggtggcaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtgagggtgatggcagccccagggactgaatcacttgggaccagacctaagcaaaaccatgaatgagaccaaaccacctttggtgccttcccatatcccctttctttctttaccatcttcccatgctggtatctgtcctcacccagctgtctccagatgcctagaactgcctgtgtcagagtaattttgccttcttccaggaaaactgaaattacactttcatgagggttctgctggtcctcactgtaggaaaatgatctgcaaattctgtttacacagaggtctaaatgccagatacattactgagcattactggcaatctaggaagggtgcttttttttcctttaccttttgccacttcttccaggacaggacggatgctttacaaggcaaggggagacctttctgagacaggaggttactctggttccagattttccctttctgcctttcttctggaaagccaggacaaactcagctaagagacccagggatagggcatcctgggagaaaaggctgggaatctggtccctatctccttactcctgggtgaagccagggaaggcattttcccatccacctgtaccctccctcttatcctcacttccctcccctgcccatttggccttgtgaccctttagtcctcttggtggctgtggagatgccagggtgactttaggtctttagagtggggtttacaggagagggggcttctgtacttacaagaagccctagcatgtcaagctccactcacatttgtcctggcttctgtttgtgggaagggtgatgaagggaaccacccgagccctgaaccagtgccctctactaaacacccaaacaagacccaggatcccccagaaagtcctaaacagagtgtcccaaaaagctgctggggcaggtgagggacatgtgtccatctgcacatacacttggctggctgcccttgttagacccctgccagtcagggcaaggtggcctcggaggccaggaggttgtttgcttctgcgatcaacatacagagttaacaactgcagcaggatgtaccccagccaccacttccggttcctctgtaacaggtttcctgtccctgcccagcttacctctactccccactccccaacgcctacccctaccccaaatccccttcctctcccacaagggaaagatccccagggttggggattggggcttggaataaggacctgaatgggattcaggagatcagaatcgggttctggctgcccccagtttgctgtgtgacttagagccagtcacttccccctttgggcttttttttggtcatctgcaaaatgagtgattggatgagagggcctttgcactcccttgacactttctgtgatttattgcctctttctggaccccagatctcaggtccccttcaccttgcccttaagacaggaaggagtgggactggaggttgtggacggggagagaaaacctgagttggggttggggctccaggatcctctcccaggtcttttccctggctccataacattcggtcctctggccccctcaacgctctgtcccctgtttccctctgcccaggctctgggagccagatagagcactccctggtgttggtgctggcaacaccacctgctgcagctaccaggccttccttctcctgctccaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcaggtcaggcaagctgggaactaggggaagcacacaaggtgcagggcgaaggggggcctgggaagcctctgacgtaactccggctggcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgaggggcaggatgggggtggaggacatctcagggcccagagtgtcctcaggggcatgagaagacaagggggtcaggagaggggcaaatggagaaaagccacagtgacacaaattcctgcttagattagtgtgacccaaatatatccggatgcctcaaggccattctcatccacgtcagcacttaaaactaaaactgcaactcaagcaccaaagtaattggtgaataatatggaatttgctcaagatttcagaggaagtggcttatatctatactacacagcaaatctttctaaaaatcccttttaaaggtttttcttcttcacccatattccattccctttagcaactctgtacttccctattctccttccatacccctctcctctgtcttccccttctgtttcctcccttgtgttcatcactattttagaggcttaaaacacaagcgtctttactattttaaataatatgtatatatgtgtgtgtaacatgaaacttcccattttaactattttaagcgtacaattcagtggcattaaatacattcatgaaattaaaaaattcttttgatatataacagatgtacatattttcagggtacatgtgataatttaatacattcatatattttataaaaatcaaatcatgtcattaggtatcctttacctcaaatatttctttatgctagaaacattcaaattattctcttctattttgaaatatacaatagattattgtaaactgtagccaccctactgatctattgaatcctaggtcttatttttcctgtcaaactgtatgtttatacccattcatcaacctctctttgtcctccccccacacttcctggcctctggtaccactaatatactctctatcttcatgtgatccacttttttagctcccacatgtaagtgagaacatgcgatagttgtttttctgtgtttggcttattcacttaacaaaatgacctatggtgccatctatgttgttgcaaatgacaagatttcattctttttatggctgaataatattatatatatcacattttcttaatctatttatccacttctgggcacttaggttgatttcatattttggccattatgaatatctctgcagtaaacatgggaaggcagatatctcttcaatatattggtttactttcttttagatatatacccagcagtggaacttctagatcatatgatagttctatttttagttttttgaggaaccttcatacagttttccatagtagctgtactaatttatattcccactaacagtttatcagggttcccctttctccacgtcttctccagcatctttttacagaaaagatattcttggccaggcgcagtggctcatgcctgtaatcccagcactttgggaggccgaggctggtggatcacctgaggttgggagtttgagaccagcctggccaacatggtgagaccccatctctactaaaaatacaaaaatcagccgggcatggtggtgggcgcctgtaatcccagctactcaggaggctgaggtaggagaatcgcttgaacctggagatggaggttgcagtgagtcaagattgcaccattgcacttcagcctgggtgacaggagtgaaactctatctcaaaaaaaaaaaaaaaaaaagatgttctctattttttttgtaaaaagccattttaactgggatgaaatgatatctcatttaattttgatttgcttttctctgatgattagtgacattgagcattttttcatatctctgttgaccatttgtatgtcttcttttgagaaatatctattcagatcttttgcccatttttaaactggattatttggttttttgttacagagttgtttgagctccttatatattctggttattaatccctcgtcagattgatactttgcaaatattttctcctattctgtgggttgtctcttcactttgttgattgtttccatggctgtcctgaagctttttagcttgacataatcccatttttctatttttggtttggttgcctatgcttttgaggtcttccacaaaaaatctctttgcccagaccaatgtcctggaatatttctccaatgttttcttctagtagtttcatagtttcaggtcttacatttaaatgtttaatccatttttatttgatttttttatatggtgagagataggggtctagtttcattcatctgcatgtggttatttagttttcccagaaccatttattgaaaggactgttctttccccattgtgtgttcctggagcctttgtcaaaaatgagttctctgtaaatgcatggatttatatctaggttatctattctgttccattggtctttgtgtctctttttatgccagtactatgctgatttggttactatagctttgtactacattttgtttttttgttttattttagagacaggatttttctctggtgtccaggctggagtgcagtggtatgatcataggtcactgcagcctcagtctccttgggctcatgggatcctcctgcttcagcctcctgaatagctggggctataggtgtgtaccaccgtggccagttcgtagtgtattttgaagtcaggaaatgtgatgcctccagcttcgttctttttactcaggcttactttggctatttgaggtcttttgtagttccgtataaattttaggattttttttctatatctatgaagaatgcctttgctattttgacagagattgcaccaaatctataaattgctttgggtaatattgttattttaacaatattaatttttccaatacatagcatgggatatctctccatttttttgcatcctcttcaatttatttcatcagttttatagtttttcttgtatagatctttcactttggttacatcgattcttaggtattttacattctttgtagctgttggaaatgggattgcactcaacttctttttcagattgtttgctgttagcgtatacaaatgctactgggttttgtatgttgaattatcctgcaactttactgaattcattcatcaactctaacggttttttgttggagtcccttttttttttttttttttttttgaggaggaggaggagtcttgcttttatcgcccaggctggagtgcaatggcacgatctcagctcactgcaacctccgcctcccgagttcaagtgattctcctgcctcagcctcccaagttagctgggattacaggcacctgccaccacacctggctaattttttttttttttgtatttttagtagagacagcatttcaccgtgttggccaggctggtctcaaactcctgacctcagatgatctgcccacctcggcctcccaaagtgctgggattacaggtataagccactgtgcccggccttttttttttttttaagagagagacaggatctcactgtattgcccaggctggtgtcgaactcctggcctcaagcaatccaaccacctcagcttcccaaagtgttaggattacaagtgtaagccaccacgccccatggagtctttagatttttctaagtagaagaccatgccatctgcaaacaaggctaatctgacttcttcatttccagtttggatgcccttcatttccttctcttgcctaattgctctggccagaactcccaatactacatggaataaaagtggtaaaagtgggcatccttgtcttgttccagatcttagaggaaaggctttcaatttttctccatttattacaatgttagctgtgagtttgtcatagatagcgtttattattttaaggtatgttgcctctatacccaatattttagggcttttataacacgatgttgaatttttttagaaagctttttcagggtctattgaaatgatcatatatggtttttgctcttggttctgttactatgatgtgtcatgcatattgatttgtgcatgttgaaccatccttgcatccctgggatgaatcccatctgatcatggtgaaagatctatactcacaatattgtacaaccatcaccactatctatttccaaaactttttcatcacaccaaacagaaactctgtacctaccaagcaataactcctcatactccctgaccccagctcctagtatcctctattctgctttctgtctccatgaatttgccttttctaggtatcttacataaatagaatcataaaatatttgtccctttgtgtctggtttcttttacttagaaatgttttcaggcttcatctatgttgtcaaatatatcagaatttcattcctttttaaggctggataatatccctaacagtgtgtgaggatctcagtttctccatttccttaccaacagttgttgtttttccttttaaaaaattatcatagccatcctaggatctgtctaattttgtcacataaggtgttactgtggaaaggagcacggatctacgcagaagtccaagcctcatcactaacagactaacagtgtgaggtggacaatcctggagctcttagtgcctcagtttctttctctgtaaagtggagctaataatgcctgcctggcaaagctgtataggtggagtgaagataatgatgcatataaaatactagtacagactctagaatgtggtagctattattttccacagaatgtaaacttaatggaggcagagatttggtctgttaggcacaccttagtatcccaacccctggagcagtgagtggcactcagtaggcactccaaaaacatctgcggaatgaatgaatgaactcttaacaagcagggctatgtggaagtgagttgtcatggatagtgaggaccctgttactggcagtgttcaagcgtgatctgcataaacactgagtggcgattatgtactgggccccgtggaataatagcaagatggaaacgcacccacctagccttcaaagagcaaaggctacagagttgtggggacttaagtcccccataacttatgatgcaagccatgcaggctcctcgcagagtggggtccccagggaagatagccaggagggctaggggcttgagctggagcacccttggggcaggtggggccctgacccagtgaggccagcctggctgcggccacctaccctgtgccaggtgctgccagaccgcgacggaaagcgctgcatgttctgtgtgaagacagccacccgcacgtatgagatgagcgcctcagacacgcgccagcgccaggagtggacagctggtgagtgctcgctaggtggcttgggtctgggtggtccttaggcgcctcatctgtgaaaagggggtgataatactttgtccagcgggaggttggagagtggactcgggaaactcctaaggcccctttcgggccgtgtgcgaggatcctactgacccgctcccgctcttcggcagccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggtggggttagctcccggcgccggggacgggaccggtgggctgggaggctggccaggggcggagcgccgggggcggggcctgggcagagggcggagctcctgggttgaggggcgtgcactggggtggagcttgaaatgagggattgttgggacagagtccgcgggtttgaaaaagagatttgggatggggcttccgccagggacagaacctggggctaggaaaggggtgtggggcgaggtccgagcccgtggatggatggggcctggttcggagaccttggctgtgggttggggcttgggcagaaggagccgttgaagaccgtgtgattggggattagactggaccaagtttggactagacttgaactaagtttacagtgaaaccagtttgagaggcaagcgggacgcgtatggaggcggactaggtgtgcagaggcaattagatttaggatttaagaaacctggatctggagtcagaaacacgtagattcaatcctagctctgcttcttacgagccccgtgatcccaggcaagttcattttactgagccttatcagtaaaatgctaatgctaatagaactttgctcacagaggtacggtgaggattaaatgaggaaacacttgtagtgtccagtaactttttgttgtaataattgtagttatagtcacatccttcctagcatcagccatgattataacatattattatatattataataattattaagttagtgctaggaaggagatgaccatatttttatatcttatttaattatataatgttgtttaattacatgttatataattatgattaaggttggtactaggaaggaaataacttgagcccgtttcccccacgtggcatctgttcaccgaccattatctgttccagtcaggctctcagaaaggggtcagatcaggaaaccccaacatgaaggagttccccagaccctcacccctaggcagcttagcaacatgcccaccccctcctcctccgcccccacgtgccccttttgacctggctcttggtccaccacctcccccctccacaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccaggtaggcctgaggaacctcttctggttctctcaccacccctcctggaacacaccccagttttcctgcttgctgtgcacctgcaaggtgccttggcactagaggctacacagtacacactcacccggcagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggtgaggcctggggtgggatggggtggaggctggcagggtgagctcattagggcacaggctctggagccaggctgccttccctcaaaccctggccctagcagctgctggctgtgtgactttggacaaatgcccaaacttcttggagttagtctctcacctgggaaactggtaatagcgttgttatgaagattaaatgagatgatacatgatacttagtacgtagtaagtgctgaagaaacatttgctgctatctttgttcacatcattattaatctggggaaaaatttttccttctacccttccaagcccctgtcttgctatccttgtactttggctctactccttggagctttaatctccataaattcaaacacagaaatatggaacatagaaagggaaaattcctccatgatcccccccacctcacaaccactgctaatggctccgtgaaatgttgaacagaggttcttggattaggtgctggaaaggtggtgtagtgcagtggcttagagctcaagtgtatccctgggcaagtcacttaacctcttttgaacttttttgttgttaacttctgctctggaagttaaataagataataaatatgcttagcacatcttagctgctcaataaacggaaactattattatggttacattttatcttttggaagtccatgagtcccatgaaattggaggcaaactctattcatgtatgtattaataactctatgagcatatatggtttttctctggggagatgatcagtagtcttggtcagattttaagcagcctgcgaacctgaaaagatcaagactccatgccatggatgatggttctgatcactccccactggccctgtccccacaggctgcccagagaaaactgcgccaggccagcaccaacgtgaaacactggaatgtccagatgaaccggctgatgcatccaattgagcctggaggtgagaaggaatagactctggagctttccctggagctgggagggagaaaggagggagaaaggtctccctgggagacctccagatctcccagggccagcaaaagcaggactggcagtcaggaggctcccctctcctctgagggctgaggcaaggcccctcgcctctcacctttgcatgcctttctccttacttgcctgccttctctctgccagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcctgggctaggaaagagagaacaagcaagccggggctacctgcccccaggtggccaccaagttgtggaagcacatttctaaataaaaactgctcttagaatgaattattggctcaggtctgtccatctctcctgccatttcctcccttcctccctcaagccccgttataggttccaaagagcagtaaaagtataataaagtggttaagaaagaccctgcagctagactgcctgggttctgaacctggctttgctacttactaactgattgactttggtcaattttctttatatctctgtgtttcagttcccacgttggtaaaatagagataatgactgtacttaccatatagggttatatgaggattaagtggcacacgagcaagcaccattattagaatcagccaaaagtgtttattgagtgtctactgcagttttccaggttatttaattctcatgacaactcttagagctggaaatcaccattggcattttacaaatggatgaattgaggttcagagagatttggcaactttaccaaagcctttcagacttgcttttcttcccatcatctctgactcgctgaccttgttagccaagacagagatctgggtatttaggaagattcatgtcctctctctcagccccctcatccaaaccccatcatcaaatccaatagactctctccttcctactctcctatctgtccctccttttccatccccatggctactgccatggctgaggcctttgtgttttctacctggttgttaacctttaactcctcctccgtcttgcccatctcaccaagtccaactgattggacttccttggttactctcagatccacacttttgaggccatgtctgtcatggctactgccttattctggctcttgtcacttcccaactagataagagcagtaaccaggtctccttgtcaacccctctccccattgccacctggataggatttctaaaatgcagatttgtccttcactcttcctaatttccagtcccttggtggtatcctagagttttgatatttaaattcacattcccatatgtggcagatgaggcccatggcgatctgtcccaggagggcctcctatgcctctgccttatagagctacttgcagctccctctaggcctcacactgacttcctttcccccatccttgtaacagccttcataactaaatgcttgagcccctcaagggcagggacatatcttcttgaactaagagccacggtgattggctcttagaaggcatgcaacaaatatttgtcaaatacatatatgaatgaataaattctgaagtgaataattcaggtgtcacaaagctaaaaagttatagagcagctgaaattcaagttcattcgttttccaggtccctacaagagacagggtctctacaaaactcggctggcctccaactcccgggctcaagcagttttcccgcctcagcttcccaaagtgctgggattataggcaggagccaatgcactctgccctcattcaacaaatgtttattaagctcttattatatgccagcttctggctatattgtacagaacaaaaacagagtccctgccttcctggagtttatgtgctatctgattttttgaaaccaagtctccaggctggagactgtgcctgatcagtctccaggctggagcacagtgcctgatcagtctccaggctggagcacagtgcctgatcagtctccaggctggagcacagt

SEQ ID NO: 17467 - DNA, 10738 bp, Human
tgcacatttttctagggaaaggcccataagtttcattagattctcaaagatgacctattgctatatactatcatcatgggtaatatgtttaccagaactttcctaattataaatgcctctgtttagaacttttgcctaacaggcatattcagatacggggatcagcagttattctgggtggtgtgcgactagggtggatagcagagttggtggctttagatttaggaaatttgagttctaaaatcagtgctaccagtaatcggtgctgtgactttaagcaagtcacctctctgggccagtttctgtcgcctaggctggagtgcagtgacatgatctcggctcactacaacctctgccttccagattcaagcggttctcccacctcagcctcctgagtagctgggactacaggtgtgccaccatgcccggctactttttgtatttttagtagagaccaggtttcatcatattggccagtctggtctcgaactcctgacctcgtgatccacccgtcttggcctcccaagtgctgggattacaggtgtgagccaccgtgcccagccagctctggtgttttaatcaaggaaaattgctctttggaactgcagtgtaagagagatggccgtgctgcatttcccagtactcattctccccatgcagggacctcatggagctgcctgcatcctcaggggtatgcttccttctggtctcttcctttgtcctgggtcacttacctgttgttgggacgggataaggaatgggtcacctccagttacctgaggtattaatatttatttacacccctgtcctatctccccagtttcctcatacttctgtgagtctctgtgcatagcattgtgtcctacacataatatatttgcggctggtgattatggatcttttgttgattctcctggctccatgatatttcactaaaatttaatggaagaagtattactttaattacaccttgaatatttggtaaaggactggcatagcaaagacatgatagcagagaggtgtaagtgagaagtaccaaggacctccagttctctacaaaagtaggcacgaaaagctttatgaaattcgtattcaaggctgccaatatttttttctttttctttttcttttcttttctttcttttttttttttttttttgagatggagtctcgctgtgttgcccaggctgtagtgcagtggcatgatcttggctcactgcaacctctgcctcccgggttcaagcaattcttgtgcctccgcctcctgaatagctgggattacatgcatgtgccaccatgcctggctaattttttgtattttttttttttaagtggagatggggtttcactatgttggccaggctggtctcaaactcctgccctcaagtgatctgcccaccttggcctcccaaagtgttggtattataggcataagccactgcgcccagccctcaatgttgtttctgtctagcagacctacagggaaattcagattcttccctcagcagaggcaaatgactgtaagagatgtccctcagggatgtacagaaataccgtatctcactgattctaagaagcacacttttccgcattttaatacttctgaaatcatgatgtgtcttataattcatggcagcttgtaattcattgacagcccttttttctcctcttagtgctaagcacataaaataacactatgcttatatcttagactgcatcttaaatatgaggaaatatagtagttgagatgattaatgttaaatgcaaaaatgccaaaggtatcttttagtgtagtttatctgaaatagagagtatgttgaaaggagtaatgtgaaattaggctggaagaaagatcctagctttctagagaaccagattgatgaatgaaatgtgggtactatgtgaagaagagtgtttatataacaatgtgaaatttattatttaaagaattattgtttctgtaattgaaatcaatcttatttaaatttttattttttaaaggatgagaaaaatcagttaatgacaacaaacgtctggttgaaacaggtatgtgtgtaaaattcaaacgggcacccaattagtgactgggacacctatttttattatatgtattgtagcagaaatacaagagtatgtatatttgtgaatacaaatgaatacgtgactatatggccttggtggattggcaggacacagaaagatgagggtagatggagttcttgtatttattcagctagtatttttggagtgcctattgtgtgccagacactgttatggggaaacagcagtgaacaaaacagacaaaaaaccctgtagtattagtccgttctcacactgctataaggacatacccaaggctgggtaatttataaagggaagaggtttaatggattcacagttcagcatgactggggaggcttcacaatgatggtggaaagtgaaggagaggcaaaggcatgtcttacatggcagcaggcaagagagcatgttcaggggaactgccctttataaaaccatcaattcaagatgagatttgggtggggacacagccaaaccacatcacctgccctcatggaacttcattctagtgggggaaaaataaacaagttgtatagtaccttagaagctgataagcttggggaaaaacacactggaaaagaagatagggagtattggggtcgggggtgtacttataaaaatggtggtcagagaaaacagcattgagaagataatgtctgaacaaagtcttggtggagaggaagcaagccatgtgtatatctggggaggagcgttccaggcagcaggacctacaagtgcaaaggtttctgaggctggtgtgtgcctagtgtgtttaagcagttgcaaggaggccagtgtggctagcagtgagagaaccattggggagagggggtgtaggagatggcatcagataagcaagaagaggctggtggagtagcagctgcttataggccactgcaaggattctgactctctaaggtggaaatgggcaagaatgaaatgaatttttttttaatagatagtcccttttatataaaggacttttgtttttttctgggccaccatacatatgtcctaactgctgttgagcgcttccttttgtttttatcatccctaatttttatacctactatttgttttctaaccccgaactcctgaaaggcatatatgcttttctcagggtgcagctcctaacttgatcacagaattgtaactgcatggaggtagggtaaggtgttgaaatacgcagaatgtgcaataaatccaactcccttttgcatggaccagaacagccaaattgggtgacaatacatctggaaaaaagaatgtttcccttgaacctggatattaagtgcctgtggcttcaagtcctggatatagtcagtcagttgatgggagaagagttgccgagcagagccatgaacacatctagctctggttctcacctgtgtctcacagggaccatggtgagaaccactacacaaggggacagggttatctggtgcccataataagaaagacagggaggtgttctctattgggggtagagatgatctcatgtctaaaatttctggtgtgacaaaaaagtatggtattcactgtttttgactattagttttattgaaattgaggcagatttctttgttttaaaggaatggatagatgtaaaattaagatggaaccctgatgactatggtggaataaaagttatacgtgttccttcagactctgtctggacaccagacatcgttttgtttgataagtaagttatattctaaatatagttttatattttcaaaagaaaacatttgtatttctattaggcactaataatttttctcccttttgaaattgtttaggtataaaaatcaaatgacatgaccgcatgtgcctgggtatgattacatgttttatagatgaggaaacagaggcttagggtggttgttcttttccaagatcacagagctagcacatggcagagtaggggggtcacaccaaggggactgatacctccatttactctttgttttactagactacatatttggcagacttctagatttttttgtatgttttttacgtcattgaggtcatattttatgttgaattgtgcatccttctagttgtgtttaaatactgtatcgtcattttcccacaatgaggaatgctgggttaattatcaattcatctttagaggcatcctacctaggtgtgttttgaggatttttttttttttttaacttaggggagaggaaaattctgggtaccagttttatttttttctaagaccactcctgggcaaatctgggaatttgtgcttatcttaaagcactttgtctgattcgaaagaaggccatttggcatgaggacagagcaactgctatgcaaaaatatctttaatcttttgacactttttacctccatgcttcttaagaagtgaacaaagcttgtaaggacacatgatgcagcttcctggagcatcattttattttcagtaattgaaaacatttttatattaaacatggatatattacagaatagtgtgcaaaagccacatgaatttgaagacagcaacattttaaagaaatcttatgttggtggtgtgctttcctagtatatggattctatactagacttttctcatatatgaattcacttggtgggagagcttgagaggcatagctgcttttcagggtcatgcccagcttggtgttcatggtctttccccatcaaagtaaaaaacggccagtatttgcgatgaaggaagaagagcactgtggagggagtctaggagtgtggattcaggttctggctgtatgcgtgcccattgtgtcaatagcctgagtctattctgtgtgtaaggtgaggtcttttcaatcattagaatctcaggcttctgtgaaaatttgtcagttctggagtagatgcagaagaaggggttcagttctagtagagttagatatttaaggaagatattcctggagcagggtccctatgtagcacgtatatcttatctgaagtatagtaatttaaaaattatttcatgcaatcaatgataggcctgcttttatattaggcttatattaatacaattcatgtgcattgtttaatttctgcattgttattttatatgtgtgtattttagtgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggtctgtgatgtgtatttacaaatgcagatcttcttccattttaagttcagaagttactttcattaattttggcagagtaaacagcatgacccttaagtaagactaagcatagattgagggccagaattgttgacatattttctataaaagatctttactaaggcttgtttcagttaaagcacctgcaaaatggggcatttacacaaatctcacttctccacttcccccatcagcatcttggataactctaaagaaaatttagtgttatattctaaggaataatcctgccatatttcttggctctgacctgatgaattgttttaatttcttggggtgagggcagtgggtgaactgttttaattttgtcttcagtaactttgtttctaaattgtgataatctgtaggcagaactccattataacagttaatggagttatcaaaagttcttttaggctgggcgcagtggcttcatgcctgtaatcccaccactttgggaggccgaggtgggtggatcatttgaggtcaggagtttgagatcagcctggtcaacatggtgaaactccatttctactaaaaatacaaaaattagctgggcatggtggcacatgcctatagtcacagctactcgggaggctggggcaggagaatcgcttgaacccaggaggcggagattgcagtgagccgagatcacgccattgcactccagcctgggcgaccgagcaagactccgtctcaaaaaaaaaaaaaaaaaaaaaaagttcttttaaagaatgagcctaatgtggaatttataagtataaaattcagtcttgtcactgttatttcttctattgtgtgttattttaaacctatgactatagtaaattttcataattgaatgtacattaaaattatgtgaattataatctgtaaagctattttaaatggaaaatttccatcaggtatgaggagacagaataaatctggcaaaatcacagcctttatcccaaaagggacatttgatgtatatatttttaaaactttttttcatatgttaatgatttaatttcaataagactttccttccttattttattgtatttcaataggtttttggggaacatgtgtttggtcacatgcataagttctttcatgctgatttctgagactttggtgcacccatcataaaaacttctaatgcttgtgggtttgtgaagtatctatttggtggtagcataatgaaattagtttataaggtttggagctatcaatggagtttttaaaagtacatagatttgttaggtaatggtttagactgagatggaatttaataaatgtctgcaaagtattgtgcaaaagggtcatggctcatactactaggaccaaggaggttggttttattttcagataaaaacagaggcagaggtggccaggtgcggtggctcacgcctgtaatcccagcactttgggaggctgaggcaggtggatcacgaggtcaggagtttgagaccagcctggccaatatggtgaaacactgtctctcctaaaaatagaaaaattagctgggcatggtggtgtgtgcctgtagtcccagccacctgggaggctgaggcagaagaatcacttaaacttgggaggcagaggttgcagtgagccgaggtcacgccactgcactccagcctgggggacagagcaaggctctgtctcaaaataaaataagcagagaagtaacagggtttacaatgccctaaattctaaattatcctacactttggaggcacagttcccatagaggacaccatccttcatagaggttcagggccagggaagcccctggtcaaggaaatggccttgtagaaaggggagcccctgctgcttagtggctgggctcatccttctttttccttgtggtggctccgagctgctgagccagctccctactaaagctggctccagggaagactgttctgtgctcatgaaattagactgaagtggtccctaggaaatccaaaaataaataaagtgtgtatgtgaggaagatgaacagctttctaacatgtattattctgaaccaacttttaatttggcatgaaattaatctcaggctagagtctctcaaaatattaaaataagtaaacactactgggcaagaataagtatatatagtaagaataattttttttagtttattgtaaaatatccaagtctattttaatttttaatctatcaaaataaaccacttgtaatataagttgatgtgtaaatgaacatattttgtagtgtcttttaaagcttatatctatagtagaccttcaggctagtgtctgtccctgagctgagtatagggtcacttaccgtttagaggcagcaatgggaggcagaaatcgatttggcttctaactcagtgtgtttgttatatcttaaaatatgtacacaatttacaattatttaatgcatttttatttttttcctaacaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgcactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatgtgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaattgggaactcctttaaggcttactttattctttagatgcttaattattgtgttaactatttctgtagcttagcttccactgtaaagtcatacagtagacaactcctgtggacacgcagtagcatatccttaacattaatttcagtcctcttgtccacatttcccacaattaatagaaccatcttctatataaattgtggtagtatctctttatccttgatcttagaatagtcagtccactacaattacatgaaccccatttaaaaaacatatttagggccgggggcagtggctcacatctgtaatccaagcactttgggaggctgaggcaggtggatcaccagaggttaggagttcgagactagcctgaccaacatggtgaagccccgtctctactaagaatacaaaaaattagtcgggcatggtagcaggcgcctgtagtcccagctactcaagaggctgaggcaggagaatcgcttgaacctgggaggtggaggctgcagtgagccgagactgcgccattgcactccagcctggcaacaagagcaaaactctgtctcaaacatattttggtctaaatcattctgtgagaaaacaatcttctaatatgaaacacagtattctaatttggtatatgcacactgttatatacctgtaatatttcagttttctctccttcattctaacaattacaataatagaatcttagagttgcaagggcctttagatgtaatcaatcttagcctattactagtacagcgtaaatgatttagtacagtataatgtatcacagttaaaacagttaaattccatctctaaatgtcaccacttcaggtgtgaccaggtagcaaacactgacagaaaccctcgttcaatttagaactcttagctgttgagatcacaaacacctcatttatttataataagtaacctatctaagttcaagccaatgctctttggaaggcggaggagaccctatctaatttgcatttaatcgtaggcaggtgtttaatgccatttaatgagtgaaagcctggtgtgatgaatttagattgcctgccagctacctaccttagttcgtatacatccctgatccctcttatactaccattactgttacttatgatttttatatataaatttttatcgacatctttcttttgacttattgaaacatgagtcacagcgggctgcaattctgtccattttatttttgcacaggaaaaactagtgagacaagattcaaacagtctctctctg

SEQ ID NO: 17468 - DNA, 88906 bp, Human
  misc_feature (1)...(88906): n = A,T,C or G
agcctctccgcccggcagccaccccatctgggaagtgaggagcgtctccgcccggcagccaccccgtccgggagggaggtggggggtcagccccccgcccggccagccgccccgtccgggagggaggtaggggggtcagccccccacccggccagccgccccgtctgggaggtgaggggcgcctctgcccggccgcccctactgggaagtgaggagcccctctgcccggccaccaccccgtctgggaggtgtgcccaacagctcattgagaacgggccaggatgacaatggcgactttgtggaatagaaaggcgggaaaggtggggaaaagattgagaaatcggatggttgccgtgtctgtgtagaaagaagtagacatgggagacttctcattttgttctgcactaagaaaaattcttctgccttgggaaaaaaaaaaaaaaaaaacttctgaggggtgagtttaaactgtttgccatgtatcatatgacctcccccagggcccagagtaccctaatgtctttgtactcgtcaatgttttgtgtgggaagggtgcgggcagtccttagggagagctgagtttcctctccagacttctgaactgtggtacgcaacagcctggcaaaagcagaaacccagaggcagagatatttaggagaatataaatccccagatatttgcaaatatgttaagggagggactctgactttcaccgtccatttttacctcaatctcaaagggcaaggaggttgacatctaagttacaaatataatgcacaagcatttcaaaaagtaggggaaaaaaaagaaaaagaaaaagagaagcagaaagaagggggaaaaaatcactcatccctgccaggcacggtggctcacgcctgtaattccagcactttgggaggctaaggtgggaggataacttgagtccaggagttcaagaccagcctgggcaacatggcaaaaccctgtctctactaaaattacaataattagctgggcgtgtggcgcatgcctgtaatcccagctacttgggaggttgaggcaggataatcgcttgaacccgggaggcggaggttgcagcgggctgagattgcgcaactgcactccagcaggggcgacagagtgaaactgtgtctcaaaaaaaaaaaaaaaaaaaaaaatcactcatccagatagctaggtgtggcctaaggagcttgcggcctacggaaggtgtggccgaaggagaggggaggggtcatctttaatgatgatggaggggaggcattggtcatatacctgagagtcaagctttgttcatcgtcagatgaaagccaacttcttccaccagattgcctcccagctgctaggtagtttcctgtggtacatcttaagcggtaggttgggataataggtcccttccaggtcttaaagatgtggattaataagaacagaattttctacaacaataaggaggatgtcccctattttaggtgaataagcgtattgcataagcacatgggaagaaaggttaagaactctaagaccgtaaatttccagttgtagaagcctcttgaaggcggaaagcccttttttgaaaattataggcgatatgatctcctccagtggacctagcactgggttaagagtctctccagacttgtcactgcaagtcacgtaccttttctaggactaagtttcttcactggaagatgaggaggttgcactagatgacctagaaattcccttccagctttaaattccctcttgtgtcacttgctggacttgttctactggacctggcgctcccctgctcctcccttagctgctacgtccgcatcccgcaccagagggcgccacaggctggcccggggcagcgtgcggtgggcggagaggcagaattaggggagtctccaggaggcgtggtgattggccgccgccgggcggaagggggcgtggggagggaaaggccgagcagcgcggtgacgtctcgctggcgggggcggggccgggccgcggagcgtgtgacgctgcggccgccgcggacctggggattaatgggaaaagttttggcaggagcgggagaattctgcggagcctgcgggacggcggcggtggcgccgtaggcagccgggacaggtcagtccgagacgagagaagcggtcaggcaagtggcggagggaagcgccgggcctgggccgaggcggccagcgggactggggcgcaaggcccggcggcggggaacggggtgcggggagctgccggggtccgcggacagcgtcacggcggcttcctgatgctccggcccgctccggtcagccgtcgtgcgttgccatgtaggcgccccgctgaccctgcgcccccccgcccttggacccccatagctgcttgagtgagtccgaaatacgggcctccttccaccctactctttgccccctcttgggcctggtggcttcgtcttctcccacttgtgagaaccccgtctcaggcccgggggcctctcccattcccctcccctgcctctgacctcttccttcacccgtttctggtgttcctgaatccactgccctatctagcgagagtcttctctgggatcttttcctctgtccccctcgttatccttgtctcctgccttcatcctcccatccttgctctctcaggctttactctctctccccatccctgtccccttcttatctgtggtctgatccctcctagtattatgggtccccatcctcttccccagggtgttcctaggctttttccaactccgtgcctgcagtccctgtctccctaagactctcaccttggttccctgagaggccctgtttttgctcctttttccgatttccttcgtatcaattctgtcccctacattcctgtcgcccacctccttttctctccctgttcctttcccctgcttcagggagaagccttagctccacactctactctactttcacttgacctgcagttgacataaccatggggtgggggtggaggtgttcagaccttgatcgaattaagaggctgattgactaaaggaaataacagattgtgtgggagaatgtacgtgggtgttgcatcagagatgatgtccaatttgtaggccattcttcttatctcagctttaatacttcccctttatggggctgttgacttccaggaacccttgggggagacggcgctgagctggatgtgtgccacgggtagccggaggctttgtccaattcttttccccttccaggaaccggggttttgtgtctttccactctggatgtgtggaatacacttataccatgataccccagcctctctctgccctcactcccaccctccaccctgtgctccatccgaaaggactaagagaattctccagaagctgtgctccagaaaatacttgtggtcctcaaccttttttctgtgtactggctccagaacttttttttttcccgtttgagttttgaaatagattgctggcctgatagccctggggctggcgggcatctgtccccttttattattggtggcttgaaacagctgctgattttctctcatatctctttgacaatctttggccaactgaatgtgcctctgatgttggtcactgaacatgttctcttggagtctcttctccctcttttttctttgttcttttctgaatctagggaatccaaattgtccctctttttccctgggagcttaatttcctctgtatccaggaggaacggcaatcccagagctctgttccctttgcccaggcatagtatgaggtatcagattgataactaccctggtgggctgtggggctgcagtagttagaccttgtcaggaacttgagcagacacatctgcttccagtcacatagatcatcttctctggggcttgagagcccaccaccttccatgtgtgtctggatgtttaaccttaccaagcagaagattctcgtcatatccttcagtttgagctcctttatttggcgttggttctctaaagaagtattcaagaaataacatatcctttgtttctacccagtctgatcttggaggattctgaaagcgtgacccactctcatgtttagaaatgaaggctcattgtttcacctggccccaggtttctaggggctcctcttttgatgattgtgctgtctttgagccagattggacatgggagttggcaacctttaggagctgcggtggagagccaaaggaaccagcttgaccagactttaaagttttgtaatcctcttgtacactgttttctgtgaaagcaataggattgtggatggcctgttgttgagccagtcccttctccactgacccccagaccccctttgcagcacttgcaaagatttgggtagactggaccagagggttttccttgttcctgtgaatagcatctctccagggttttagtggatcattctaaagaggtagaggtcaagtgttggacagatttttagtctagtctctggctttcaaggactcctccttactcttttgagcagtttgttacttctggccgtgcttaccccttagtagtgctctctgctgtggtggcaggtgagagatttgagaacaggtcaaggccagtccttgtggagcagcttgggcaccagcagccctagatggatagcttcttgcagtttgtccactctcattttctgagaaggtagtcatgattgtcaattaccaaattccttccccattcagtgatttttgcagagtctgggtctggattttctttccttctttcttttctgacacaaggttttgttctattgcccaggctggagtgcagtggtgctatcatagtgcactgtaacctcgaactcctgggctcaagggatcttcctgcttcagcctccagagtagcggggactacaggtgcacaccaccacactcagctaattaaaaaacaatttttttgtaaagacaggctctcacaatgtctcgaactcctggcctcaagcagtcctcctcaccttggcctctcagagcactgagattacactgactgctcgttcaggtgcctttctccttgcctcttcaccatggccttcttgtgtgatatatgccttaacccattcaggaagaattgctcctactcagcctttcaacccgacctgtggtcccttagacgccttcccttagggcctggtaagaggatagacagtgtagagcactagcctgggaagccattaggcctctgctttgggcctacagctgtcctgactgttgtgcaagctgtcttcagggcctgcagattctggcacatcctgggatagtgcagctcctctctctcaggagttggacctgtcacttttttttcgttttttttttttttttttttgagatggagtctcgctctgtcgcccaggctggagtgcagtggtgcgatcttggctcactgcaagctccatctcccaggttcacgccattcttctgcctcagcctcctgagtagctgggactacaggcgcccgccaccacgcctggctcatttttttttgtagttttagtagagacagggtttcaccgtgttagtcgagatggtctcgatttcctgacctcgtgatctgcccgcctcagcctcccaaagtgctgggattacaggcgtgagccaccacaaccagcctggacctgtcacttctaagggcttcagctatatcctgtccctgaggcccacctccctgagtgctctctgcaggctgggaagctgaacagtggtgccttgctccagtgcctctgaagggcttggaaattgcaggacacagctttactgctcagcattgcccacactggaaacattctcttcctccctacccaggtctctgtgggctttgtccgttctgccaggcccttgcttatatgatgtcagaagccctgtgcccggtgccattgtcaatgccatgtcccagattacctaatggctgcttcttggagatggtttggtgtccatgcacatttttctctgccgttggagccagggtgaggagctgcttgcaacagctggattccagggtgtcagaggagcccttggagcttgccttgagcctggcagggagaacatggccccttgcatcaggtttcagacatatgggtcttcttccttggcagatggctcctagccttcataactcagcaggctggtgattggcatgtgactccagttcattctgcaggggctttggtgaaggcatcaactatgactcaggacatcttcatttatgagcttctacccagctcccttcttaccttgcctgcgccttctgcgccgacctgataaaatcagcaaagccagtgtctgcttacttgggagtgagcagactccttccaggattggggaaatatttgctgactcaggctcagaatcacatctcagggtggtgtgtaagggaccgacgaggagccagattaccttaggaacactctttgagttacggtgggtataacttattagagttgctttgagggcccctggcacctgtcagctaaagctgttggggttttttctatcctgcagtgttgtacagtgttttgggcatgcacgtgatactcacacagtggcttctgctcaccaacagatgaagacagatgcaccaacgaggtaatcccattttctttactcaggggtctctgaccaccactgacacaggatccagatttaagatcctgaccttgaagatgaaataatttcactagggcttattcccagattccaggttcctgtcacagcatctggtaccagttgcttatgcatagtataggcatttattaagtaattattgaaagtctatggcttacatagttttttcaggagcatggagattcccacctttgcgcccattaaaagataaactccacagggcagggagttgttttgctgcctgttgtgtctaggatagtgcctggcacagaggagataatgaataaatttttgttgaatgagtaaatgaacgaactttcgtctttgcctatatgggtacctagggtgccaggccacaaagatggtgtccatcattctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattacaggcacctgccaccacgcccggttaatttttgtatttttagtagagatggggtttcaccatgttggccaggctggtctcgaactcctgacctcaggcgatctgcccgcctcagctgggatttcaggtgtgagccaccgtgcccggcaaattaataggcatttaaatttacattgaatataaaatattttcctttgtagggaactctgctggatacggatgggccccagagaactctcaaccagaacttagagctcagatttcaatacagtgaggatagttgctggcagtggtttgttatttacaccaaacaggtgagttctcagggcagaccttgaacaccctctgtgctgaaatgctgtcttgcttgctggggtggatgaagcacatgaccctaacccaactagagcaggaccctaaagtgttctatgcactctcgttcgggaccgtaataccttttattttgttttatgttttgttatattttactagtcaccgtggcctttgtatcagttagaaatgaatttagttaccaattaatagaagattcaaccaacagtggcttagaccaggagtccatagactttttcttaaaggatagtaaatattttaggatttgagatccatacagtctctgttgcaactgctcaactctgttaaaagcagccataggcagtatataaacaagtgagtctggctatgttccaataaaactttatttatagaaacagatggtggtctggccttgtttgccaacccctgactcaggcaatacagatttttatgatcttagttaataaaaatactgaaggtagatgattggcatccctattattctcttgaccttttccaagcagataaaaagccactggttgagtatcccttatcccaaatgcttagcaccagaattgtttccaattgcagatttttttaaatcttgaaatatttgcatatacattcatgtggtacataacattttggtcaatgacagtctgtatatatggcagtggtcccataagtttataactcagtatttttactgtaccttttttatgttttttttttaatgtttcacctttttcctgtagtaccttttctatgtttaggtgatacacatacttatcattgtgttacaattgcctcagaatttattcagtatagtagcatactgtacaggtttatagcctaagagtgggaggctctatnnnnnnnnnnnnnnnnnnnnttctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattataggcacctgccaccacgcccggataatttttgtatttttagtagagatggggtttcaccatgttggccaggctggtctggaactcctgacctcaggtgatccgcccgcctcagcctcccaaagtgctgggattacaggcgtgagccaccgcacctggccttttttttttttttttgagatggagtttcgctcttgttgtccaggctggagtgcaatgccgtgatctcggctcactgcaacctccgcctcttaggttcaagcgattctcctacctcagcctcctgagtagctgagattacaggcatgcgccaccacatctggctaaattttgtatttttagtagagacggggtttcaccatgttagccagactggtctcaaactcctgatgtcagatgatctacccgcctcagcctcccagagtgctgggattacagatgtgagccactgtgcccagccgggaacaaatatttttaagtgccaactatgtgccaggcacttgggaaatgataatagtaaaaaacagatccaatctctgcctcatgggtctgtggtttgctggtatatatgagagctggccataacacacagaattgtttcttccatctctgcaggggtaggaggttctcaccaagagtctgaacaatgctctgggttcccattgctgtttccatgttctcaggatgcctggcaggttttataaactctcagaagtggagctccagggaatacaatgttcattgtcctatttggaaggctgggttgttgtgggtccctgctgggggccggggaaacgtgggcctcctgcctgatttgttttaatctctgaagttcagtggttccagtagctgtttgtgggcttcacttccccttctctgcctttaacaccctgcaggttttcctgttgtcagacagggtggtgagtccctgtgtctctctgtctgtgggggtcaggttgtttgtagatctttcaggaaggtcctgggtggggggccctcctgctttcaaacccataccaagtgctttcctctgaagggaatgtgagggaggaagaaggggggagtttcagagacttctgaggttccccaagagggaagaggtcaaagtacctcctgagcggggagagctactgagttgaactgatttgctttgccatttgctttagcagcagccaggcccagtggcagcaattgtacgtgcatttccaggggtcagttgtccagttcatccctgagccttgagctcccagtcgcaggtaggaacttctcttctcctttctttttttttttttttttgagacggagtctcgctctgtcacccaggctggagtgcagtggcgcgatctaggctcactgcaagctctgcctcctgggttcacaccattctcctgcctaagcctcctgagtagctgggactacaggcgcccgccaccacgcccggctaattttttgtatttttagtagagacggggtttcaccgtgttagccaagatggtctcgatctcctgacctcgtgatccaccggcctcggcctcccaaagtgctgggattacaggcgtgagccaccgcgcccggcctcttctttctttcttgattgggtactgctatatcacctaggaccaggggtgtgtccaatcttttggcatccctgggccacattggaagaagaattattatcttgggctatacataaaatacactaacactaacaatagtgatgagctaaaaataaaaatggcaaaagaatctcatgttttaataaagtttacgtatttgcgttgggatgcattcagagctctcctgggctgcatgcagtcatgggccatgggttggataagcttggcctccctaggcagtcctctcaccacagcctcccaagtagctgggactacaggtgcacaccactgtgcctggctaagttttttttttgtttgtttttgtttttttttaatttaatgggtacatagtagtaggtgtatatttctttttttcttttcttttttgtttttttgagatggaatcttgctcttgtcacccaggctggagagcaatggcacaatcttggctccctgtaacctccacctcctgggttcaagcgattctcctgcctcagcctcccaagtagctcagattacaggcgcccgccaccacgcccagctaatttttgtatttttagtagagatggggttttgtcatgttggccaggctggtctcgaactcctgacctcaagtgatctgcctgcctcagcctcccaaaatgttgggattacaggcatgagctaccacacccggccttgtatgtcttcttttgagaaatgtctattaaaatcttttgcccatccttttattagattattcgtttttttcctatagagttgtttgagctcgttatatattcttgttattaaccccttgtgaaatgggtagtttgcaaatattttctctcattctgtgggttgtctcttcactttgttgattgtttcctttgctgtgcagaaactgtttaatgtgatgtgatcccatttgaccatttttgctttggttgcctgtgcttgcggggtattgctcaagaaatttttgcccagaccagtgtcctggagattttctcctgttttcttgtagtactttcatggtttgaagtctcagatttaagtctttattttgatttggtttttgtggatggcaagaggtaggggtctagtttcattcatctccatatgaatatccagttttccaagcaccatttattgaagagactgtcttttcctcagtgtatgttcttggcacctttgtcaaaagtgagttcactgtagatgtgtggatttgtttctgggttctctattctgttccattggtctatgtgtcttttttttttttttttttttttctctgagacagagttttgctctgttgcccaggatggagtgcagtggcgtgatgttggctcactgcagcctctgcctcccgtgttcgagcagttctcctgcctcagtctcccaagtagctgggattacaggcatgtgtcaccatgcctggctaattttttgtgtttttagtagagatggggtttcaccatgttggtcaggctggtcttgaactcctgacctcaggtgatctgcccacctcggtctcccaaagtgctgggattacaggcatgagccaccgcgcctgggcgaaagatggcttattttgaagtcaactttagaatattaaaacagcattctcaaactttttggcctcaagatccctttagattctttttttgtttgtttgtttgtttttgttttttgagacggagtctctctctgtcacccaggctggagtgcagtggcacaatctcggcttactgcaagccccgcctcccgggttcatgccattctcctgcctcagcctcccgagtagctgggactacaggtgcccgccaccacgcccagctaattttttgtgtttttagtagagacggggtttcaccatgttagccaggatggtctcaatctcctgacctcgtgattcacccgcgtcggcctcccaaagtgctgggattacagatgtgagccactgcgccagtccctttagattcttaaaaattattgaagaccccaagggcttatgtttaccatgttagaagttataataggccgggcgggtgacattcgttaatatcaccactgatctcatttttaaaaagtctttaagtattgggaagctgtcgggctcacagtggtcaatacacgttttctaaatttgagttttctcttgaaagtttgatttttatcattggtaacatactgttggttcttttgtttgattttgtctgagatagcatctccctcagtcacccaggctggagtgcagtggtgcagtcatagctcacttgcagcctccaacttctgggctcaagtaatcctcctgcctcagcgtccagagtagctaggactacaggtatgtgctaccatgcccagctcattttaaaattttttgtaaagatggtgtcttgtgatcttgctacatcgaccaggctggtcttgaattcctggcctcaagtgatccatctgcctcagcctcccaaattactgggattataggcatgagccaccacacccagccttttttttttttttttttttttttgatatggggtctcactcttgcccaggcttgagtgcggtggcacagtcttggctcactgtatctagccttgacttccaggctcaagtgatcctttcatctcagcctcccaagtagctaagactacatgcatgcaccatcatgcccacctcattttttaacttgttgtagagatcaggtctccctgtgttgtccaggctggtctcaaactcctgagctcgagccattcattcctgccttggcctcccaaagtgctgggattaaaggcatgagccactgtgcccagccagttcttttttgttttgttttgttttgttttgagatgaagtctcactctgtcacccaggctagagtgcagtggtgtgatctcggctcactgcaacctccgcctcgtgggttcaagtgattcttctgcctcagcctcccaagtagctgggaccacaggcgcgcaccccaatgcccggctaatttttgtatttttttagtagagatggggtttcaccatattggtcaggccggtctcgaactcctgacctcatgatctgcccacctcagcctcccagagtgctgggattacaggcgtgagccaccgcgcccggccacaaagaatatttaaaagacagatatcaaaggtggagattttaataaagttagtttttatttattcatctaggacattcttaaattggcattttattgtctttcatggttctgtggattaactgggcccagctgggtggttcttgcttgggatatgtcatgttgctatagtcaaatgaagacggggcaggtgtcatctgaaggctcagctgggctgggtgtccacgctggcttaggcacatgggtggcacttgatgctgttgaatggagtgcgtatacatgacctctctatgtgccttgggcttctcatagcatgagagctgggttctgagcagaagcattcccaaaatgaatgtattgagagattcagaaagaaatgtcaatgtttctcatgtcctagccttggaagttacacagtgccacttcctctattcccttggtctcaggaccagttcagattcaaggagaggactacacaagggtgtgaatactaagaggcgtgattcactgaggagagaaacaggcctccttggagaccagctactacttttcagcatccttatgtgaggtaatgtggtcttgatacttccaagagaaaagcacatcttctcatgattttcattcctggaagctactgttagttaggaaattcctaataggttgatggaggacattgaatgctaggtgaaggaatttgtactctgttctttgggcaatgggggagccatcagtggttttggagcaaggagtggtggtgttaatattgcaaaaaggtagattaggaatggagatagagaggataggtaggggactgcagtggtctaaatgtaaggaaattcttcttcacattaaatctgagttcctctggttgcaatttaagtgtattgattttgatatttcagccacacagattaagcacccagagccagggtggaataacccatccctaccccatatccatttagggctgttgatgcacaggagagattaagagttcacaaactttagaaggcaactaaatttaggttttattgtcaaagcacataaaaagttaagcataaattattcaaaaataaaaagcaagaaaggtgaaacttcatttaacaccactaaccatgtttcaaatacgcttcagtttcagtattatagaagcaaggagtggagccagaggaaggaatggggaggacaaattagagaatggtaggaagagggacaaaagtaggggaagaaaggagtcaggaggggcacacagcagaaagaatttgaaggaggtcagattggagcaactacttgaagctgagagaaggctccgtatggggctaacatgttagcaaagagctggtgccttctgtgtttccctgaggcactggcttctgggttttagcatctggtatcctcaccctttctttaatacagacagtccccaacttatgatggttcaactttacagtgatgtaaaagccatacacggctgggcgcatggctcacgcctgtaatctcagcactttgggaggccgaggtgggaggatcacgaggtcaggagattgagaccatcctggctaacacagtgaaaccctgtctctactaaaaatacaaaaaattagctgggcgtggtggtgggcgcctgtagtcccagctacttgggaggctgaggcaggagaatggcatgaacccgggaggcggagcttgcagtgagccgagtgcatgccactgcattccagcctgggcgacagagcgagactccgtctcaaaaaaaaaaaaaaaaaaaaaagcgatacacattcaacagaagccccatcctttagtactcatacaaccattcttttttttttttttttgagatggcgtctcactcttgcccaggctgcagtgcagtggtgtgatctcggctcacagcaacctctgcctcccgggttaaagtgattctcctgcctcagcctcctgagtagctgggattataggcgactgccaccaggcctggctaatttttgaatttttagtagagataggatttcacaatgttggccaggctggtttctaactcctgaccaggtgacctgcccacctcggcctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtcaagctgggttctgagggggtgagcccaggtaggagtgacttctgaaccagcccagatttacaggcttgggcatagggagcccagcctcagcctgggagcctcatcttccattaaatagctcctggcattcaggggagtgcgttgcagcaccccatttttttttcattgaagtcctgtcttccagccaggcacagtgaatcacttgaggccacgagtttgagaccagcctagccatcatggggaaaccccatctatactaaaaatacaaaaattatctgggcacggtggcgcacacctgtagtcccagcacaccagagttcaagaccagcctgggcaacatggcgaaaccccgtctctacaaaaaatacaaaaattatccaggcgtggtggtacatgcctgtagttcctactccttggggggctgaggtaggagaatcactcaagccgaggaggttgaggctgcagtgagccatatttgtaccactgtactccagcctgggtgacagagtaaggccctgtctgtaaaaaaaaaaaaaaaaaaaaaaaaaagtgctttcttcttcttcttctttttttttttttttttttttttttttttttgagacggagtctcgctttgttgcccaggctggagtgcagtggcgtgatctcggctcactgcaagctccgcctcccaggttcgcgccgttctcctgcctcagcctcccgagtagctgggactacaggcgcccgccaccactcctggctaattttttgtatttttggtagagacagggtttcacggtgttagccaggatggtctcgatctcctgaccttgtgatccgcccgtctcagcctcccaaagtgctgggattacagtcatgagccacgatgcccgacctctttcttatataatttttttttttaatcgggcagccctcagaatcacagcagattcagaaagactccccagaaaagttctttcactcctaacttctacccagcctcatggtcacctcagcagctctcctgagaccgttactaagttctccacagctaatggtaactcagcttggaaagagttctcttgtaggaggatgctgaagggaggttgccaagtggtgtgggaaactgcttcatgcttaagttcacttccatatcatgatactaaaaggtatctaacagctgattttcattgctttcatttgtgatctgctaggaccacttgatccttatcactgcttttggcacactcctcatccaagagttgatcgcagaggcagagttccttgccaccagtccagtggaagtacaagccaactttgctctccaaatggcagcagtagctgagcaggccgccctgcattctctcctcataaacatgctgttctcaagtttgtcagaatccagagctctctactcattacccccttttccaaacaagcaagcaaagcatgctcttcctttgtttcccttaattgcctaaaacatctccatgctcatagctgttgactctctttgcctcctagttcctgttcctctggtgtaggatttctcagccctagcactgtaaacatgttgggctggataatcatctcttgtatgggctgtttgtgcattgtaggatgttgagcagcatccctggcttctacacactaagtgccagtgacactcttctcccctccccagctgtaaaacccaaatgtctgcggacattgccaaatgtctcctagggggcaaaatcacccctggttgagagtcactgctctatcatttattcactaaatactgctggtcagctgggtccactggcgaacctcacatcaataaacctggtaatagaagcatattgttcttacattagaagtttactctcttcagttatctcactgggcccttgagggctttggggaggagtgatgggaaatggtttacaattaacagcatattccaatgaagaaagaaagcatatgatgtctgcacaacagaggagagtgtccacaatgtacagctcttccctggagcagttatgtttctcagggtgtgcttttccaagtcattttgtgtctggttagaagccaccttcccttagcatccagaggtgccatgtagactagggttggtcacagtgtgtagattgccattgacctgcccattcctagtgtttgacctggtggtcatggcactctgaccacatcagttttcctctccaagcccagatgggttctcagaaccctccaccccaagctgcactcatgagaggcggcacttctgccatcctgatctagagcttgttcatgtggtccagaccatttctttgcagccccctctcctgtgtaaaagcctttaggaaagtgcagagatcctgatggattccccttgaccctcagcacgcacatcctggtatgtagtgctcagcactccgttgggggcttcagactggagaagagaaaactgcccttccctttcaaggacatcctccaagggccagaatgctcagttccgtaaaattaactctccactgcctacttttttttttttttttttaagacagtctcactctgtgccccaggctggagcgcagtggcgtgatcttggctcactgcaacctccgcctcccgggttcaagcaattctcctacctcagccttccaagtagctgggattacaggcatgcgccacctcacccagctaatttttgtatttttagtagagacgggatttcactatcttggccaggctggtctcaaactcctgacctctagtgatccacttgcctcggcctcccaaagtgctagtattacagtcatgagccaccatgcctggcctgctgcctatttaaatagcaagcagttacagttaaagaaagaccctggcctggggacgctgccaaggctcctaatctgacacttctttcatgtggaccagggatctgaactgtgtttcttccaaacttttggagcttgcttccttggtggtaagctaaatagtggcccccaaaatatacccctttataacccctgtaacctgtgaatattatatgacataatggactttgcacatgtaattaaattaaggatcttgagatgaggggattatcctagattatctgggtggacccctaaatgcaatcccaagtgtccttatgagtgggggccagagagagagattggacacaggagaaggaggcaatgtgactactgcagcaagatgctacactgctggctttggaggtggaagagaaggccaaaaatgcaacgaacgtagctttggaagctggaaaaggcaaggaaactgttttcccttagaacctctggaggaagtgtggccctgccaacacactgattttagcccagtgaaactaattttgaatttctgacctctagaactgtaagagaataaatgtgttttgttttaagtcgctaagtttgtggtaatgtggtaatttgttacagtgcagtaggaaactaatacagggctcatctgcctccaggtacaagtggtggcttggctgatccctgttcttattttaaggcgtccctctcatggcacaaggagagcataggcccagcattttcctgaaccagtatttgaaacaatctgcactttgggggaacctgttggggagttcttggaagcaagagagaaagcctcatatggtacccgatccttgctttggaactctcccagcaccttcagtgatatcatgaacaaagagttctttcagaccagtgaggatgtaggattattaaaatctgattctaattccatcttcccctctcctcttccatttattcaataaatgtttattgtgtacctcctatgtgctaggcactggggatgaagggataaacaaagcagataaaaaatctcctgctctcgtggtaactgaggtgggggaagtggagggagccagagttaagtcaacagcatgtgagatggcttcagatgctctctagaaaactaagcagaaaggagggtagtggcagttccacatagagggccggggaaggtctcaccacgaaggtgacatttaagtggaaagaggagagtgaactattgtgggaagaatctcgcaggcagagggaaagcaagttccaaggccctgcactgggacacagctgaggtgttcaacgcatagcgaggaggccagcgtggctggacagagggagggaggagaccaggagatgaagttagagacgagattggtggccctgaagtgccataacagcttttactttgcttggcattttgccccttctttctcctctcctccccctcacaccacctcacgagttttaggcccatgttcctcagttcctttccatgggatatttatcccatcatacttagggactaccagcaggcaaacatagtcacttaaaaatattagaagagggggaaaaagcagcctcctctttctgaatgatgaaagcagttccatggcagtgttggcatggcactgtgtatctagcagtgcaggctggccattcaccgcgtagttctgggtggtttctgagaggttcccctccatggccttcttcagcccatgaggaagtccaacccccctggcccgctgtttctttccatttcacccctcttggtctccccagtgggactcccacagctgacttctatccccacctgtgtctaatcccctttccatggctgagccggtagataacctagtaacgatctgagtagaatatggctcccacatgttgaatgcattgtgctgatcactacatatatcactttgattcacacaacaaccctgagaggtaggaaccattgtaccccttttagagatgaggatactgaggctcagactggttaggaaaattgcctaaagttgcacagctaatgaatggcagagctgggatttgaacccaagtgattaaagcccatgtctttgatcactacatagcagggccttctaggaaggatggctggctggatctagttgttccagtttggaaagtacctgcttgactggccagactgctgttggcttcagaaaatagcagtctcttgttggtcactgagaagaggcaaaattttggcaggccttggggcctcctgcagagtctcattccaggtcagtggacagaggaggccctgagaatagtcgtgcatactggctccctggatctgctccaagacagtgagcagcccctagaaccacaagagactggccagccaagctgtgggcccggcctgtagggtggaaggaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagccctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgcaggggctggggtgcagggatggcgctagaaatcagaagaggcaggcatagatggcatctcactggtggccttggctggtctctgggaactgtgcccatctgcctgccctgctggctcctcctcaggccagctgtaggccccagggatcatagagctcgggtagctagaggctgggagggcaggcgagacagagaaacagccacacttctcatttctttggcttctcagagggggatgagcttcctcctggaacagagaagggagtagctcactgcctgtttctcagggttaggttacggacttctagggaatatggggtagtgcttaagagccagactctgtgtggcatgggggtgataactgtagaccctccacctctggggattaaatgagctcatacatgtaaaggcacagaggaggcactcactgaatgatgattgtttcattagtgtctttagaccctcagcacccagcaccataggtggatgccagtcattattggttagaccaaacagaacttcaaggcagctgggcatggtggctcacacctgtaataccagcactttgggaggccaaggtgggagggtcacctgaggtcaggcatttgagatcaacctgggcaacgtagtgagacccagtgtctatttatttaaaaaaataaaataataataaaaaaagaaaaataactttaatgttatttttgtcgtcctcttcatctgaacattggcctgcgtaggtattaacctgagtccagtgattgtttgtggagccccacagggtacttcccagtgacagcagcctggagtgtgctcctgccagcccctgcctgggccctggaaaaggcagggcagtgcagcgaggaatcttctggcctaaggatgcctgtaaccaccaaaccttatgtttagttttacaccttgctgagggtctggcttttggatatgagctctggagtggtaggggtctgtgtcccatggggacaggtggttctgggtgttgggcacgaggtgatggaggaagggcctgccacttgcaagctgtttatctgactagtaataaacagtggatgacacctttaggaaactgtatttgggagctttgaaattaatcagatgccaccaatggcatttttaatttagttaaaaatgttttagttatataaataatgctcattcgttatagatgattagaaaatacagataagcactgaggagaaaaaagtaatatattatcacacataagtggctgctttgatatatgatttttttttcttacctaggttcttttcaaattgtgtatacctagttattttttctgtctttcgaaatgggatgctgtttaacatttagttttgtgacttgcctttcccatttttcaggtggttttgtggtgtctgcttgtcctccgacctcctctcccatttgtgggaaaggcatttggcctggagggaggcacttgggaagaactgtctggttgttccttgatgttattgccagacttgcagagggtagagaggtgcatgaagtcttactctgcctctccccatctgtgtctctccctgtccctgtccagcgccccatctgctctgcctactcaccactcctgccttttttttttttccttccatacaaatccagaaaaggataccacctccagtctgaaggtttctttctatggcttttagggatgaatctctcaggagtttagaaaaaaagatgcacagacagtatataggaagggtaatgccagggctgggggtgggggtcttgggaagagcaactgagaggagggcctgggtccctggtgctgtcttgagtcagtgagaagaagctgcgtgggtgatgggttggggcggggtaggcagcaggtgactgcagggacctctctgaaacagcaagcaagctggccaggaagacgcctggagaataaggggcccagataggggccagacataggggagaagaaaatgtgtctcagtggcacctgctcctccaccctggccccactctttccatgatctttccagagattctctctttttctgcctgatctgcttccctcacctggcagtgcccagccccagtagtttgacacatctggtatatctggctactgtgctctactgacacctgtgtggcagcagctgcacagcttcttggcatctccctgggcagtaggcagggatccgagcatagaggaagatgttccatgcatcagtaactcagattccgttccagaaacgcatctcaaagcaagggagaaaattgaagatggggtattttgtggggaacaagctatgccttcctgtcacttcttacagaataaaatggggtctctggcagtaggcaaggagaaggcctttctgagcactgagggtcagtggcttctcaggtcttttctgggccactttggcctgcacacaggttgggctaggaattcatgcttaaaagcaggctgatttccataggctgtgcgttcctgtgggcctgcctggatcatatctgttctgctgtgatcccaggcctggtgagacccactggcttcctgtacgtcccctcaaagcctgcgccaccgcctctcccttcaccactcccaagctataattaagttcccatgtgaaactgtatccctcagctgacacacgcttgtaactacagccctggccattggacggctcatctggggtgacttctggggctggtgcctcagcctccagacgctctccagtaggtctgagtaggtggtgtggacccaccaggaaagggtggatccagtgaggcgggggccaggccttgcccaagagtcagaaagtgggaagtcacgggggagatgaagggcgagtgagcagctagaaagtgccaggggacacaaaaatgggggagacaggcagccttttggggctggagggcatggacagggtgactgatgcctgagccacaggcagaatgtgagcagtttattttattttatattctacatatttttatagcataaaattaagatatagttcacataaccaaattcaccactttaaagtgtgtactttgatggtttttgtatattaactgtgttttatatattatattaaattaatatatttatatattatattaacggttttatatattattttagctgtgttgtttatatattatattaactgtgttctattaaccactaattccaggacacttctatcacctaaaaaaccctttacctgtcagcagttactccatcccttggctgctaatctacttcccttctctatggctttccctatcctggacatttcatatgaatggaattatataatatgtagccttttgtgtctgaacaatttcacttagcatgttttcgaggttcatccatgttgtagcatataatagtactgtattcctttttgtggctgagtattccattgtgtgtatatattccattttatttattggtaaattggtggacatttgggttgtttccattttttgactgctgtgaacattcatgtacaagcttttgtgtggacatatgctttaggttctcttgggaatatacttagtgaaattgctgggtcatatagtattccatgtttaacttttttttttttttttttttgagacggcatcttgctctgttgcccaggctggagtgcagtggcacgatcttggctcactgcaacctgaacctccctggttcaagcaatttccctgcctcagccacctgagtagctgggattacaggtgcatgccaccacgcctggctaattttttttttgtatttttagtagagacgaggtttcaccgtgttggccagactggtctcaaactcctgacctcaggcaatctccccgccttggcctcccaagtgttactctttgttttttgtttgtttttttttttgagacggggtctcactctgtctggagtgcagtggcgcgatttcgcctcactgcaacctccacctcctgggttcaagtgattcttctgcctcagcctcccgagtagctgggactacaggcgcatgccaccatgcccagctaattttttgtatttttagtagagacggggtttcactgtgttagccaggatggtctcgatctcctgaccttgtgatccacccgcctcggcctcccaaagtggtgggattacaggcgtgagccaccgcgcccggccccaagtgttactcgttaggcagatacctgatacctgtctgctatactcactggtctgcaccttgcttcacttattatatcttggccatctttgcataccagacatgtagagcttccttattcttttttttttttttttttttgagatggagtctcgctctgtcacccaggctggagtgcagtggcgcgatctcagctcactgcaagctccacctcctggttcacaccattctcctgcctcagcctcccgagtagctgggaatacaggtgcttgccaccacacccagctaatttttgtgtgtgtgtgtatttttagtagagacagggtttcaccgtgttagccaggaaggtctcgatctcctgacctcatgatccgcccgcctcggcctcccaaagtcctgggattacaggtgtgagccaccacgcccagcccctcattcttttttttttaacagttggctcatccattgtatggatgtgccagtctcttcttttttttttttagacagatttttgctctgtcacccaggctggagtgcagtggcatgatctcggcttactgcaacctctgcctcctgggtcaagcgattctcccgcctcagcctcctgagtagctgggattacaggcatgtgccatcatgcccagctgatttttgtatttttagtagagacagggtttcactttgttggccaggctggtcctgaactcctgatctcaaatgatttgctcatctcggcctcccaaagtgctaggattacaggcgtgagtcaccatgcacggcctggatgtgccattctcttattcattgatgaatgtgcaggtgacttctagtcttttttggcaatgaataaccttgtcattttacacacagataaacagattgacaatgcttctgtgtgataggtgcagtaatggagatagacactggggaactagggaaggcttccagaggatagttaagaaaggctcagggtgagtgagcgctggtatctgagtgggccttgcaggcctggcagaatttcagcaggctgagatgttgtaggaagggcaaatatgactgaagaaaagaacaacagctcaggtgtgacaggggaaatgaagagtattagttatctattcctgcataacaaattaccccaaaacttagtagcttaaaacactatctcgcagtttctatgggttaggagagatttacacaaatatgtgaataccagaaggtgaggattgttgccagccattttagaaggctgactctaatagcaagttgcagtaaggataggattggccaaggcaacagatggagccatgattgtggacaatcttacatacttagctgagaggttgtcagagattgatctgagaacagtgtgagccatggaaggtctttgagcaggagaataatgtgatagttgctatacaggacaattaatctgatagcatttatgctagaggggtcaaaatggagagagatacacaggcagaggcctagattaggagatggctatagtagtacaggtgagaaattcctggcctgtagtactaaatacttttttttttttttaagacaatctcactctgtcacccaggctggagtgcagtggcatgatctcggctcactgcaacctctgcctcccgggttcaagcaattctagtgcctcagcctccttagtggctgtgactacaggcgtgtaccaccatgcctggctaatttttctatttttagtagaaatggggtttcacggtgttggccaggctggtcttgaactcctggcctcaagtaatccacccactttggcctcccaaagtgctgggattatgggcgtgagccgctgcatccggcctctgtattaaatactttagctgcatattctttcttcgaaatgaccacaaaaagaaggtattactgattaatatgcatatggtcttgcgtatggccagacttatgacttgcgtatggtcataaaggtagtaagttgcagagcagcactcagacctgcctggctttgatgaccgtgccttgatggcactggaagtggaaaggtgggggtgactggggaggtgaggttttgtccgttccctggatgctaaaaggaaatggaggagtgtaagaggttgattctttgaacctggatggctggggcaaagataacactgtaacaggaagaagagaggccggagggaacactgatgtgatgggagaaggtgagtgatttgggaacatggggcatttgttggcagggtccttcccaattatagggcgagtataaatagttcctgtgctttgtgtatgaagaggtacccttggcccaaaaagactctaaatgtggaaaaaggatatggtggtgtggtggtggtttgaacattgggtttgcgcagatagtgatggtaactggcactggcctgcgcttcagactttcacagcccgttcacttctgttgaaactcacacaaccctattcaggttatcatcattccctatctgattgatgaggaaactaaggctcagaaaaatccatttgctcaaggagaaacagtgtttcagttacctactgctgtgtaacaaatcacctgtgaaactcagtagtttaaaacaaccaccatttatcctttctcttgattgtgtgaattgggtccagatgcttggttctgccccacatgatgtcggccaagcttgcccatttgtctgtgtttagctgcactgtaatgtccaaggcagcttctctttgcatggcctctaatccttcaagagtctatcctgaacttcttgcagcatggcatctgggggccaagacagtggaagccagtcgtgttgaggcctgggctcacgtcccagaacatcacctcaatcatgttctattggtcagagctgtcactgggccagcccagattccaggttgggaactagacgccacctcttgatggaaagagtggcaaaaggtttgtagccatatttaatccacagacagccggtagtggatacctggatttgaacccagatctgtgtgactcagactcacagtctgtcatgccatactgcatccctttctgcttctggttccttgggagttgcaaagcttgctggctcttttgtgtggttggagagggctgatttttcttgtggtctcccacagtggaagttgtactagtcatcccccttttcacagatgagcatccaagatcactgtgtcttagggaaccttccaaaataggtttgctctagggatttgctagcttcccccaagcttcagcagtgatagccagacatgcatggaatttccctgtggagtttccctttctgcgcttagtggccttttgatgcacagtgctcactgggtgggattcctgctgcattgtagccagatgtggaggctagccctattttgagttatcccagatggtatccagcccagtgagtcccatacttgactcaactggcatattcaccagggagttttggggaaaatgtagattcctgggccttcctcatgcctattgaattagaattcccagggatggcgtccaggaacctgcctttaaagctccccattgatttgggagtacagcctggttgggaaaccaatgacttccagaggctggcaccctccctcagcccagtcatttcagaaagatgcctttgaagtcactgatcagaggaggccacatgggagagaatgatttgtccagagggcctcacacttcacaaccaggaagtgactcctgaaagtgtccaggaagtttctatttgaatctgctcaaatctttgatgttgttttgcatgctttgatagtatctgagctttatggtggcctctgggtgtttttctttgaaagtgtttgcagagagtagcaagctcttccagcagtcagcagacactccctaaccaggagctacttggtctgatttatttgaaatatgaaattcctttgcttggctgtctggttggtatctttggtgtgaagaatatgacaaccctagagatacctaggttagcacagcagttggacctttctagtcttgtgccttggacatacttaaggtacacttggaaaagtagattttaaaaccctggataatttggtttgccagttaaataaacttctatattttagaatatttggaaaataaagataaatataaggaagaccataaaattacctagaactttcctctcagagaatttccacggttaatgttttgaatggctattcatccttcccctcatgacccttcacaccccctctttttgaaaaccatattgaagtcatattgaatgttactttttagcagttttgttgagatgtaagtcataaagtccacctgttgacagtgtgcaatttgatggtttttagtatttacagagttgtacaaccatcaccacaatctagttttagaacattttcttagtcccaaaaagacatcttataatccattagcgtgcattcccgcctcgatgccccatcccgcccttactccagcccaagactaccactcatctgctttctctacgtacagatttacctgttctggacatttcatataaatgggatcatacaatatgtgatcttttgtgattggcttctgtcactggacataatcatggtactgttttgaaacctgctttaaacatttatatcctagcaatttgaatatagttttcaagaatgcacttttaatagcagagcggtattcattcttatgagaatatctaatcttatttaatcagtcctgccaacagacgtttaggttatttctcatcttttgctcttatagccagtgctctctgcactcagaaattattttgttgatttattggttaattgtccgaatctgtgactagaacaaaagctctttgagaacagtcaccttctctgtctcccctactacttggcatagttcctggcacttggtaggtattcagtttttaaaggatgtgtatgtgtgtatatgtgcaaattttgaatgaatcaaaatgtaaggatattaataaatgttgccatattgccaaattctagaaagttgtactaatttaccctctcactgcagtataagggtacctgactccctgttcctttgaatctgggttaatttgtacaggaagtcctgtgatcttttgaatgatgatattctctgacctgtcaaccagttagtttgggaattgatgctgtctgtgtcctgaccctgtctgtgggccaggaagggtctggctgttgggaaagatggtggtgtgtgggagctctagctgcccgggtcctcattgtggctccgtggtattgtatcgtttcctgttgcccttagaaaggctgcatcgtgttgtctggccacttcctctattgtgtgcaggcatgttggggagtgagtagagttgggtggataaagtatgtgtaagaagatactggttatggctgctgattggagtgccttttgaagtcgtcaggagagatgtcactctggaagttcagtgtcttcaaaaatagaaatgaagaaatgcttccaggaagtctgatgcaactggcccagtctgcccccatctgagggtggtgggcacccacatggctggtaaacgcttcatgagtcacccactggccacagtccctgctcctctccacacacttcctgtctggaaaagcctgctacccgcccatggtgaagagtcaccccagagaacttgccagggatgcagggcaggtcttcccaggtcacagcagcagcctctcgctcatgggtttcacagcagttcttctccccaagatgagttgtggtaactgctttttagataaatatgtggaatggatggttgggattggaaaaaaaaagagcggctagatggcaaggcagctcttgtgtgtagcagggagctcacacgagccccatggtggggcagttaaggccccagaattcaccttctccagcagctggctgctcattcttttcttcttctcgtggttttcccatcacatttcccttggggtttcttccaggccttcccctactcaccccacaccctctcagaagatgctgcctcatgtaacttggccaagctctcaagcattacagatgcctttaccttcttttctttgcatcttagaaatcactcacatgttggtctctctcacataattgctttttattattacttcagcggttgccaagtgcctactctatgcctagtaccttgttagactcgggaatgatgcagaagaaagagactggaccctgccccctaggagggtaaatgtctgttctcccatggcctctgtttcccttcctctctgactgcgcctttgctgccctggttcctcttcctctttccgctgcctgagtgtcaacattcttcaggcttctgccctctctcctctccctccacgcgcttgtcccttcctgtggctgtgaccatctgctcttatagctaccaaatactaaagttcttttctcctgaaaaccaggtccctgtgtccacctgcctgctggagtgtgcagccttaaaagcagagtccatctttgtctctgctctttgcatatcccctttctgttaataatccgtcattctctcagtttcccggagccttactgacagctttaaacctcattcctctgccatgcacaggtcgttcctcccgttcttttgagtgtttctccccactgattttcctgcctgtagtgagttggatggttgcccctccaaaagatatgtccaagtcctaacccctagaacctgtgaacatgaccaccttgtttggaaaaaaactcattgcagagattctttcctatgctgcagacgtacatgaacctgtgctcattgacctcctctctgggcctggccttgttggtctctggcttgaaatagtgactgtacttctagtccacacagtgattacatatttattactctgtttgagctcccctagtccaaaggcaaagttcactgcctgccctttccactaactcctaggtcagacttgctaggttgtgtgcacagcagctacaagtgtggtttctaaggtgggtctgggtttgaatcctggttctgtcatttattagccaagggcctttgacagattgtaacctttctgggcttcagtttcctcttctggaaaatggagctaatggattgttgtgagaattagattgcatagtgtctagcactgtgcctgacactctgagctttatttttatttatttttattttttgagacggagtctcgctctgttgcctaggctggagtggagtggcatgatctcggttcactgcaacctccacctcccaggttcaagccattctcctgcttcagcctcccgagtagctgggtttacaggctcccgccaccatgcccggcaagtttttgtattttttagtagagacggggtttcaccatgttggccaggttagtcttgaactcctgacctcaggtgatctgcccaccttggcttcccaaagtgctgggattacaggtgtgagccaccacgtccagcccactctgagctttataaccagagagatgctgtggctagccaaatcgctcaacctatacttggaggatcccaagcttggatgagtgtaagagctgtgacttaaatccagcctacttgtatgtcattctgccacagttgtctttgtctctccacagtttgtcctggagctgggcatggtgagggctaagacaatggattacagagctacaggtctaggagggcatgtggaattatgcctatatgagatagatgacaaagtgggtaagagcatgtgctctggagttagacctgggttcagattcaggctctatgaccctatctcagtgaccttgggaaacttttctttgcatctctgggtctcagttttctcatctgtaaattgggaataacaatggttcatacctgtcttagtctgtgctgctataacaaaattcctgagatgggtaatttataaacaaaagaaactgatttctcacagttctggaggctgggaagttcaagatcaaggcattggcagacttgatgtctggtgaaggctgctgtccacttccaagatggcaccttgttgctgtgtcctccagaggggatgaatgctgtgtccttacatggcagaagggtgaaagtggcccagctagttccctggagcccttttataagagcactaatccgttcctgagggcagagccttcatgacctaaacacctccaaaggccacacctcttaataccgttgtattggggattaagtttcaacatgaattttggagggttcacaacattcaaaccatagcaatgtcttatagagtaatcgggatgattaaatgaaagaatgcccataaaacattgaacacatgcctgactctttgtaaacaataattattaggtatcgctattatagagaccagcttctgctgtggagagtgttaagtgccttgatgccacaagccactggacacgcagctgcatggatcaatgtacccctgtaattatgtaacaaggggacatggagaaaaaaacatttccaatgttgcctcctctgtaacatgattgtacccctaaactgcacagaggagctttctgttctttgaactccatagctgttggtacgtctcttgtggggtttgccatagtctgtcttatactatgactgttcttcactctacggtacatttctttctttctttgtttctttctttctttttttttttttgagacaaagtctccttgtgtcatccaggctggagtgcagtggtgcaatctcagctcacagcagccctgacctccccaactcaagcaatcctcacacctcagcttcccaagatgctgggactgctggcatgtgccaccacacctggctaattttttttgtattttttgtagaaatgggatttcaccatgttgctcaggctggtcttgaacttctgggctcaagcagtccacccatctcagcctaccaaagtactgggattgcagtgtgagccaccacgcctggcctactgtatgtttcttgaggtcaagattgggcactgggtaactgattacttgaattgaaccttgggattcagccagtgaaagtggtccacctggcagtagtgaacctctggctcctgacctctgctgctggtgaatctgtttctcctatggctgcacagacacagggtttcctgcctccaaagagcttttccactctgtacatgggacctgaaccggctccagaaaccttggagcctggcaccacttttcacatcacccagcaggagcagaacttagatggaccaggcatagatgggaaacatgggtttattgctaaggtcatggttagttctcggcggtggggcgggggggtttagtgggcaattgctttttggatttttgttttgttttagaagtaaaaaatatgggccaggcgcggtggctcatgcctgtaatcccagcactttgggaggccgaggcgggcggatcacaaggtcaggagattgagaccatcctggctaacacggtgaaaccccatctctactaaaaaatataaaaaattagccgggcatggtggcaggcacctgtagtcccagctactcgggaggctgaggcaggagaatggcgtgaacccgggacacagagcttgcagtgagctgagatcgcgcccctgcactccagcctgggcgacagagcgagactctgtctcaaaaaaaaaaaaaaagaaaaggaaaaatatgtacatttttaatagtggtagtaagaattttctgtaactacttacgggacatcttcactgaggggtctccagagctcctaaaactcagcactcccccagtgattcttacattttcctgccagacttgctcttcttcccacaatccccaccttaatggaatcatccacatccccctggtcacctgacagttgccctctatttctttattctcctcagcctcttttaatcagccaccaagtcttgtttgtccttcctccctaatgtcactcctgttttttgccgtgaggtctgatggcactagtgctgcctggggttgctactgcctcatctcttcaacctttttgtgtcacgatgtttaggagtttctttcataaacagaatgtggctggatttaaatcaaatctgacaatctgtcttaagtaatttatgtacatttttgggatttaacttaacgtattactgtattatattttttagtactttccatgtatttccatttttgcctatttttctccttccgagtttttttttttttttttttttttttggagatggagtcttgctctgtcacccaggctggagtgcagtggtgtaatctcagctcagcgcaacctctgcctcccaggttcaagtgattctcctgcctcagcctcccaagtagctgggactacaggcacgtgccaccacacgcggctaatttgtatttttagtagagacagggtttcgccatgttggccaggctggtcttgaactcctgacctcaggtgatccacccacctcggcctcccaaagtgctgggattacaggcatgagccactgctcccggcccggaattttctttatttctatacattttacttccgttgtttttttcttttttgagacagggtctagctcttttgcctaggctgaagtgcagtggtgtgatcacagctcactgtagctttgacctcctgggctcaagcaatcctcccacctcagcctcctaagtagctgagattataggtgcacaccaccatgctcagataatttaaaaaaaaatgttttctagagatgggatgttactgtgttgcccaggctcgtcttgaactcctcactcaagccctcctcccaccttggcctccaaaagtgctgggattacaggtgtgagccaccttacctggcctttatttctgttcttactccaacattttctcatcttttctcccatccttttacttagaaaaatgttaaaattagaggaaatagtacaatgaacatgagtattctctttaatcttattcaattaatatatttctctgtatatgtatatatgcttttgtttggaatcatttgaaattaagtgtggatttgttctccatcttcttgctcaggatttggtgtgctgcttttatctgaggactcatttataaaagaaaaaacaaagaaaaagcctttttactttaaaatgattgtagataaacttagctttacacagagtttctgtattccttcacccagcttcccctaatgttaatctcttacatttaattctttcttaagttctggaaaatttcagccattgcctctttggctttctcgttttctctacagtggcctctggaatgcctcttagacatattgttgagcattttaccaccaaagtctctatatttgttctttctgtgttcctttatctgtttaatcatccaagttttcttgtgtagtttctttgagactgtcttatttctgattcttgggatgctacttctctttttgtgtctgaggcttgcccctcttggtggtttatttccttgtgtggtttgtaactttgggtgtgagttcatctccaggagggattctcttttctggctgagacttgggtcctgaattatgaaagtatacctcagagcagcttgtttgcctctggcggggccatgagtgtttcagtggtcctggctcagtttttgttcactgcttagtgcggcacccctttactaccctagtagtgtaagttcagttttatatccatgggcaggactagcttggtggcttaagaaagggtgacctcccgccgggcatggtggctcacacctgtaatcccagcactttgggaggccgaggcagggggatcatgaggtcaggagattgagaccatcctggctaacgcggtgaaaccccgtctctactaaaaatacaaaaaattagccgggtgaggtggtgggtgcctgtagtcccagctgctgggaaggctgaggcaggagaatggcatgaacccgggaggcagagcttgcagtgagctgagatcacgccactgcactgcagcccgggcgacagagtgagactctgtctcaaaaaaaaaaaaagaaagggtgacctcccacccatacctgacccacagagccttggagaagtgttcagcttcttgttgctttcctttactgggcagccctttgaggctctcttcttgatactggggctcaaagccacaggcaggctttaaaccgcttcatttgtgggtgcgaaagtccacaggccattgtggtgtcagttccactcactgtttatgtttcaattcttctcgcacataggcatttctctttccaatttggctgcatgtctacggacgtcatttgttttattttatctggtatttttctgtgatagtggtggaaaggggaagctctttcacgttaatttagtcccgtatcctactgaaagtttgttcaaatgcttagcgtgtcatatgaagcttttcatgatgcagcccattctacctctcctgcataaacttagctcttaaattttacacttcagcaaattgaactatttgcataccatgtactgtaatgtttaaaagcacaggttttagggtccagctgtttggcttggaacctgtcttttcataaggtatgattttggacaagttacttatcccttccataactcagctttctcatctgtaaaatggcagcgtccggcatgcagtaaccctgatccctgttggctgcctctgtggttgctgcccccagcagttgaggctgccaggcctctgcgcaattgcactgtttattcctttgctggaattgcctgtctcccctcctctccttgatccctcccaggagagcagcctttactccttcagagcttggggtctctgtctgtagtaactatcactctgtgggtcgctgcttgtttacgtatctttttttttttgagacagagtgttgctctgtcgccaggctggagtgcagtggtgcgatcttggctcacggcaacctctgccttctgggttcaggccattctcttgcctcagcctcccacgtagctgggactacaggcgtgcaccaccatgcccagctaatttttgtatttttagtagagacggggtttcaccctgttggccaggatggtctccatctcttgactttgtgatccgcccgcctcggcctcccaaagtgctgggattacaggcatgagctactgcgcctggccacgtatctccttttttcagccgactctgacccccttgagagcagggtcttgtttttcttggtacttgaaactccttacattctacctgtcatttggtgggcattcagtgttggtagtttaattgcattgaatttctctggctgagtagaggcaagtgctgggagtggtatgggacgcagaggcagggaatgacagcaggaaagcttgttttttggcacattttgtgccaagttgatggaaatgtgaatcagtatggctgggacacaaggtaacaattcttagtctagctgaggatgccagagacttaaaacaagccagtggccagaaaaagccactaaatcttgcaaattaaagtggtttccagacttaagaatgcatgccccacattcccttcccaaactcagcgtctctgagtgccaggtggaggaatacaaactaattataatcctagtgggccctgagaatctttaattttagaataaggctgcacttctgaaaggcgcagttgctttaggagtaggtgactctgtatgcccggggcctccgaggagaccaggatgtgaaaactcagtacctggcatttagagctgtgtcacccatcacttctgacctcgttaagatttctaccctactgcgacttaacaactaaaaagggcagatgagataggtccggggcagagcttaatggcctgtgtcattctcctcagctttgcctgaattctctggactcttgagactctatcataggaatattctcagaagagaaggcaatcgaacctttaaagatccccagattatccatcagataacagtctcatgagagtgatgaacaatgacagcaccaactctcaattcccttggctggaatttcaggaatcagcttgaactcagaggtgggcacagggttagggcttggagtaggcgtcttttctttctttttttttttttttttcttttttgagatagcgtctcactcttgttgcccaggctggagtgcaatggctcaatctctgctcactgcaacctacgcctcctggtttcaagcgattctcctgcctcagcctcccgagtagctggggttacaggcatccgccaccacgctcggctaatttttgtatttttagtagagatggggttttaccatgttgcccaggctagtctcgaactcctgaccttgtggtctgcccaccttagcctcccaaagtgctggtattacaggcatgagccaccgcgcctggcttgcagtaggcatctttgcccaacccacgtgaatcccattagttctttcttgacagctctcagtctgtggtcatatattaagcaactatgtgttcagtactgtgctgggtgctattgctgaagatacggaaatagtaatgccacaagtccctcttcttagagaggagagcttgcactctagttggagagaattcctagcacacagaaagctgcaaccagtggtgcccaacagtaatgctgtctgatgccactgcatgcaagtgtgtccctttgacaacttggtgcttttgcccaaaaggagctgttctctttctgaggcttggactattcgtttgttttttctcagatgacttgctggcactgttacagactggtctgaattaactaggactaccttttatctgtttctgaggaatagccccaaatgtgctctctcttggtctttatgaacttttcctttcttccatttctccaaattatgatagattaactttgcagtgtcatctgctaatctccaaggtcttctaggggcacgtcatcagcagttgctgcttttgaggtatcaaggtttgtcctgtggagtctcagatagtttctttacctgttcaatgaatctgattttccatttttctaggagagtgtatctcaaagtgattgctgaatcagaatgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccctgccattcttagggtgtggctgctgtcctcatggtccaaaatggttgccgtggttccacatctcacagtgagatagaagaagacagaagaatgatgtctcacctcccttctaaggagacttcagcaaagcctgcctctaccactttctgtgactgagggaaagttaattcatactcagagccaattaacctcgtgttttttttttttgtttgttttttttttttttttttttttttttttttgagacaaggtcttactttgtcgcccaggctgtagtgcagtagcacaatctcggctcactgcagcctcgacctttcgggctcaagcagggctcctccctgctcagcctcccgagtagctggaactacaggcacatgcaccacacccggctaatttttaaattttttcgtagagattgggggtcttgttatgttgcccaggttggtctggaactcctgggctcaagtgatcctcctgccctggcctcccaaagtgctgggattacaggagtgagccactgcacccaaccagttacctcatttgtaaaacaggcatggtaacacttagtgcaggagcaagaggatcagggagcacacatacatacaaagtgcttggtgctgatgcccagcctgcagcacctgttctctaaatcatagcagcaattgctgctgcagcacacttctctttctcctctctccaccgctccatctctccagggtctctaccttgcctgtcaggctccactttcctttgctcctgccttttgcatctgttcctctctgcattctcccctcatctcctctcttccgtgcacctcattttcctgctcccctcctgcctctgtccctcatcttcttttcagagacttaaaaccagccagtggccactggcttttcagtgtctcctcctcctccttgaactacctcttccttctagtgcttctgtccttccctcctcctgacctccagtgaacaataattatttgtaacgtaatgacaaattatcgttacgttacaaagaccagaggttagaggtggtgattggccttgtaaactgtaggtcagcgatgagtaatttaagaaaactaaatttaattggtttactcatgagtcagttaggaattctatttggcagctagaacagaaatagcagtggcttaaaccagtagaaattttttctattgtgaaaagaaatctagggggacagtctagggcttgtctctccgctctgccatccttagtgcagggcgtccaaccccaaggttgtatcatggtctaagatggctgcgggagccccaaccatcatgtcaggttctaggaagaaagcaggaagaagagaggaaaggcaaaaagaacacatgctccatcttaaggagctttcctgcaagtcccaccaaatagcttcagcttctcctccttgcctccattagttgcaagggaggctgagacatcatttagctgagcacattgctacctgaggtagaattgggattctgtcaccaagaaagaaggggagaatggatattgtgtaaacaattagcaaggtctgccgccattcattcaacattaatttagcacctacaatctactagttatgaagaacagtcaaggtgccccattccagagggaagacatagataagtaaacaagtacagtacacaggatgggtgaggaagagggggagagtggagaaaggcatgaagtgggtatcttacataccctccaagggcgcattctagagttcgtcatgcagacattcttgcctgtggtttgtttcctcttctgctctctcctttttgtcattgtcgccattgttgttgttggggtttgtttttgcccctccattctgacgtcagcagtagcccctagaaccttaggaaacagaaacagttggcctagtgggaagctctgggatgggagccatgtgtttgaagagccaagtcccagggccattaggcaattagaggcctgtggcaggagagcattcgttcctggacatgccgtggcactgccaggagactttactccaggaatggggtcgttgtcaggaggcatgttctaaccaggcacctggcatcacctatactgtgcttgccataaaatgaaattttggagcagtaaaattctccaggtcccgtgaaatgggtataattgtttcacccacattaatttaaccagaggtcttggtatgctatagtgttaattatgtgtaaaaatacttctacttactataaaatgtattgacagttagacattgatattccttcttagaactcaaaaattctaggaataacttgggagacccacattatctttcattttgatcccaagaacatctattgctgtttcctttgggaagttagagaggcaatgggaagcctgctgcagagattttctaaacaggcatatcccagcccctaaggagtttgaaagtgtcagagaaggctaaaggattaaaagatcgtttgttctggcacagtgcaatccttatgaggttgtactgtgaccctgggcaagttaccatcctatcctcagtttcttcatctgtcaaattttgatcctgtggaccctccccaacagggctgtgatggaaatgaagagacacatgggaagcattcagtatgtgttgttgttattatcatcattattgttatttttattattattagtgctactggtagtgctagcccactagcccactgggcagcgactgcacccgtatcagagtgtggaaagccttggatgccacattaaggagttggattttgtgggcaagggtgtgacaggtcatggctgggcttagaaatgtcactgacaggagtggagaggcagatctaggtgaggagtgggcagggcttgaacctggccagtcaaggaaaggggagaatggatacctgagtggtgagggaggacccactggtgctggagttcagcctgtgtgcccaagggatggtgtcccattgacttgggtgggaagcactagaggtggagcagttggggtggcaggaggggaaagaagcatatggtgatcagctcagcaaacaaatgggtaacttgcgcactcagtgctcggtggtgcccaggctggagtgcagtggcgtggtcccggctcgctacaacctccacctcccagccgcctgccttggcctcccaaagtgctgagattgcagcctctgcccggccgccaccccgtctgggaagtgaggagcgtctctgcttggccacccatcgtctgggatgtggggagcccctctgcctggctgcccagtctgggaggtgaggagcgtctccgaccggccgccatcccatctaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggcgcctctgcctggccacccctactgggaagtgaggagcccctctgcccggccagcggccccgtccgggagggaggtgggggggtcagccccccgcccggccagccgccccgtcagggagggaggtaggttcagccccccgccaggccagccgccccgtccgggagggaggtcggggcgtcagcctcccgcccggccagccgccccgtctgggaggtgaggggcgcctctgcctggctgcccctactgggaagtgaggagcccctctgccaggccagccgccccgtccgggagggaggtggcggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcccggccgcccctactgggaagtgaggagcccctctgcccggccagccgccccatccgggagggaggtgggggggtcaggccccgcccggccagccgccccgtccgggagggaggtgggggggtcagccccccgcctggccagccgccccgtctgggaggtgaggggcgcctctgcctggccgcccctactgggaagtgaggagcccctctgccaggccagccgccccatccgggagggaggtgggggggtcagccccccgccgggccagccgccccgtccgggagggaggtgggaggggtcagccccccacccggccagccgccccgtccgggaggtgacgggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgtactaagaaaacttctgccttgggatcctgttgatctgtgaccttacccccaaccctgtgctctctgaaacatgtgctgtgtccactcagggttaaacggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaattatcaataaaaaataaataaatttaaaaaaaaaaaaaaaaaaaacaaatgggtaacttgctgcctgccagggactcctgtggcctggcatgaagataattgactgtgttttgaacgcattataaggcccctgcgaggcctccgtgtggtatttagacagtcagcaggagagaggccccggacagtggtgtgggatgcagtcccggtgtgtgaaattgccagtggttggattgtgcagcggatggattgagcagggaagccagccaagaacagaatggggtggggagggcgttgggggtaggaaaggaggatcatcatttcaagggcgggtgagggaagaacaagcagcagagtgcaaagcccccagagggaagggcgatccttatgaggttggactgtgaccctgggcaagttaccctcctgtcctcgggaggaagtggttgacagaatcattgcagcagtgagatggaagcaggaccagggcagcagccaagggcctcttagatggcggggcgagaggaggtcatccaggacctccaagagaactgtttcaaaatgggaggagaaagcagtgttcctctggtggtggttctaatgctttgtatttgtagttcttagtcgttttcaaggccctttgcattctttgcatcgtgctctcttaccacgatgcatagtgagaccccacctctacaatttttttttttttttttttttttcagtgagccaggtgtggcagtacacacctgtagtcccagctacttgggaggctgaggtggaaggattgcttgagcccaggaggttgaggctgcagtgagctgtggtcatgccactgcattccaacctgggtgacagagcgagaccccatcttaaaaacaaacaaacaaacaaatacttggttcatttggtacttggctttttggatcttggggaatattggagatgacggaataacttcaaggagactaacttcaaggtcaagactcctgccaagcactccaccagacataaaataggaaaatgatgatagaatctacctcactgttggcctggcagtgggagtttgttgataaccctgaagatgaactcctcaaggtgaagagcaaggcttcagaatgggctgctctatagatgtgagagacagagacagacctagccttgcaaaaaggttgctgtagtctttctcctaccatttccagcacaggatggtttctggtcccaggaggccctgtcttgtgctgtgtgggacccttagtgctgtgaagactagcagcaccctggaggtctttgttccttctgccctttcccttagattgcatctcctaaccttggtttatatatttgtcaggaggtgggggaaacctgctttcccccacctcctgacaaatatataaactggaaattgatccagtcctggatcagtttgggtcacacaacagggtcggcagtgttggcccacagagggccctgggccccttatttcccctttggccctaggctctgagctctcaggttttggctaccaagcaaaaggtggagttgcatcagttgttgctctttaccaggcccccaggggttgctgtcggtgagctcacaggatgttttcttctctctgctttgacttgtgctgaatttctgactgaccccatgcagcatctgcgtggcttctggggcccgagcccaggtttcagcaagctgcccatggtttaccctcaggatgaactctaggaagctggggagcactgtggtggtggtataagttcagcccctcattttagtttatttttatgttaaaatgtttattaatacaaaataacacatagatcagaatgttgtatgacagaaagggactgactggactcaggatctcccaccccagccccaggggtgaaggtgaaggtgattggtttcctgggtatcgttccttccacggtttttccatgcacgctctcatgtgcgtgtgtttttatcctcatcctgctcttcaccgtggcagtggggagcacactaaattgctctgacacctagttggttttttttttgattgagtgtatcttgggaatctttccatatcagcatatacagatacactgcattctttttttttttttttttttttttgagatggagtcttgtgctgtctcccaggctagagtggaatggcacgatctctgctcactgcaacctccacctctcaggctcaagcgattctcctgcctcagcctcccaagtagctgggattacaggcacccaccaccacgcctggctcatttttgtattttgggtagagatggggtttcaccatgttggccaggctggtttcaaactcctgacctcaaatgatctgcccacctcggcctcccaaagtgctgagattacaggtgcgagccaccacacctggccattcttttttttttttttttaaagcttttttgttgtacatatgatgtatgttaggtggactgtggcttataaaacctcttcatagctgttttccagtgcgatccttctagccctgtgaggaagacagaccagaagaaattttttgcagcttaggatactctgcaaacaaggaggaagtgagaggagttggggctcatttaatgcagactaaaacaggatctttcctttgagagactgagacaggatgaggagcaggctgtagatgtgcacacatatccactcagagagaacatgagaggcagcatctgcagaggagcctggtgggcagcacgtgccgcgggggcaggaaggggagagcttccgggaaggggatggaacttgagccaaacctttttctcaaaaagaggggaggccgggtgtagtggctcacacctgtacccagcactttgggaggctgaggtgtgcagatcacttgaggtcaggagtttgagaccagcctgggcaacatagcaaaaccccatgtctattaaaattacaaaaagtagccgggcgtggtggcgcacacgtgtaatcccaactactcaggaggctgaggtgggacgatcacttgaacctgggatgcggaggttgcagtgagccgagatcgcgccactgcactccagcctgggtgacagagtgagactctgtctcaaacaaaagaggggaaggtaggaatgagacaaaggaaaaggggaggcgggcatttcaggcaggagagcagcataggcagaaggtgcaaacatgtggcagagggtcggtgtccatggacacgcttccaccacctggtctaatcattgacttatcagacatctaaatgcctgctgcgtgcccagcactgtagagggccacaaggcagcaggaacctctcagtgcctgccctctgtgggctctgactccaaccaggagaaactggacgcacaacagcaggcaaaactagctgatggtgatagaggtcagaagagtggtttacagccaggcacagtgactcacacctgtaatcccagtactttgggaggctgaggtgggaggatagcttgagcctaggaggctgaggctgcagtgagctgtgatcaggccaccactgcattccagcttggcctggacaacagagcaagaccctgtctcaaaaaaagcggagtagttacttattgtggagattagctgttcaggggcacaaagaaccttgtagggtgctggaaatgtttactgtcttgacctgggtgatgggtttttttggtttgttttttgtttgtttattttgtttttttgagatggagtcttgctcttgtgccccaggctggagtgcaatagcactatctcggctcactgcaacctccacctcctggcttcaggcaattctcctgcctcagcctctcgagtagctgggactacaggcgcctgccaccatgcccggctaatttttgtatttttagtagagacaggggtttcaccatgttggccaggctgatcttgaactcctgaccccaggtgatccgcccgcctcggccttccaaagtgctaggattacaggcgtgagccaccgcgcccagcctgggtgatggttttatggtggtatataaatgtaggaattcatggggcttattatgtttaagattaatgcagattgcatactctaaccatgagtatgttataccccaattataaatcaagcaggcaaataaatagcatattccccaaaataaagaagtaaaatgcaatagcaagaaagtgtgcaaagagctatgcctgggaaaatacaggaactgtatcattttgaaagggtgagagatgagatttcagaccctcaccctctctcactgtgtcatttctgaagggccctggtgactttctttgcccctctccactcttacagtcattggaaccagagggcagaaccccgggcctcaaaattaagtctatacaccttagaaactaggaattcaaggctagccaggtcctggccctttatctgtccttcagagagtggggtgccccagccaaagcggacagctcgccattcccagatgtgccctgtgttctcggctgcgttgcctgactcaccttggccttccctgggagtgccttttctagttttctggcccagctagaagaaagggccattacacctactccagaatcatccctgctgctcccaagttggaatatttcttcctccacagtggccacctcttatgtgccctccatcacacagtttgtatacttacctcttcaagggcaggctgtgttttactccttttgtcatctctccccataggggtctaggtcagtgcttttgtacatggtgcctgaaacagtcccataaatgatattttatttgagtggggctctctggctggagctactaggtggaatgttgccatgtgggagcaggggtcataacgaaggctggccatcaagatgctggtacttccaaattcccaacagttattaactttcaggattgaggaacaagtaatagaaattccctggaatgcccaaaatcataactttttctatatctttcctaacactttatgagtttttaaataaggagtggtcataataataaatggaattattttttctgtgataaaatttcagaggtgtttctgtaaaaaaaaaagaaagaaaagaaaaagagaaaaaaagatgtaacattaaatgcgtggtttggtggtttggttgggcacagtggctcacacctgtaatcccagcactttgagaggccaaggcaggaggatggcttgagctcaggagtttgagaccagcctgttaacagagaaagattttgtctctattaaaaataaaaaaaattagccagcatggtggcatgtgcctgtagtcccagttactcaggaggctgaggcaggaggatcactggagcccaggagtttgtggctgcagtgagctatgatagcaccactccgggtggtgacagtcttggtgacagagtgagaccccatctaaaaaattaaaataataaaaataaaataaatgcatagtttattgttattatggacaaatatattgtgatatatgattgtatatatttcattagcatgtaaaaatgatctctatctgatatagacatctgataatagaaaatgcggaagagagcattaacacaaaatgaataccaaataaaaatcacttaatgatttaagagtaatactacacatatttaatatttaaaagttactcttaaaggttaaaactagagaaaagttaaaagaataaaacaatgaatttctgtatttccttcaccaagattcaccagttgctaacagtttggcgcatttgcttgatgtgtcatagattgtccacattccatatctgttggattgtttccttgtgattagattcgggtttacgttgttggtgggaacccacatagatgaggtgtgcttcctgttgcttacatcaggaggcacagtggtgccagttggccctagtaaaagtgatgctaacttgattcacctagttaagttggcatctgtgaaggctacttttgtattaaggcagtgaacttcgaaaggaacttttccctgactttgggaattgctgacagccatttaggaaaagagacgactgttttctctgtcacgtgtagctgcagttaagaaacatcctagtatagtcagacaagctctggaagccagtatgtcaggacctgggaccaagctctacagccatctctccctgtgaccatagccaagtcatttctgagctatgtgagactgtacgtataaggaaatagacactcagagaagtgaagcagtttgcccaaagctactcagctagtgagtgacagagctaggattcaaacccatttttgtctggggacaaagccctgcccttgtccttatgccaagctgcctcctttgtgaggcagctggttgttatgattgtggcactgaccactcagatgttgtgctcggaaccaagcagaagagcaccaagccttataggccctgacaggtgagagggaagagagaggtgccttccttcatccatctggactgcccttggaattcctgggccaatttggggaaccctggcaccaaccctaacatgggccagtgccagcaccaggtatatgcagcctgtacttcccagtctgggcaggcaaaggctggaaccacaccagcagctctcctctgtaacgcagcacggaagtatttatttcaagggtggctcagagaagtgaagcagtttgcccaaagcaaactggttcctcccctgcatgtggcaggctgtcctgcaagctgggaggcgggctgttggacgctccccagccacccttgaaataaatgcttccatgctgtgttgcagaggtgagttgctggcaccgttccagcctccgcctgcccagactgggaagtacaggctgcacatacctggcactggcccactttagggttgatgcatgggatccccagattggcccaggaattccaaggccagtccagatggatgaaggaaggtattgcctcagcctgcctgggttcctcgggggagagagggagacaggaagcattaatgggggaaaggtgtgccaagccttgccaagcaggtcattgtgggtggggagacaccgcctacgtgctcgggacgccccaggatttgggtggaggttcttgaggaggcagcgagaaaggagagctgtgacagcgactctggagcactctagaatggctcttagtgaccttctgctctggtgacccaccagcagcccaccaacctgtcatcttccagttagcagccatccccagggccagtagcacctgagcacttggtaagtagaaagacccagtgtctgctcctcatgttaccctggtgtccttccccagagcagttgttttgggaaaaactggctccggctgaagcaggaaatggtgctccttgtcaaggtcatgttgtcctgttgctatagaactgagagaccctgaggatcagccctctgaggttcctgttacctctctttacactattcatcctcataggcctccaggaagggggccaaattcagggccaggaccagggccagtggcttggtgaggcataggctttgctgtatgggccctgtggggagctctggggagttcttattcccctggctcatggccaccatcatggagagacccccagggctctggcagccaagtgggcaggagcggagggagggggcatcttgggagggagagccccgaaaggaaacagggtttatagacagactcccggtcatcactgcttgtaatgcttgctcagtgaacagtggcagtgcttttcctgactctttcaagagagtcccttctctctcctgctaggtgggctgagatccagactggttagaagcctaacatgacctggcgtgtgagaccttgcactctctgaatgtattccccaagtgtcatcaataagtcactccggttctggcatttccctatcttatcctgcatacccctcctcctggctctgagtcctgaggagtgagattgcagtttttgacccatgttcttactgagaagtgggctgtcatgcaggtataatataaaatccagaagctgctgtcagaattatgtgagaattgggaggtgacagcatgggccaattttctgaatctctagggtgctttgatgcttaagaagtctttctgggctccctgagatttgaaacctcttgttttatctgtcctttcactctggttcttcctttcctttcttggggacttcatgcttctcaaatatttgttaagtgggtgcttatatgggaccttagaaagcaaccagctaggcatgcacttggaaagggacaggaggactgagaacaagactaaacatttctgtgagattgagcagcaggagagctttgcttctttactggtgtcagtatgtgcctgcagctcctgggctgcctttactcgagtgagatccatttacaagactcctgactcttctactccactttattacaaaagatgttgatgctcgttttaaaaacaatttaaactacaaacatgaataaaggtatttatctccccaccagtccccctcattctcccttccctcctgttcttagactggtttcccctcccagtagtttaggttgtggggcaagtgtgtgtagctctgcatcagtgtcttaaacaaaatgagtgtgtcgcggatgcgcagctcggccacttcctgttttcttcggctgtatgtcacggccatcctgccatggcaccatgtctgtgccacctgctgctcttgggcatctgcagagaattccatgacatggatcttgaggtagtcttcttcagctttttctacttcatcttattttctacaatcatttatatctgcttgtaaaacctttttttaaaaaacttgcttactagacacagcacatgttcattttagaaaatgtagaaaaatcagataagcagccgggcatgatgactcatgcctgtaatctcagcactttgggaggccaaggcaggcagatcacctgaggtcaggagttcgagaccagcctggccaacatggtgaaaccccatctctactaaaaatacaaaaattatctgggtgtggtggtgcgtacctgtagtctcagttacctgggaggctgaggtgggagaatcacttgaacccaggaggtggaggttccagtgagccgagatcatgccactgtactccaacctacgtgacagagtgagaccctgtctccccgccccccccaccaaaaaaaaaaaaaatcagataagcaataaaaaaagtagaaatgacccctaagaggtaacattttggtgtgtataatacaaatgtcttttacatttgctccctcatctcagcattgccactgccattaaagaaggcacatggtcattagtcccatctcacagatagaaagcctgagccacagagagggtagcaggttgcccagaggtacacagcatagtaaagacagagctgggggtgtacctgtcatataactcagcactaatgctctctccactgtagcccacttgctgtcttcgcaccttgggacagagaggggggtgccaggcattggatttcagatgcattgaactgccttatccgaaggttaatagacagatgactgcttgaggaaagcccctgattgacttaggagaagaggtagaagacacgctcttcaggtttacagacaatatgagacaagggattgtttgcgctttagagaacagaatcgggcttagaaaaccctcaaagagctctaatgacaggtcaggagcaacaggataaactttggaaggggtggatgtaaaggggcccccttctatttccgtaagcacaggaaggcctgacttgatgttcaggcagtgatgactggtctgcctgggagtcatagtggactgtaagcagggggacatgtcatttcaacactttaacttcatcttacttcctgggagtgttaggagccacacatcaagaggacgtgatgaactaaggaagagggtttgggaacctgtcaaatgacaaatgctgcagtgacagaggtttcacctagagaagatgggtttggggaggaaaaggtgcaggccaagacttggtgaccagggccaggcaggacaggaccaggaatggcagttagttgaagggagagtctaattggtcaggatacagaacacctttttagcattagagttcaggaatagtagcgagaggcagtacagtagagtggttaagagctcctgctctgatggcttactggctcccggctcccagagtcttggaagttacctcactcttccatgttccaattttctcatctgtaaatggggataatgggtacctgccttatagtccacttgtaaaacctaagggagttactccatgaaagcagcttagaataatgcctggcacacagaggtgctgtgcactgtttgattcacacggaagctgggtaggctccatggaagaagagttgtagaaggtcttctgcatgcatttggtatgacctgcttacccagccttttccattccctgcctccctgtctccttctttctttctccatcttcctctcctgggtctaggatcctacatttcccctacctaggacaccctacccctcaatctttattttcttctttgaaactcttaagtattttatttcttcttcttcttctttttttttttagacagagtctcgctctgtcgcccaggctggagtgcagtggcacgatcttggcttactgcaagctccacctcccaggttcacgccattctcctgcctcagcctcccgagtagctgggactataggcgcccgccaccacgcctggccaattttttgtatttttagtagagacagggtgtcaccgtgttagccaggatggtctcgatctcctgacctcgtgatccacacacctcggcctcccaaagtgctgggattacaggcgtgagccaccgcgcctagccctatttcttcttctttaaattgtttttattaaaaaaaaaaaaaaaggccaggcgtggtggctcatgcctataatcccagcactttgggaggccgaggcgggcagatcatgaggtcaggagacagagaccatcctggttaacgtggtgaaatcccgtctttactaaaaatacaaaaaattagctgggcgtggtagcatgcgcctgtagtcccagctactcaggagactgaggcaggagaatcgctttaacccaggaggcagaggttgcagtgagccgagattgcaccactgcactccaacctgggcaacagagtgagactctgtctcaataaagaaaaaaatgagacagggtctttctgtgttgcccagggtggtctggaactcctgggctcaagcaatcctcccatctcaacctccctgcccagctgctgtgcccagcagtattttctataattagcatagtgtacttttcagattatcttgaagacccagctctccttgaccttgaaccttccctgaggcctccagaggcaatttcctcctcaggactcagctgcccttcactcttccctcgtgcacagcctgtcctgtgagtaggtgcaggtactgactggtcttatctttcgccctgaaaatataaacgttttaaaggcacctgaggatttgtcagcacctccccacccccaccctgggtctgacctaggactctgagtcagggaggcctccctccactgagtaatagtagccttgggatctgctcagcaagaggattgtatagtttaagggaggaagaagcaccagtgctgcctccccatgggaaaaatgaagccccccctcccgcaaccaccaccaccacagaaccaccaaccccaacgtcacttggcagattagcaaaagaactagccagacgctgctaggcccctcaggcttctagattcgctctccaccacatttctaccaatttatgctcatcttgataagctcctcctttgaagggtctggaatggtctggagtggtctggaaagcagggtcagatacccctggaaaactgaagcccgtggagcaatgatctctacaggactgcttcaaggtgcgtggtgaacagacgtctttttgcaattatgccagttgctcctctgatacttgagggttatgtgaatctaacaacagacaaaaatctctgcctcctggggcttatattctttgggaagagacaagcactaaacaaataaggaaatatatatacactctgccagatagccataagacggatggagaaagttgaagcagggaagggagatggaagtacctgagggtggactacgcatatttgaaatagggaagccagggaagacctcactgagatggccacatttgagaaaggacctgaagaaggtgaggcagtgagctgtggaggtgggtaactggggagggggaagaactttagctagagagaaaagccgctgcaaaggcccactgaaggcaggatatgcctgctgtgtcgagaccagcaggaggccgtgtgcctggtacttaatataccagaaggagtggagcaggcaggggtaccagttccagaaggacttgctggcaggtattaagatgggctttttctctgtgataggaagctccaggaaggatttgatcacaggagggacagaatctgaattgtattttagaaggatcactttgactgctgtacagagagtgggtggtgaggtgggaggcagaagccagaaagccagttaggaggctgttaagtaatccaggcaggagatggtgttggctgggaccagggtcatagcagtagaggtggtgagaagtaattagattccgtatatttattaaaggcaaagccagcaagattccttgactctaacttaaaggttggagttgtcatttactgagatgagagagaccatggggggaaggtaaagggctcggttttggatgtgttaggcttgtgctgccattggacatccgtgtggaggtgtcagagaagctggcctggagaaataaattggggaatcatcagcatactgaaggcattggaaggcacaagctggcataagatcagaaagagatggagcgtagatggagaatgaaagagacctttagagattaggaagaaaattactgactgagaccaacaaagtagattgatacggagcagccagtgatatcagagcaaaacctgggaggaagccaaatgaagagaaggcgtagaggaggagggatcgagcagtcatatcactatcacatgctatcgtgggtcaagtaaaataaagatcataagtgttaccgaaagtttcaaagtacagtgacattggccaggcgcggtggcttatgtctgtaatcccagcactttgggaggccaaggtgggtggatcacttgaggttatgagttcaagatcagcctggcccacatggtgaaaccctgactctaccaaaaaatataaaaattagccgggcgtggtgacgcatgtctgtagtcccagctatgggagtctgaggtgggagaattgcttgaatccaggaggcagaagttgcagtgagctgagatcgagccattgcactccagcctgggcaacagtgagaccctgtcccccaaaaaaaaggccgggcgtagtggctcatgcctgtaatcccagcactttgggaggccgaggtaggcggataacttgaggtgggttcaagactagcctggccaacgtggtgaaactccatctctactaaaaatacaaaaattagctgggtgtggtggcaggcgcctgtaatcccagctactctggaggctgagacaggagaatcacttgaaccggggaggcagagtttgcactgagctgagatcgtgccactatactccagcctggacgacaaagtgagactctgtctcaaaaaaaaaaaaaaaaaacaaaggctgggtgcagtggctcatgcctgtaattccaacactttgagatgccaaggcgggaggatcacttgtgatccgggaggagttcagttcaagaccagcctggccaacatggtgaaaacccatctctactaaaaatacaaaaattagttgggtgtggtggcatgaatctgtagtcccagctactctggaggctgaagtaggaggatcacttgagcctaggaggtggttcagtgaactgaggtcacacctgcaccccagcctagtgacagagcaagactctgtctcaaaaaaatcacctaccaccctcttcatacaggggaactttcttctattctttttctagtcattttcatgagaatcatgatctttatgtaaattcgtattgtatttttcacttatgttattaaatattctatgaaaacatgagtttaatgactaggtaatactcagttgtctgggtgtgccctaatatatttaaccattcctctattattgggcattgggccatttctgattttttgttattataaataacattgcagtgaacagctcagtgttttcctataaggggaagtatagggtcaaagaacgtgaacgcttttaggtgagacttgaacttgagatccctgggttctcctggacagaccgaccaatcacagcttaactgtgggatttttccatgtctcctctctccctgggaaggttgagaggtctctctgccctgcagatccctattcctgcctccccgctgcaattgcacgtcccatttctcctgggccagtcagagtttcattgcctctcatggggcctgctggccacccactcagtggctgcccttctccttaccaccagccttcgtcccctcacctagagcattcacaggcgagcaagagccagtcagagcttccctcagagtagggggtgtagtgataaatgaaatagccctgccttcactcatctcactgggtcgattaagtgatgtgtgatgtacctgaaagcacttcaggaacttaagagtctcatgctctaccaactgagctagccaggtgcccttaaagggctgtcctagtcttaattgtttgtaaagaaataggtagctgggcatggtggctcacacctgtaatctcagcactttgggaggctgaggcgggtggataacctgagcccaggagttcgagaccagcctgggcaacatggcaaaaccccgtctctacaaaaaatacaaaaatttgccaggcgtggtggtgcacacctgtggtcccagctactcaggaggctgaagtgggagaatcacctgatcctaggaaatcgaggctgcagtgagctgtgattgtgccactgcactctagcctgggtgacagggagatcttgtcttaaaaaaaaaaaaagaaaagaaaaaggtataagtggtggtgtccacattgtaaccacagagcccctaaagcagggctgttgacctatggttggcatcctggtcacaagagctctgtgtcagatgtgtgaggggcttgggtgtagttgtcaagcctgggaatgtggctgttagtatcgattggcctcatgccaagcagtgccaagcgccacgtctgctccccagatacctgtgtttgtatgtgtgtgtcatagtcgggaatcactgagaccaggacctctgggaggctgaaccctgggagggcagagcaggaacaggccttggagatgatctaattctgacattttactcagtgaggacacaggtggggcagccagagaggtactcagctctgagtcagggccccatccctcaactcctcagcctgagtcttcccaggaacacaacaggcagctgcttcccagaccttgcagggctccaggtggccttcccctcctgccgactcccttgccgggtttgctgtaactattgctcctccgagcctggctgaaatcatcttcagtctgttatcaccttcagtctgttctcatcttcagtctgttctccacagcagcctgaaaagtctttgtaaaaatgcagctctgttcctccccatcctcttcataacccccttggctctctgctcctcccagaataaatacccacatcctcagcttacccttcaagacgctgagtgacctctagccacagcccttctctctacccacagacagcccaggtcctcattccttgggccttttcacatcactgttcccatcaccctggaatcccactcagcctgcctgggccagaggctacgtaaggtcctcaggaaagcgtctcctggccactcgcacctgactcatgtgctctgagtgccacaccttgcttggcatttgtccttcatagccctggtcattgctggctaatgtagcctggcacatggtggtaggtacttgacaaatatttgttgaacaagtgaatgaaaccagctggcagggaccagaagggcagaggggcagggacagtgtccacaaccatagcccctgtggtcttagctgagaagggctctggctcggtctctggtgagtctctctgctggccggcagaaccaccctaccctggaagccctctccatgtagtgtgaggggtctcaggcccattcaggcttcagtaggagagatctgggtctcttttgggacctgagcaggcctttcctttacctcgttggcatctctcagcattttatttggttttaaaaatgtctcccccttcccccgaccaaccccagattataaaggtatcccacgctcactgtgaagaaattggataacataggaaaatataattaagaaaatcgaaatcacctacagctccacccctcagagaaaagtacccttaacatttgtggccatgtcttttcagttttgtttttatgcatgtgtatgtgctttgacattgctgagcttctctttgtgaaaaccacagatttttcgcagtcttcagtggctgcggtcagaggtggtcagcacgttagtgctcccagtggagaggtgatgcagggatctgggtgcccctttctccctactgcaggtgggtgggtgggcacacccaaggcccccttctgtggcagctttcctatccctggtgaagagtaccctcctgtctctggtctcttctccaggacattctccagccctggaggctgttcctagggggctgcctcttggggcaatgggaagaattgtggaatgcgtgggtggcctcctggctgtcttttctctggttccagcactctctgaacaaaaccagccccaggccactcctggggattggcctcaggtgactctctgggctgactctggccagctagaaggccacccgggcttctcctgtgtccttaagagggtggggtgacctggattggcaaatagtaagcagagaacacggcagagttgctggcctagaaaaccaggtcactaggtcagcacttggattaatgattgataagaaaggttgggagagaatcagccagacccattctcccatgacatccctcacttctgatcccaaaagcacctgccacggagacggggcaacctctgtcttgtatccagtggctgccccttattccgttgcagtatgggaggaaggaggtgacagcaactgggtcacctgcatgtggggcgagaaggggaggaaggtttaggcccttctccctgaaaaaagaagcatgtgcccagagtagggggctccctgccggttctctccccacaattgatggtgaggcagggaactgggaagttctgtctgtggaggtcccttgggtttcagcaggctagcacatttctaggactggaatatcaccatacaatcccttaacacaagccatgggtgataataatagcagcagccactgtggtccttatttgtaggacccttactatctacctggcactgttaagcagttactgcatcgttatttattccacacagcagcctctcaggttaggtggtagtattccagttttaatgtcttccccaagtcataggatgggagggatgagccagggtgtgaacccaggcctgactgaagccggtggaattcacttctttggagtattgcatctcgatggcagtaatatatgaaaactgatacagtggcaagtgctacaactcagaatagtgtggctaaggctcatgtttttagtatatttattcatccagcaaacgtatgttgaggacccactaaatgccaggcaccgtgccaggtgctgggacctacctcagtaagatacagggcattctctgggaaactgataacatggtgaggccagagcagttagcagacattgcagtttggtgtagtgattgcagatctggagggcccgggtcagggttgtggtgagaaggaacagaatggagctagtccaggagagcttcccggaagaggaggtgcagacaggtcgcgaaggagagaaggttttagctagtggaggggatggcattcaaggcaggtgccagttcaagcctccatgctcagggagtgatgtgggatcatgaggcacataggcaggcagagcaggaggataggcctggagagggaggcagggacgagagcctgtggctgtcttcagcacacgggagtcattttctggcagtaatgtccagaagggctttgaccaaggtgttcttgacagaaacagctggggactggcagccagacagaggattcagaggtgatggctccagactgagactaaggagccccagctgggcaaggacatgccagctcctggtccagtcttacccagcaccatatatgaggcacacagtagagtggctaagacttgagccaacctgccttgactcaaatcctgcttctctagttactgtgtgaccttgagccaattactttgcctctctgtgccataatttccacgtcagttaaatggagatgataatagtacctgcctcttagggttgttgtgaggattacatttgccaacatacacagagcatggtgtgtaataagtccttggagaagggaagctagtactattgtgatggaggtggtgatccagcttaggctctggtacagtaagaaggtccatcaggctgtaccatgtggcagatggagcccatggaggatggaggcccctggcacactgactgtccccactcatcccctgggtagggcagaagtgttcccacaccgtacagcctgccagtgggcatcagggaaacacctgagtcaccacgaggagtacgaggcacttgggggttgcccagctgaccaggagcacagagggctgccctgaaagtgagcccctccctactcctagcagagacggggaagggagacaactggacttggtgggaaggactgggccccaggtggcttagttgctctcgccccagaccaggtctctctagagctctgggccatttgggttaagcttctaactaccactgcccatgaaattcacctgccaatgggcaatggatggagtcatgcccctccctgcacctaagttctctgaagggctgagtttcttcttggggccagacagtgggtattggaatgggagcatgggggctgcatgtgcactgcaggctttgtgtgtgtgtgtgtgtgtgtgtgtgtgtgtgtgtgtgtgtgtgtgtacacacatacatatatgtcagaattggaatagtccaggggtttgttttgcaagaaatccttttatttttattttttgagatggagtcttgctctgttgccaggctagagtgcagtggtgtgattttggctcactgcaacctctgtctccctagttcaagcgattctcttgcctcagcctcccaggtagctgggattacaggtgcgtgccaccacacccggataaccaggggttttgccatgttggccagggtagtcttgaactcctgacctcaggtgatctgcctgcctcagcctcccaaagtgctgggattataggtgtgagcccccttgcccttcccccatgccccatgcaagaaattattttgctagggactactttttggtgaggggctacattgctgcattcgtgccccctcattctggctcagggcccttgtgttgtctgggggtctgaagctccagcctcttaagtggggcaaagctgtgacatgatcagagggcttctggctctggcatagtgctggggcgtggagaggggagatagccaacactgggagccagaccaaaaaaaaaaaaagccagggttttttgccggcatacaaattaaacttagtgcctggctgtattgtggttgttgttgttgttttgagacagagtctcctctgtcacccaggctggagtgcagtggtgcgatctcggcccactgcaacctctgtctcccaggttcaggcgattctcgtgcctcagccacccacgtagctgggattacaggcgtgcgccaccatgcctggctaatttttgtatttttagtagagatggggtttcaccatgttggccaggctggtctcgaacacctgacctcaagtgatccacccaccttggcctcccaaagtgctgggattacaggcatgaaccaccgcacctggacttttttttttgtttttgagacagggtctcagtctgtcctcaggctggagtgcagcagtgcgatcttggctcactgaaacctctcccctccgggttcaagtgattctcgtgcctcagcctccgagtagctgggattacaaatgtgcaccaccgcacctatctgatttttgtgtttttagtagagacagggttttgccatgttgcccaggctggtctcgaactcctagcctcatgtgatctgcctgcctcagcctctcaaagtgctgggattacaggcatgagccatgcccagcccagcctgtgctatctttagtgccagggcttaagaaaggaagaggagaatagggttcattgcaggaattgtggtgggtggggtggcagctacctgagaaaatctagacagtgggcctaggtccagtgggtcaggggagagagcctaggggtcaaggttgctcctggctgggcaagctgagaacagggagcaaccttggctcagggtagatgacagacctcagctgtagatggagcaaggaggccatatgaaaatggcaggcttctggcaaaatgcagggatgggctgcagcacagcagttcaatctaaataggagcagcccaagggacgtgggtaggttttagaacagccaggctacagctccccttcctcttcactggtgtccttgagaggccacagtcagaagagacaattccaggctagggagagatgtcagcgtgggaactagagaccctggtcccaagttcaaaactctagccagagtccagaactgcatctgagtctaagaggcaaccacttacttacacctcccgaaactgagaacagttttaccggttctggtgaaaaaaacccactaccagctcatatgtgggagtgggagctgaggctctgctgagtaacacggcccagtgcacacagctgtcagggcctggcccggctcgagtcctgctgtgtccgaagctctgccgttttctgcttcgtcctctagcatgttctgagatgccctgttgggatcctcaggcctgtcacttttgtcatctgcaaggggggcctataaggccttaatgggggctggcgaggcttgagtgggagcgtgacgcatagtgggagctcagtcagctccctcccctccctccaggatttggtcctgacagggagctccatcaggtcttccccagggtcaccagaggctcagatgctgtgttgtcaagtatatataccaggcagtattgtagcttttcctcctctgttactgcctgctaagcggggaccccacatcttcacgtcctcctcttcctggctctcatcaccacagcctggtgtgcattgccccgtgtccactgacacccacgccacatgggtccaaaaacagagtgtgttctcattgcctcatcccactcaccctgggctctgccgccactgcgctgtggctctcgggggtcccaccatctgacccttgtcacccgtgctgctccttctcttgggactcatcccttctgaggcctcccgtggccccttctcaccctcccctacctcctccatctccaggctttcaatctggtggagcataaagaatcagtgtttctggtacttgttatttggataatggcacctaatgctaaatgacgagttaatgggtgcagcacaccagcatcgcacatgtatatataggtaactaacctgcacattgtgcacatgtaccctaaaacttaaagtataataataataaaataaataaataaataaaataaaataaaataaactttgaaaaaaaagatttcagctaaaattagtttcctctccatgccgagtctgaatatattataaaaataaaagaataattgtctttcacacaattaaaaaaaaaaaaagctgactaatgccactacagtcacacactgctgttggtaattgctagggtcctttttccagtattgtggccaacttccaccccagaaccccactctactcttgagctaagtgtctttatgtctcctattttaaattaggattgcgttcagttgcatgcaacagaaatccggcaatcagtgcctggtaaaacaagtttgattttttcacctaacaagcagtctggaggccggcattgcagggtgggtccagcagctttgggaggccacagtggccaggtgctttcggacttttcacccaccctcctaccctgtcttctgctgctccgaaggcagctgctacacctctaggcatagtattcctgttccaggcaggaagatgggaggggcagaagtttgtctctctattaggaaataatagctttttcggaagctcctcctggtagatttctgttcacatattgctggtcagaattatgccaatgaacactgtagctgcaagagagcttggggaaattgagtgtttaggtaggcacagattgctgatccagagaagactgagactcagaaggaaggagaatggagctggggagaagtaggagtgactgccccagctgccacttggagaaagccacggggtgagcaggacagcacctgtgaacatttcctgtgctctgggtctggtgcttctcaagtttaacacccaggggcgagtggtcagggactgatccttgaggaactgatgtacattaaacaaactatcaagtccctgcaatgcagtgtaaatgagtaaagagcctgcaggggagaaactgccactagtggagaccatgcgagtgggcagccgattgcttggctctgggggtgggtgccagaggcatgcaggtgcccaagggccaggtctgcccaattttcaagagaagccagaaaaccaaaatttttaaaggttttttcgttctaactctattttgaaaaaagttcggtgttacagagtaagttgcagagattgtacagagtccccacatatcctttacccagctcacattaaatcttacataaaggaacactggtacaatactattaaccaaagtcagtgtgttgttcagaccttaccagtttttctgccactgccccctttctgcttcggggatctggtccaggatcccacattcatttagttgtgtctctgtggtctgctcctgtctgtgaggcttcctcagtcacaaagctagaggtttacgtgaccttttccaggttttcccactctaatgatttggaaatcatacatcggcatcttgagacatcttttgagaagtaaagggacttgagctgattgaatgttgatcactccctctcatcttccacattattaagttttgccttcttattttattataatttaaattatttttaagccaggcacagtggctcatgcctgtaattccaataccttggtaggccaaggtgggcagattgcttgagcccaggagtccaaaaccagccggggcaacatagcaaaaccttatccctaaaaaaaaatacagaaattagctggtgtggtagtgcacacctgtggtcccagctacttgggtggctgaggtgggaggatcccttgagcacgggagataaaggctgcagtgagccatgattgcgccactgcactccagcctaggcgacagagtgagactgtctcaaaaaacaataacaacaacaaaaaaaaaacccatcagaaaacagctaagagttttgtggtggtttattttaggttcagggtacagatgcaggtttgttatgtgggtgaacttgtgtcacaggcgtttattatacagattatttcatcacccaggtactaagactagtacccgatagttattttttctgctcctctcctcctcccagcctccaccctcaagtaggccccgaggttattgttaagtccaagcaagggaaggcctggtggaaatgaatgtgtagccttaacatgttttgtacaaacttggctgtacattacaatcaccaggacaattaaaaaataagaaacccaatgtccaagctgctccccaaaccaatcaaaggagaatctctggggatgggaccaggcatctgtctttttaaaaactccccagtgactacagtgtacagccgagttggcaggtctagagcagggagagagagcagaaggagtctctgatcactccaggttctggttctgatgagtgggtagacaggcaggtgggttgctaaagtaaagattactagaggacgaatgggtttggggaaaatgatgggttctgtttggatagattgagtttgagctgtcggtaaaatatctaagagttggggtcccacagatgcttaacatcttaaagcagatcttttcttctcctgatccttccacaaggtctggtgcagacatttccccgctgggagactctccacagtacctcatgatcttatcatctctgactgtggcatttgtggataatgttttacttgctaagggttggaactgtctcctcctgggtgatgtggacatggcatcaccacccagtaagttgtcaccttggaaagactccaggatggagcacatcttcctttttctgatgtctctgctattgaggccatggttgcagatctgctgtcaacatgagccaagaacagcagggctttatgtcttttttccacacccaaccactgaaaggatgggactcaccccttcaggaacagtagcacagcagagccgtgattcttgggcctgagtgctgatagggacagggtcggggatgggaggcgtgatgcatatctggatctccaggtgggctggagagttgggaaaagcccctcaagtcattccaatgtgcttcctggagactcagaacagaaggcagcagaggaggcagggaagggtggcacagtgatgtgtcacctctctagtttatggagcctgctccgaaccccacaaacccactacaagagccaggtgggaagggtgatagggcaggtgacttgtgatacaaggagcagagaccatggtatagcactgcaggaactagggaaggagcaggagcagaagaaccccctccatgacagcagcccccaagcgtgccccactcgcaccatcctcttccttgtcactgcctcccctgacctcttcctgtcttctcctctgcccaggctgatgggaaccatcctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacaggtgaggagaggactggcaggggacacggggcagaggaggcacagcccagtgcagtggggatcctggccctctgcaaacgccatcatgtggggcgcagagtagcagagtgctgaaggactggagccggaagcctgggttcacgcccagtgcggtggggatctgctctgccactcaccagcagtggggcctggagcaagctgcaccacttccttctgtaaaacaggccaaaggatggtaggtgatgtggatatgggctttcgtgagaattaaatgagtgggcatctgtaacacatgtcatcatcattattagtattcccaccactgttaacacaaggcatctgagaccaatctccactaacagcacactagaaagatcagctgtacctgggattgttatgatcagtcgaaacacacagttcaattggtctggtaataattatacacatcatcattgagccgtatcataattagataaaaatgctaagcagttagtatgaataactcaactaatattatttttatgcagccaagcagttgtagcttctcctgtctcacttattggttcccctttatttatcagcagtgcagacagttttctctagtaccctgtactgttctgtcatcttcatcatcatcatgttatgtttaccttcaaaagcacccagaatccatgcagcccctggctttccctgctgcagttccccctgcttttttgtttttgtggtttttgagacaaagtctccttctgttgcccagactagagtgcagtggcacagtctcagctcactgcaacctctgcctcctgggttcaagtgattctcctgcctcagcctcccgagtagctgggattataggcgtgcaccaccacgcccggctaatttttgtatttttttagtaaagatggggtttcaccatgttggccaggctggtctcgaaccgctgggctcaagcaatccacccacctcagcctcccaaagtgctgggattacaagcaggagccaccgcgcctggcctgatccctctgcttcttgctttctcccaccacttctctccttacccaagtgctgcaggcctgcacatgcagctcatcctcgctcctccccttagagggaactcagggtcataaggatatactgctgggagtagacaccctgcactcgctgctgctttcagctgcaggagatcctagccacaggcggtgactcaggcagaggagcaagcccaccccgcagaaatgggctctggacccctgtgactgcatggagcaggaggaggcagttagtgtccaagctaaggcagggtgaaggctgtggaggtagcgcaggctcctgtttgggtctgcagctaagatgggtctgaatcctggagccacaccaccttgaacctgcaaagcaagtcccagaattttgcagaagttcttcctcttcagtgtatagagttgggtggagggagtatagagccatcattcagtccttctcatctcacccaggatcacctgggagtgaccaaagtaggccaaatgtgattctagggccaaagtgaaggtgtccgccattccccgagtaagcaacttcctgtctattggctggtaactgggatggctttggagacacagcctgtctcagaagagaggaacagctaaccaggagtgataattcactcagtgccagtagcacatactgttctaaatctgaagaaggtagggagggttagaaagcaaagggaagacagtggggactaagaatgagtgtgggatgtcatgaggattcaggggagaatgcaaggagaagagacggccacagggtttgtggctatgccgcctgccgtggcccacctcatccccacatctgagcccaggcagatggaagtcccctgcagagcagtgttctgtcctggagtttcctccacaccccttcttgggaccagggctgtttcccaaatagcatcactgttcccgtgcaggccaggtgaggtgcctgggagcaggggtagggtgaggcaggcatggcggtgacctctcaggcagcttcgttgtgggatttagggcacagcgggaaacgtccagggcagaggttgcctcaccagtcacatggtactatgtaggaggtggtgtttaatagattctgtttatcaataagtggatgaagtggagatagacttccttgttcagtcattgaaacaggagagagggttacttgacataatcactttgtgttaaagctgtagtgtatgaaaagttcccaaaaattctacaagacaagcaacctagcaggaaaatcagaacaggtaacagtaagacaaatacgaatggcctgaaatcccgacaggtttttcagtctaaccaactcaaagaaagcaccttaagttgcaatgccatttcacctgtcagatgggtggggaggacttggtcctcccaccaccaggggtgaaagggtagtgtgggccaacacttcttaatgtgtgattctttttttttttttttgagacagagcctggctctgtcgctcaggctggagtgcagtggcacacgatctcaactcactgcaacctctgcctcccgggctcaagcgattctcctgcctcagcctcccaagtagctggaattacaggcgtgcaccaccgtgcctggctaatttttgtatttttagtagagatggggttccactgtgttggccaggctagtcacgaactcctcaggtgatcctcccgcctcggcctcccaaagtgttgggatttcaggtgtgagccaccacacctggccaagtgtgcatttcttttaccctgcattcccacttctaggaacgtgtcctgtgtaagtacttgctcagcatgctcagagattcccatgccagcttatttactgcaggactgctcataagagcaaaaataggaacgtgcccatctgtggggaactggttatgtaaactgtggtagagccatatggtggaatactctggagtcattgaaaaggataaggctggtttatatatatattaaataagttcctgacaagttggggatcccattgtttaaaatccttatgtttcatagaaggcaccggaagagtctataccgaaggactcaggggctaactctgaggagcaggatcatggttaaggaggctgtgtcataagatcctgcatcttctgtgtttttctcaacaagtctgcactacttccataatttgaaaggcaactgtactttttttaagggtaaaattaactgtttaaaaggggggtgaggatctggcaggtgaggggccctggagacagagcctgatcatgtgtccagagcagaagggcttggagatcacagagaccagggcaggcatcccaggtctgtcactgtgagctgtagccctcgccagtgccatcacttctccaagtctcattctcttcacctttataggctgtgtcctacccagcctgagggccagccaggtgagagtcagtgggggtatgtgacacatcgcaggtctcagcacctgctagttctctgccccatccccatgagttattactttggcctcgggagtcccctgagggacccataaggacagcgcacagctttgagccctgaaacagcaggaaggctccacagtcacccctgaccaccctcctcagcagttcagcactgactctcagtgcagatattgagctcaacacctgccatgcaccttctcaccctccccccagccaggcaggacagaccttcccatcaacaaggaaactgaggttaccagaaacccacttgccagggtcccctgggcgtgtaggagtagagacagctagagccaggattcacctcccattcccattctcatccctcctgcttcagtgacatccatcccaatcacccttgagaaagaggaagataaagtgtccttcctcctggcctcagcacctcctcacttggcaagcacttggtgggcatcaggctgggcccagcactgtgcccagggctggccatacagtggtggacaaggctgagtgcctgtcccaaggagcccacagttcaggcaaacaggacagcagaagtaaagaggctgctcagtaacccagcctcaaatccctgcagaatttggcctgacttcagaagctgctgggtgcttgtttgcctgtgagctctgccagcaaagtaaatagaccaatcgggcgcctcctggctgtcttcacagccatgacaacggcattctcccagcattggaggctagatatgcaggagagctctcagccacaaatgatgtgaataaggtcaatagtgtctatttgctgaacttgtcatcaaagatggtgaaactgatactttactctctgggtgagagggctagtgtttacactgaatccaaacatttggataatgacatggtgcctcctcagcagtgactgtgtcttcttgttcatcataataatgttattgattagcggtactgaacatgtaggtatgcgtagtagtgagatgccgaggttaagagctcagctccaggaattgcatggttctaggttataattcttgctctgtcactgtattagtcagggttctccagagaaggagaacctgtgtgtgtgtgtgtgtgtgtgtgttgaaagaaagagatgtgttttaacgaattggttcacacagttgttggagtggcaagtccaaattttgaaaggcaggcaggctggagagccggggaagttgatgttgcagctcaagtccaaaggcagcctggaggcagaatttcctgttccacagtggggccacggtaggcactcagtcttttttcttaaggccttcagttgttggatgagggccactcacattatggagggtaatctgctttactcaaagtcttctgatttaaatgttaattgcatctaaaaaatatcttcttagtggccgggcacagtggctcatgcctgtaatcccagcactttgggaggccaaggtgggtggatcacctgaggtcaggaattcaagaccagcccagccaacatggtgaaaccccatctctactaaaaataccaaaaaaaactagctgggcgcctgtaatcccagctactcggggggctgaggcaggagaatcgcttgaacccgggaggcagaagttgcagtgagctgagatcgcgccattgcactccagcctggggaacaaaagcgagacttcatctcaaaaaaaaaaaaaaaaaaaaaaaaaaaaaaaaaaaacaccttcttagcacattgtttggtcaaacaactgggcaccgtggcctaatcaagttgatatgtaagaccaacatagccgctgccagcaagttactaacacttctgagccttggagcctcggcttccttgcctgtaaagtgggggtaagaagaccatcttgaaaggttgttttgaggttttacgtgagatgaaatgggtgtccaatggagtgcctttagcaggacacctgcttacccccacctctacccaggacatcatgatgcgggggaagtggtggaaccttcagaacccagcccctagtatgagaagaattctgccatcacctttctttcagcagagagggaagcagtccccttccgtgacagtcacatgcgtgagtgatggctccttccaatatcctgcacttcttactgccccttacctggcgttgctccactctgtctcatgttctagttttcttatctctttctctttttttttctattttatttttttcctgtaggcacaagtgagttacagtaggttaagttacaccttacctttccttgtttttcttgtttatttatttgtttatttatttttttgagacaaggtcttgttctgtcaccacaggctggagtacagtggtgcaatcacagctcactgcaacctggacctcccaggctcaagtcatcttcccacattcaggcaatcctcccacctcagcctcccaagtatctgggactacaggcatgtgccaccacacccagctagtttttaaaattttttatagagatagagacagggtctcactatgttgcccaggctggtctcaaactcctgggctcaagtgatcctcccgcctcagcctcccaaagtgttgggatcacaggtgtgagccactgcacctggccttttgttttttttaagtagagacagtcttgctttatcacccaggctggtatacgatggcacaatcacagctctcctaggctcaaggattttcctgcctcagcctcctcagtagctggcactataggcaggtgccacgacacccaactatttttttttttttattttttatagagacagggtctcactatgttgctcctggcctcaggtaatcctcctgccttggcctcccaaagtactgcgattactggcgtgagccaccacactcagccgagtgcaatggcgcgatctcagctcactgcagcctccgcccccctgcccccgggttcaagtgattctccttccttagcctcccgagtagctgggactacaggcatgtgccaccacgcccagctaatttttgtatttttagtagagatggggtttcaccatgttggccaggatggtttcaatctcttgacctcgtgatccgcccgcgtcggcctcccaaagtgctgggattacaggcgtgagccaccacacccagccctgctgttacctctttcttacctcagctatttgaggatagagtctaggtcctgtcctgcatatagaaggtgcttatcatgtgtcttttgagtgaacacagagggtgacattgtcacgtgcagtgccaacagaaaccaaatgactagacacctgctgaccttccatggccacagggaggatgagaaaggcacctccaggaggtgtgaataatctgagggtattggccactgtggacaagactcggtggtggaagtgagctcagagatccaaagggaacgtgagtagagacatgcagagtctcgcagaggaagcagacgtgcaggccacaaagacaaaattacaagaaatgccccaacacgagcatatgctcacggactgcacagattcaaggaggaagtgccagaaaccctgcctgccccagcatctgcacaggcgtccacaaagggtttctgtcatgttatctctttttcttccaacatccggtgctgtgagttttattgtccctgttataatgcctccaggagtggcaggtcctgcccagccccatcagccagttggtgctgcagtcaggacacccaggcagcctgaggactgccagatgtgcagagagctatcgcgtgcctgctgcgtgcccagcacctcacacagctctcagtgtctgaccacgctggtgccctggtggacaaagttcctgcccttgtggcccttttgtctagtgggtggcttccaacaatgaacacacacaggatatgtcaggcggtgacaaaggctactgagaagaccaaagcggcttcaccctcccagagcacagcttttccctcccaggcccgagagatgtagggagcccactgtcccagtctgggtcaagaggaacagttacacaccttggaatgactgaagttgggagctaaggtgccaggacaagacaggccattttaggaaccagagacttgtgttacccctaaacctcaccagccaggaggggagcagcccactgggtcctctctgccacagttgggtgcttcttgtgctccccctcctgtggtcaggataggggaagcaggctttcctgctgccactcctaggacccaaggggaagctgggggagtggggagaccatgtgggaaggatggagtgcactttgattggtagcaggtggataggtactcccatggtggggaaatcaaagttgcttggcctgtgtagtagacaggtattaccacaggcctggaaaacattagcctgggtttatctctgtggcttcggtcccccaacatccccttctactcaaaatggctgattctctggtttggaggtttggcacctgcttttggggaggttgctcagtcattagagaagagtgcagaggttggacggtcatcatggcagaggtaggacagctggtatgtggggccatgaaaccagctttgggctaggagtcaggaagctgagactcagttcaggtcccctttccaagatgaagagatcatttccgagtgtccaaagggcactgggaagagaatcctagcagttcttatgaaatcatctgacagcagatatatcctgaagtcatagccttagcaaactgcctttctcgccaacacactcaacaccccgtggttcaaacatctatacgtctgatagaaaaacttggagaaattcagtgtgttgcttaatcaatatgactgatacctaagctgttctactcaagaagttttcatgggaatgaacttgagcttcttgaagagattgtttacagcatccctggagtctatgcaagaatagaacttcctgtgggggatggtggggaggctagctctgcagaggtctacagtcctgcagtttctgcaaaacacgttgcacacatctccatatgggccacacggtggcaacctctgaaccaggagagctgcttcctaagggctaagaccctctgtctgctttctctctcttgctttcctcccaaaacacagccatcctcctccccactgctaccccatggtgagttcagcccaggaagcctctgacccagccctgatggtaatagctgctgtgtactggacatcttctgtatgttaggctctgggagaaatgctgtggagactttttgcccatcctcccagagaagctgtcagtaccccctgttctaggtgaagaaactggtcctcagaaaggttgactccctgaggccacacagctgttaagtggctgaggcgagggctgtggggctgttcccacgccctggcttccaggcctggcagcatgtggagctgcccctccatcgtgtgtccgcagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaaggtacggactggggggagcggtggctggccactgaggctgtggtcacatggtgaattgaccctccacaaagctttccttgccttggggtggggccctgactgtacctattgcagaattcctgcccaggaggcagccaggcccttgtgctccagacctcagctctgggcactgcaggagaagagggggttcccttgtcaagcctaccctgctgggcacctgtgttgacccagctctgtgggtgattgtgtccccctggggaccaggcagctagggcagaatgagggtcttgggctgagccatcgtcttacctgaggtctgggtttcttgtttctcaaggctcaaagcgggctctgagaaaaaaggacagacatttgtttttccagtgatatttgtgggtccttcctaacttcacacccatcaaaatctcacagattattttattgaatcaccacctcacaaatacacagaaccagatacatttatgaagaaatcaagttagccgtgagacaatcttatgttaccaaactaacaaagaagcttttttttttttttttttttttttttgagatggaatctcgatctgtcgcccaggctggagtgcagtggcgtgatctcagttaactgcaacctccacctcccgggttcaggagattctcctgcctgagcctccagagtagctgggattacaggtacatgccactatgcctggctaatttttgtatttttagtagagatggggtttcaccacattggccaggctggtctcgaactcctgacctcaggtgatccacctgccttggcctcccaaagtgctaggattacaggtgtgaaccactgtgcctgacccaatttttgtagttttaatagggacggggtttcaccatgttggctaggctggtcttgaactcctgacctcaggtgatccacccacctcggcctcccaaagtgctgggattacaggcgtgagccactgcgtccagccccaacaaagaagctttaggacttctttagacatttaaaatagttgtgtttttttttttgttttgttttattttgttttgttttgttttgagatggagtttcactcttgttgtccaggctggagtgtaatggcgcgatcttggctgactgcaacctccacctcccgggttcaagcgattcccctgcctcagcctcctgagtagctgggattacaggggtgtgccactacacccagctaatttttctgtatttttagtagagacggggtttcaccatgttggccaggctggtctcaaactcctgacctcaggtgatccgcccacctcggcctctcaaagtgctgggattacaggcgtgagccactgtgcctgaactaaaatagttttaattaaagttttagaattactttccttctccatctcccctccaaaaaaatttcttctcgttacttccaaatgtcaggagtgtttacaccttatacataatcgggccctttggcacagcctccctcccacctcctggtggcctttcctcacctgttcttggtgcttcagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacggtgagagctgaccagggcaactcacgggctgctggctccacacagcctgaaaccaaggtccagggagcccttggggcagcctagagggggcacctgtagagcagtgcctggcgcacagtaagcaccatggctgttggctgttggctttgctgatctggaccttggatcttagagcctaagacctgccacttcctcagactgccagcatctaccatgggtcccaggcgtggggtagtgtttacctccctatacctgaggtttactcattctggcccagaagggaactgataattgataccagcttgaacaatttggggaacaccagtcccagaaactcaagcctgtctcagatgacctgacacagcatgaaagctactgccaaggccaggtggcccttcttggttatagaaggcaggcagtaaccagtaagtaaccacatttgtcaactgccaggagccaggcagaagtttcttggaggtcacccactcccaggagacagagccttctctgccctgtgctccaggcctcctgcagagccttgtcttcggaccccagggtaggatattgcaaagcccacctgtcccctcagtacctctctgagtaagacccctagaggacaggggagagcctcttgtgatctctacaggcaggttagctgcttggccagcttttacccagggatgccctaactgccttgcatcttagagggtagcagtacctgagccctccatttgcggctctcctgggtaatggggtctggcaggtctgggtttgactcctttcttaggaaatctcggaactgactgaatccctctccttacgctaactccaggagaagtcgaattcgtatcctactcaattactaatgacaacaatttttgagtgcttactatgtgaggattcttatttaattgatctaataactcagtaagttttaaaaagtattagcctcatttttctgattaaaaaagaaaagtggccaggtgcagtggctcacacctgtaatcccatcactttgggaggccaaggtaggaggattgcttgagtccaggagtttaagaccagcctgagcaacatagtgagacctcatctctacaaaaaaaaaaaaaaaaaaaaaaaaaaatttagccaggcttggtggcgtgcacctgtagtcccagctactcagaaggctgaggcgggaggatcactttagcccaggaggtcaaggctgcagtgagccatgattgtgccactgtactccagcctggatgagagtgagaccctgtctcaaaacaaaaaaagaaaaaggctgggcatggtggcacatgcctataatcctagcactttgggaggccaaggcgagtggatcacctgaggtcagcagttcaagaccagcctggccaagatggtgaaactctgtctctactaaaaaaaaaatacaaaaattagccaggcatggtggtgggcgcctataatcccagctactcgggaggctgagacagagaattgcttgaacccgggaggcagaggttgcagtgagccgagatcgtgccactgcactccagcctgggagacagagcgagactctgtctcaaaaaaaaaaaaagaaaagaaaaagaaaagtgaaggagtctgccccaagtcacaaagctagtaaactgctgagctggaactcaagcccaggcctttgtcaccaaagtctgtcttaccccagctagcgtagctcagtcactcagtaagttagagtccttgtgtgctgggcactgtgaacaaaacagacaaaatcactgctcttgcaaagatacaccaaaaaaaaaaaaaaatcacatcttgtggagcttgcgatctggaggggccaccccatcattcctaccttgctgactctagagcttctgggggccttaggctccaaaaggatttggcccatgcacctgtaaagggatggggatgtcagaggtgctggggcctgcctgggctccttgctgactgcccccttccctgtgcagctatccgttttggtcggatgccggaggctgagaagaggaagctggtggcagggctgactgcaaatgaggggagccagtacaacccacaggtggccgacctgaaggccttctccaagcacatctacaatgcctacctgaaaaacttcaacatgaccaaaaagaaggcccgcagcatcctcaccggcaaagccagccacacggcggtgagtgttgctgctgcttggcctggcagcatcctgggctctgggtcccactgccgcctgcctgactccgggagagccaggccttctccctccctcaacttcatggtgcaggcaagggacatggggagcacagggtgggggtctcccgaggcctgatctctaacggggcctggttttcagccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggaggtgagtgagagtggggcaggtgggctggcctggcacacccagtcgtcctgggggttggccctcactgcagggcactgtgcctgagctctgacagtgtggggaagtgtccctgtgatcttggcagtggaacatgcaaggcactgactgagcatgcaggatcagctccatctcattatgtacgtagatagaggtggagacaggaaaaagactaagccagacgtggtggctcacacctgtaatcccagcactttggcaggccgaggcgggtggatcacttgaggtcaggagttcgaaaccagcctggccaacatggtgaaaccccgtctctactaaaaatacaaaaaattagccagatgtggtggcacgcgcctgtaatcccagctacttgggaggctgagccaggagaatcgcttgaacccgagaggtggaggttgcagtgagccaaaatcccaccactgcactccagcctgggtgacagagtgagaccctgtctcaaaaaaaaggaaaaggactaacaggcagtatgctgtcatgttaatgtggggtggaaaaattgtctgcattttttctgcatttttaaaattccaacacaataaatacaataataactatgctaactaacagtggtctagagcttacttcatgccaggcactgttcttttcatcgatgatgactcacttgatcctcacaacaaccctgtgcaggaagaatgttttgtgtctccattttacacatcagagaggctgaatgacctgcctatagcctcacaggcagacacaggatttgaattaagcattgagtctcttaaccacaatactacgttgcctaatcgggggggaggtgggggcaaattggcaaaaaacaaaagaagtggattaagaccaggggtagggagattagaacacccagtggagcattgctgatgggacagggcttggtctgtcacggccaaggaggcctgccgtcccctgggccaagtcacctcttggggtggaagtaggggagctccactgcctttctgagctccctggcgtgccctgtgtccccacagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcctctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctatgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgcccccacccgggtctggtgctgaggatacagctcttctcagtgtctgaacaatctccaaaattgaa

SEQ ID NO: 17469 - DNA, 15975 bp, Human
cccagaggtagaaaactggcactgagttttgagttactgtccacctctctaaaatgaggcctgctgtcagactcctgggtgagaacatgtgtttgatggatgtacatgtcaaagaaaatttagataacgcagaggacaggctgggtgcggtggctcatgcctgtaatcccagcactttgggaggctgagacgggtggatcacctgaggtcaggagttcgaggccagcatggccaatatggtgaaacccccgtctctactaaaaatacaaaaattagccgggcgtggtggtgcacgtctgtaatcccagctacttgggaggctgacacaggagaatcccttgaacctgggaggtaaggttgcagtgagctgagatcgtgccaccgcactccagcctgggtgacagagtgagacttcgtttcaaaaaataaaatttttaaaatgcagagggccatcctgggcaacatggtgaaaccctgtctacaaaaaatacaaaaattagctagggctgggcacagtggttcatcccggtaatcccagcactttggaaggccgaggtgggcggactgcttaatcccaggagtttgagaccatcctaggcaacgtggcaaaaccccatctctacaaaaaatagaaaaattggccgggcatggtggctcacgcatgtaatcccagcactttgggaggccgaggcgggcggatcacgaggtcaggagttcaagaccagcctggccaacacagtgaaaccccgtctctactaaaaatacaaaaattagctgggcatggtggcgggcgcctgtaataccagctatttgggaggccgaggcaggagaatcacttgaacctgggagatggaggttgcagtgagccaggatggcgccactgcattctccagcctggacgacagaggtagattccgtctcaaaaaaaaaaaaaaaaaagaagaaacattgctgggcgcagtggctcacctctgtaatcctagcactttgggagaccgctgaggcaggtgtatcacctgaggtcaggagtgagaccagcctggccaacatggggaaccctgtctctgctaaacatacaaaaattagccgggtgtggtggcgggcacctataatcctagctacgcgggagggtcaggcaggagaattgcttgaacccgggaggtggaggttgcagtgagccgagatcacactattgcactccagcctgagcaacaagagcaaaactccgcctcaaaaaaaaaaaaaaaaaaaagttagttgggtgtggtggcacatgcctgtggtcccagctacttgggagcctgaggtaggaggattgcttgagcccagaagttcgaggttgcagtgagccatgatcatgccactgcactctaacctgggtgacagagcaagaccctgtcttccaagaaaaaaaaaagggctgggattggtggctcatgcctgtaatcccagcactttgggaagtcgtggtgggcaaactgcttgagcacaggagttaaagaccagcctgggcaacgtggcaaaaccccgtctctacaataaatacaaaaatgagctgggtgtggtagcgtgcatctgtaccccagatactcaggaggctgaggttgggaagattgcttgagcccagtgggtggaggctgcagtgagccaagattctgccactaccctccagctgggtaacagagtgagcccctgtgtcaaaagaaaaaagaaaatgcagagagatcagagaaaaaaaatgggtttgtgatcctgttattcagagacagaatcaccctcttccctctccactccccataaacacaaccacagtctcacgtacactggggtttaggaggcgggcggacggcaccgggcctcttccatggtgggagaacatcttacttaggttgattcaggtgtcctcagcctggctggcagagagcagagacgggagcaggcgcggcagggcaggcggcactccctgtttgagagtagaacctacatttgtttggggttagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggtagagaccagagcattccagtcttccttccttccgtcatccattgaggaggggtccacagcctgcagctggcagttctgcacgtgtcccccctggcctgggctctacagggtctgccctactgcttggtgctgcgggatcatgacgacctctgcttctccctcctcattcaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagtggccccaggcagctctgcccaggttagttctggggttggtctgcagagggtggcgttgctctccttatcgttaagggaaccttgctcctggcacctttggcccaataggtatgttctgcagctttgccaagttggggtgttgcgctgatgcctgtggcctggtcttcgcattcagctgtgggccttctggccactctcctgccacagccgcctcagaactgcttttgactgttagcttttttttttttttcaattatgataaaacatgtaacaacatttgccctttttttttttttgggagagtcttgctctgtcacccatgctggagtgcagttgcgtgatctcggctcactgcaccctccgcctcctgggttcaagtgattctcctgcctcggcctcccgagtagctgggactacaggcatgcactaccatgcccagctaatctttgttttagtagagatgagatttcaccattttggccaggatggtatcaatctcttgacctcgtgatccacccacctcagcctcccaaagtgctgggattacagatgtgagccaccgcgcctggccccgtttgccttttttttttttgagatagggtttctcactctgccgcccaggctggagtgcggtggtgcattcttagctcactgcaacttctgcttcccaggctcaagtgatcctctaacctcagcctcccgagcagctggaactacaggcgcgtgccaccacgctgggctgagtttttgtattttttggtagacatggggttttgctgtgttgtccaggctggtcttgaactcctgagctccgagtggtctgcctgcctcagcctcccaaaatggtgggatcacaggcgtgagccaccgcgcccggccacgttttaactattctaaagtattaactacattcagagcgtcctgcagcatccctatttccagaacgttttccttacccagaggtctggagtattggcgctctgggcgtgttcccacccaggtggcacccacacttcgtatgcccctcagccccaagggcattatgacccctaaggatccactgtgaaaactgccatcctgatcccgctgtccttctcctggggaagggctcctggacagtgtggcctcttagccgcctctccccgttaccaggacacagcagggtccttgtttgcacagtgtcaagatggggcctgtgggtttctattgtctcttttctcggtcaccaggcaggtggggctggggccgcacacttgtgctctagggacagctgaacctggatgtgggtgatggtgggtttgtgccgctcagagccagggtagtgtggataggagagaaagtctcgggagaggagggacctggggagtgaggggcaggagggcggccgggggcgatcggaccttcagctcctgtcctgtgtcgtttccagaggggagaagaaccttttagacagcagcatcataagccaaacggtcagacgggcagcctctgggattggggctgagtggttttggacacaaggaacccattcactttctttttttttttctttttctttttttgagacagagtctgtctctgtcgcccaggctggagtgcagtggcgcgatctcagctcactgcaagctccgcctcacgggttcacgccattctcctgcctcagcctcccgagtagctgggactacagggcacccgccaccacacccagctaatttttttgtatttttagtagagacggggtttcaccgtgttagccagggtggtctcgaactcctgacttcatgatccgcctgccttggcctcccaaagtgctgggattacaggtgtgagccaccgacccattcactttctgtagtaagcacggagcatccagcactccccgggaccaggtaggagggagggtagagccagcttcctggagcgcggtggtgcgggtgggtcaggatggcttgcttccatgttcttgttcttgtcatttagctgtttttgcagccacttcctcaagataactcaagacagtagatgctctttaccaggagacattctcttgatgtcccctgaagggaagagagttgctaaattagtctattgccattgcaaggtgcccaggaaattaaacctctgactagaaaaagccagtgaagtgttggataaagttgaaggaaccaaaggtctttttagagcttttattaaagagaaagttccaagtcttgtcctgaaacttgggttctggggcagactttctccagagcccacgaaactcgcgaaccctgtgttgtcacacagcccacagctccttcagtgccctggatgtctgcagtggccgctgtgactctatggacagtttggtgatatgtgtccgcgaaggctgggagggtggtttcgttgctcttgcctgcaaaggctcacacgtggccatccatgtgggctccccacaggttaacgttctgtctccattctctggagtccactagagctgggcacagacaaacccacttgggtttgatgccagttggtgggtggcgctttcctgcccactgaaggtggctcaggtgtctgtgatggcgaacgtggtcgttgcaggcagctccgggcagaagcccggccccctgtccggtgcacgtggtaggggctgccctggaagtcagagctcaccccgcagctgagaggatgagtccaacttgttccttttccaccaggctgttaacccccatccctcaaagtgagtgaggccttcctgtgtgtgcagtggccacagtgggcagcctggctgagtcgggtgctcttgtgtggcccgctcttgcctgctcttcccttccttccctagcaggcactgcaacccaggaaaacctctgcgggggctgctggtcactggcaccatgggtgtgagagcttctgatatttcactttttcttctcccccagctggcagcactgggcctgttattgttgtttgagaaagggtctcgctctgttaccaggctggagtgcggtggcacaatcacacttcactgcagcttcgacctcctgggctcaagcagtcctcccaccccagcctgctgagtagctgggaccacaggtgtgcaccaccgcacctggctattttttaatacttctgtggaaatggggtttcaccgtgttgcccaggctggtctcgaacttctgagctcaagcaatcctcctgcctcagcctgccaaaacattggggttacaggcgtgagccataccacccggcctgcattgggcgtttctatgctgtttgtcaccgtggcctggcagggctggcctcctgctgctgtgccctgctaagtggaccagtttcccttaccgcagtagaccgtgattgagtgtggtgtagcatctctgctgaaacgatggcagccctgggacagctgcggcagtgtctcctcctggcttcttggcatgagatggtgtaggcggcgcctgacactctggagggagtcagagacattgttctgcaggggtggggggatttcgtttgcctgcagttgcggcccggcgttactcctgggcacagtgcgagcccacccgtgccactgggagcacggctgtgatcagcagctcatgttccaaaggattccctccaagggcctcctgaacttggcttttctgcctctccttacccgcctttgcccctctggggaagaggtagcaggcttagaagcctctgcccctcgggttcgggcagggtggttggtgcttgtgccctggtttaacatcagctccttggcagtcaggccaggccagggtggcccaggcacagcgtgcacaagagcagggagtggcacctggtctctaagttactctgcagacgcatacatggaaacggccagtaagaaaggatgcgtgatttatttccccaagtctcatttaagaagtttgaggaggccgggtgcaggggctcatgcctgtaatcccagcactttgggaggctgaggtgggcgggtcacgaggtcaggagatcgagaccatcctggctaacacggtgaaaccccgtctctactaaaaatacaaaaaattagccgggcgtggtggcgggcacctgtagtcccagctactcaggaggctgaggcaggagaatggcgtgaactcaggaggcggagcttgcagtgagccgagaagcaccactgcactccagcgtaggcgacagagcaagactctgtctcaaaaaaaaaaaaggttcaaggggaccaggcttggtggctcacacctgtgatcccagcacttagggaggccaggacaagaggattgcttgaggccaggagtctgagaccagcctgggcaacatagtaagactgtctctacaaaaagtaaaaataaaataaatttttttggctggacacgctggctcacgcctgtaatctcagcactttgggaggccaaggcgggcagatcacctgaagtcaggagcttgagaccagcctgaccaacatggagaaaccccatctctaataaaaatacaaaatttgccaggcgtgttggcacatgcctataatcccagctacttgcgaggctgaggcaggagaattacttgaacccaagaggcggagattgcaatgaggcaagatcgagatcgtgccattgcactctagccagggaaacaagagcaaaactcagtctcaaaatagataaaataaaataaaataaattaaataaataagtattttaaaaagtagttctgtccaggtgcagtggctcacacctgtaattccagcactttgggaggccgaagcaggccgatcacctgaggtcgggagttcaagaccagcctgaccaacatggagaaagaaactccatctctactaaaaaaacaaaattagccaggcgtggtggcgcgtacctgtaatcccagctacttgggaggcagaggcaggagaattgctttaacccgggaggcagaggttgcagtgagccaagatcctgccactgcactctagcctgggcaacaagagtgaaactccgtctcaaaaaaaaaataaaatagtttgggccgggctcagtggctcacacttataatcccagcactttaggaggccgaggcaagtggatcacctggggtcaggagttcaagaccagcctggccaacatggtaaaaccctgtctctactaaaaatacaaaaattagccaggcgtggtggcgggtgcctgtgatcccagctactcgggaggctgaggaaagagaattgctggaactcgggaggtggaggttgcagtgagccgagatcatgccattgcactccagcctgggtgacaatagcaaaactccgtctcaaaaaataaaaaaataaataaattttaaaaataaataaaaaagtagttcgggggaatgatggaaggctcacccaaaattctcacttgaagagcctcagcacaggggcgcctctctgagcctgagccgaggccgcatcctcagctgcaggctgacccctcgtggttggggcgccacagcctctccatcttgtggccttaggactccctgaagctgccgtgcattattaggggtccccagggccttacaggcacgtggattgcgcctttcaggatctgttgtattagaaactagaactaagaatgtaaaaaatcgtttttttctctctatttatttttattttttattttttgagatgaagtcttgctctgttgccaggctcgaatgcagtggcacgatctgggctcactgcaacctccgcctcctgggttcaagcgattctcctgcctcagcctcccaagtagttgggattacaggcacccgccaccacgcccagctaatttttgtatttctagtaaagacgacgttttaccatgttggattaggctgctctgaaactcctggcttcaggtgatccgcccgcctcagcctcccaaagtactaggattacaggcgtgagccaccacgcctggcctgtttcactcgtcacccaggctggagtgcagtggtgcgatctcactgcaatgtctacctcccagactcaagcaatcctcctgcctcagcctcccaagtagctgggattacaggcaggtgccaccatacccaactgatttttgtatttttgtatttttttttttttttgagacagagtcttgctctgttgcccaggctggagtgcagtggcacgatcttggctcactgcaacctctgcctcccgggttcaagtgtttcttctgcctcagtctcccgagcagctgggattacaggtgtgcaccaccacacccagctaaatttttgtatttttggtagagtcgaggtttcaccatgttggccaggctggtcccaaactcgtgaactcaagtgatccacctgcctcagcctcccaaactgctaggattacaggtgtgagccactgcacctggccttttttttttttttttttttttttttgagacagagtttcgctcttgtcgcccaggctggagtgcagtggtgcgatctcggctcaccgcaacctccgcctcccgggtccaagcgattctcctgcctcagcctcccaagtacctgggattacaggtgcccgccaccacgcccagcttatttttgtatttttagtagagatggggttttaccgtgttggccaggctggtctcgaactcctggtctcaagcgatccacccatcttggcctcccaaagtgctgggcttacaggcctgagccactgtagccaaatttattttaaaagaataataatcccattacatgttatcataaatcacatctttacggaaactagtttgtcccagacaaaaacaatttagtgctgagtgatgttttagattcctccagcaggattctcctctcctgccctcctgctcttgcgacaccatgcgcccagcagcctctgtgggtctgtgccgcagcacgtgagagggagagtgaaaaggcagaggccagagaagtgtgagtgtgaaaatagctttgaccagccgggcgcggtggctcacgcctataatcccagcactttgggaggccgaggcgggcagatcacgaggtaaggagattgagaccatcctggctaacgtggtgaaacccatctctactaaaaataccaaaaattagccggtggtggcgggcgcctatagtcccagctacttgggaggctgaggcaggagaatggcttgaatccgggaggcggagcttgcagtgagtggagatcacgccactgcactccagcctgggagacacagcaagactccatcacaaaaaaaaaaaaaaaaagatcaagaccttcgtggccaacatggtaataccccatctcgactaaaaatacaaaaaaaaattagccaggcatggtggcaggcgcctgtagtcctagctactcgggaggctaaggcaggaaaatcacttgaacctgggaggcagaggttgcagtgagccaagatcatgccactgcactccagcctgggcaacagagcgagactgtctcaaaaacaaataaaaaagaaaatagctttgaccacatgggtgccctgaaaaggctaggggccctggggatgggccacacttcaaggttgctggaggaccacgtgcgccaggcttgcattgtggatgtgaagccagctgttgaattcacgggcagccataaggccgtgaccagagccagtcttactgtcgaggaacagccatgtcctgtacccattgctggacctgtggctcgaaaccccacgggagggcagggctgctggctgctgtgacttcccacgtccagggagacccgggcccaggggctgtgctcccagcagcaatgctcagtcagggccctctttctgtccacagtttgatgaaggccggaacaactttgaaggggaggtcaccaaggagaacctgctggactttatcaaacacaaccagctgccccttgtcatcgagttcaccgagcaggtgcggctgccctgcagcccccaggctggggatggggaggagtgggttgggggtggcatgaggctcccggtcaccactgctgtccagcgtctgacattggaggccattgggagaatcttctgcattaatagtgtgtgactcagacccagtaacttaagtttataacacagacagccccgaagatttttggaggtgaaatcaagactcacatcctgctgttcttgcccaagagtgtgtctgactatgacggcaaactgagcaacttcaaaacagcagccgagagcttcaagggcaaggtgagctgctcttctgggtggctcgtggggcggtgccagggagcagtacaactcttcccgaggtgacaagtgtggggccttcctgaggctgcctgctggactggatcgggcacctgattcaggacagcctggatgtaggcgaggggccagccaggccagacctctgctcccagtcacctgctggtctggttgggcaaccccggaatccaggttggaggaaaaaggcaccggagcacggtctgcttccgagcaaagtcagggctggaggcagaggccagccgtctcccgcacctgtgcaacctccttttctcccccagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaaggtgcaggcgcgtccccgggccagggctgcctcccgggtagagccgccaccttggggtctctgggctctcagtgtcctgggcttcgtcctcaaagtaagatcttcagagtaagaggacggagcccaagatggtgtgaagaccaccattcttgtcacacctttggggacctgtaggagccctcttgtccacacggctggcccagatgctcctcagggaaacctcctggccggcgagggtgcggcctgcgtgggctcattgggcccagcccactggcccagccttctctttctggattcttggcactgttggtgtctgcggctgccaccctggtgtgcccagggcagccacgcacctcagtcccgggcagggtgagggttggggagctctgtggtcccccaggcatcgccgcccctcaccgtgccctgcctgccctccagccccacctgatgagccaggagctgccggaggactgggacaagcagcctgtcaaggtgcttgttgggaagaactttgaagacgtggcttttgatgagaaaaaaaacgtctttgtggagttctgtaagtgttgccctttcagctccccaggtccgtgccaccagggcacgcgcaaggtaggcagactcctggggaagcgtctgccagtggctttgtgtccaggacacaccctagaactgctttcttttcagatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtgcgccttccctccagacggggctggggcgggctctgggaagagcagtggtccccacgccagcctgggtgcctctctggaaggagcctggggctagtcaggtgggagaagagctgtgggagctccttcagaagcacccacctttgtttttcgagagagatgggatctcactatattgcctaggctgtttttgaactcccaatgtgctggattccgggtgtgagccaccggaccgggcctgctctgcctttctctagggaggaggagccaatgccaggagattggctctgggccgggaccagcccctgcactcatccctgtcttccacaggtcattgattacaacggggaacgcacgctggatggttttaagaaattcctggagagcggtggccaggatggggcaggggatgatgacgtgagtggggtcacagccctgggctggtctctgggattcagccccttggccccacgggacatgcccacttgggctcggcttgtgatgggaatggtgccattggaggcacgtctgtgcgtccagggctctggggccccacaccttcgcccagcagggcaagggatgtgctcccagtgctctgctgaaacagctctccctggccagcacttctttaggggacgacgttgaaggcatctttaaaaaccagattttgcttagaaaaccttttcagacacatggcaccggttcctcacatgctgctaacttggactcagaggtccatccccagcccgctggcggggcccgggcacaagggcgcagacatgggtctgccctcgggagtttagtcctgcccgtcagcgcgtggccagcagcagtggtgactctgccggggaagcaggaaggctggtgttgggaggatgcggcaggggcggggtgcttgaccatggtgaaggagatgagggcatggtcagcccaggctggcagggcctgctgggagtgctggtgcacagtgggaggtgggaatactctgcccaggctggggatggagggccggcccctggtgctgcctgtggcctgtcattggccagagcccaagggttggaagtagaatggtcacaccccagtggtgactgtgcctggacttcatgctggggctgttgtccctgccgagatgtggaccctctgtagactccatggtgccaagctgggagacacacatacgccttccatgcccagtggaagggtccaaggctgagctgggattcccagggttcctgacacagtgggggctctgattcatcctgctataggcagaaatcccccaggcgtcactcttcctgggaagacccctgtgtagctcgtaaagaccagggttggctgctccagtggccggtggccattgttccgccgtggccggctagtccccggtgtgagcagtgtggggtgctgggggccggcagcctcagctgttgcagccaacctgcccgccccgccccttttcctgtatcccaggatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtccttgcctcgggtttatgatctcaccaagcccggagagctgggctggaatgcggacgccaaggccatctgccaggccttagtggggttactggtgctgagaggcctcgcccctgggacgaggtgcagatgcagaaacaggccccagtctccccagcagagctgtgcaggcttgcgattcccggggaggatgccttccctgcctgtaggctgctttacctggactctgatggggcttctgtgattctggaccctggatgtggacacgggtggagccacccagccccatgtgatgctcagactcctggtcattccctcccatccccgccgtggagtgacgagaaatcaggtggactcaggcttcaaggatgggtgagaggaacagggggccctgcttatcactaacccttcacacgataaagggcagggctgggcgcagggacgcgcgcctggaatcccagtgctggggcaacacggggagaccccgtctctaggaaaaattagaaattagctgggcatggtttgcacctacagtcccagctactcgggaggctgaggcaggaggatcacttgatcccaggaggtcaacactgcagtgagcggagatcgcgccactgcactccagctgggtgacagagctgtctctaaaaataaggatctcctggtctttaagttgtaatttggcttaacctcagcactcctgtgcttcacatgcagaaaaaacacatacactcgattttttttgagacggagtcttgctctgtggcccaggctggagtgcaatggtgctgtcttggctcactgcaacctccgcctcccgggttcaagtgattctcctgcctgagcctcctgagtagctgggattacagacatccgccaccacgcccggctaattttttgtacttttagtagagatggggtttcactgtgttagccaggatctgctggctgacctcgtgatttgcccgcgtcggcctcccaaagtgctgggattataggcgtgagccaccgcgcccggctgaaagtcaatttttctgcagacggcaagccgcggcctgtgtgcagggctgggcgatggctctgctgagcctggatttgctgcttttctgcaggggaggcaacaggagctctgtggtgtctgtgggtccccctgagggcaacggcagaggccctgaggatccagcagggctcatggtggtctcagagggcggtgaggcaggaggaaggagcccaagggtgcaggtggcaggtgggagtgggggtggagctgcagctctagggaggctgctcggccctcagaagttcggatggaacaaacgaccctcaccaggctgccttgaggagccctgcctgtgactctgtgagccccgccaacttcacatcctgatgtgcttcctagagtaggagcttccgcactgccgagattcccgggtgtcctcccagttcccgagcttgcgggctggctgcagctgctggagccagagacggctctcaagccagaccaggcctcgccgggggtgcggttctcccgttctccccgctacct

SEQ ID NO: 17470 - DNA, 8679 bp, Human
caagctagagcttcatacaagcaatgcaagaagggcactttagtgtttagcacactgtgtacttaatattcattatagtagtagcattggttttatttattcagcatacttatttacactttgaaatttgaaaactttatttttttttttttgagacggagtcttgctctgtgacccaggctggagtgcagtggcacgatctcggctcactgcaacctccgcctcccaggttcaagcaattctgtctcagcctccccagtagctggggactacaggcgcctgccacgacgcccagctaatttttgtatttttagtagagacggggttttaccatatcggtcaggctggtctcgaactcctgacctcaggtgatctgcccgcttcagcctcccaaagtgctgggattacaggcgtgagccactgcgcctggctgaaaactttattaagatctgtttttgaagtatgtgggcgaaggattacccaggtgccgaggcaagagactgaaggcacaaactgtttcagtataataaagaaaatagttagaataagaatagttaaaatacaaagtagatatagagatgatcatggacattatcaatcattagtataaacattattaatcatcaacttttaatattactctttgttgtattactaatataaccaaggaataaccggcaggtataggatgaggtgctgaagggacattgtgagaagtgacctagaaggcaagaggtgagccctctgtcacgcccgcataagggccacttgagggctccttggcaagcggtaacaccattgcctgggaaggtacccattacttagcagactgtgaaagggagcctcccttcccttggagtcagggaacactctgctccaccaaccagcttcttgtgggagattggatattatccaggcctgcccacagtcatccggaggcctaaacccctccttgtggtgctgtgcttcagtggtcatgctccttgtccactttcatgttcctcccgtactcctgattcctctttgaagttcctagaggatagcagtagaaaaaatagtgaaagtcttaaagtctttgatccttctgataagtgcatagaagaaaacgctgacgtatgctgccttacctctctgcttcagctgcctgaaagggaagggcccctgtcccatgatcatgtgacttgcttgaccttatcaatcacttggacgactcatcctccttacctcgcccccttgtcttgtatgcaataaatatcagcgcacccagccatttggggccactgccggtctctgcgtcttggtggtagtggtcccccaggctcaggtgttttctctttatctcttttgtcttgtgtctttatttcttatgatctctcatctccgcacacggggagaacacccgctaagccccgtagggctggaccctacatcagtagaattctagttttccttaatttcagatagtaatataatacagccatccctcagaatccgtggggaattgtttccaagacctcctttggataccaaaattcacagatgctgaagtctctgatacagcatggcataatgtttacacataacctatgcagatcttctcatatactttaaaatgtctctagattacctataatacctaatataatgtaaatgttatataaatagactatattgttcggggataatgatgagggggaaatctgtacatgttcaatacatatgcaatgtttttctgaatattttcaattaatggctagttgaattcatggataaagaacccactgatatggagagctgactgtatttcttattagttatttaactacctggagtcacgggggtaggaaagcactttatagtgctagcaaatgtatagattacatctagtattatgccagtttgttgctaaggaaaaaaaatcctttcctgtgttcttatactctgggtaacctctagagtagctcttgttttgtcctcatttgcaattaatttattcacagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtctttgactatacaaaacatccttctaaaccaggtatgtgcccttttctattcaaatacaaatgagtcactatagaaatacatggttccactcactgtgagtttaattgcatgttactctgtgtaatttaacatcttgtgatttgtattgatatgtgtatatttttcttcattttgcctccatgaaaaaataatgcttttttacatagaacaaaatactggtgctgtttaagcattatctatttgatcataacggttcctatatcatttataaatgttaagagctttagacatcttgaccaaaattccattatgctcagtaggcccagagagccagtggactgggtagtcttgatgtgtctgtcactttgcagatccttctggagagtgcaacccagacttgcgtctccgtggacatcagaaggaaggctatgggctttcttggaacccaaatctcagtgggcacttacttagtgcttcagatgaccatgtgtgtatccttcccattttgaagcaaatctgggctagttaccagttggtttcttttttggggtgtgtggggaggtgagaatcttccttttatataatggttaattttacatttaagaccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatgtgagtagaatccattcagagtttctaaatatcttgtctacgttttatgtttagtcaccatttcaaggtttttttcctttgtttttttttcactgaagttgggatactcgttcaaacaatacttccaaaccaagccactcagttgatgctcacactgctgaagtgaactgcctttctttcaatccttatagtgagttcattcttgccacaggatcagctgacaaggtcagtttcgtttattttaatagaaaacatgatttctctaggtttttttgaattgcagagatattttacttacagtattttttttttcttaaaaaattgattactcttgcttttctttttgtacatagactgttgccttgtgggatctgagaaatctgaaacttaagttgcattcctttgagtcacataaggatgaaatattccaggtaagagaaactaatgctactattttgtttgttttaagaaaaacctgctgggcgcggtcgctcacgcctgtaatcccagcactttgggaggctgaagcgggcggatcacaaggtcaggagatcgagaccatcctggctaacacggtgaaaccctgtctctactaaaaatataaaaaattagccgggcatggtggcggatgcccgtagtcccagctactcgggaggctgaggcaggagaatggcatgaaacccgggaggcagaggttgcagtgagccgagattgtgccactgcactctagcctgggcgacagaacgagagtccgtctcaaaaaaaagaaaaaagaaaaacctggatgtgtgagtgggcacacatgtgctttatgccgttgctaaaaatagaaatctatatgcctatgctactttctgtgggaattgttttttctttgttatttctatactttctcaaactggttattgaccacttacattcttcagatattaagaaaactaggccaggtatggtagcttatgcctgtaatcccagcactttaggaggctgagatgggtggattgcttgaggccaggagtttgagaccagcctggccaaccctgtctattttttaataaaaatttacaaagaaaggaaaactagtgcctgattattttttcagccttgtttctgacacttagtgatctcttcccttcttccaatatattcttcatccttcattacttgccacatgtgttgatttctcaacccaagcctcaacctctggctccatattttctacctcatcagtttaaacccatttatgcctagtgttccattattggaacgctaagcatgtgggagtttatatcctgctcaaggttatcgcccaggtctgattgcaaaaattaaaaaaagaaataatcactgcactatgttcaaagcttgttgctacggcactatgagagattacgttatgtagcctttgctatcaaggagcccccaatttttttattttttttttaattaatttttttgagacggcattttgctcttgttggccaggctggagtgcaatggtgcaatctcggctcactgcaacctccacttcccaggctaaagggattctcctgcctcagccccccaaagtgctgggattacaggcgtaagccaccacgcccagccgagcccaaaattttatagtgagggagggcttgtttagaaattactataataaaagattttgtcaagtgttatgaacctgagggtggtaaagattaattctggtgtgtgaaggtggcgtctgaactgggctttaggtgagccatactcctacatacttagtctcttattttctacttttcagcccaccttggtgaacattttatccttaccctatctctttgctttgcttgtgacggtattcttgcctggacagaatccaaattcttccttaattgctggtcactaatgccctctttttctgtaccttaaggctaggtagcacttttaccatatttggtaacaaactctgattgttggatatatagtagtaaattttttgtctgactctttaataaaattattgcatggagtcatttttaatcagacttatatgtaatacagaactcatagtaaatacttggggacatagttattgtatatgtcatctgtactttagttcttaggtcagaattggattgcatttgggtagaggccagaattagcaaataagaatagacaagatgtaggccgggcacgatggcccatgcctgtaatctcagcgctttgggaggccgaggcgggtggatcatgaggtcaggagtttgagaccaccctgaccaacatggtgaaacctcgtctctaataaaaatacaaaaattagccaggcatggtggtgcacgcctgtaatcccagctacttaagaggctgaggcaggagaatcgcttgaacatgggaggaggagattgcagtgaactgagatcaccccacaagaacagacaagatgtgatgtttccaaagataaaatgatgctgggcacatggcacacacctccagctacgcaggaggttgaggcagcgagatcccttgagcccaagagttcaagtccagcctagaagcaatatagcgaggcctcatctcttttttttttttgataccagcctaaccccatctctacacaaatacaaaaattagctggccgtggtggcggacacctgtaatcccagctacctgggaggctaaggtgggagagtcgcttgaacctgggaggtggaggtttcagtgagctgagatcctgccattgtactccagcctgggtgacagagcaagacttccgtctcaagaaaaagtgtgccaaaggggtgctgtgggaatggaacaaaagcttatatcctgggtctagaaatgtctagtaatgggttgtttttgtaaacattttttttttgtttttctttttgtttgtttttgagagagtctgtcacccaggctggagtgcagtggcacgatctcagctccaacctctgcttcctgggttcaagcaatcctcctgcctcagcctcccgagtagctgggattacaggcgcctgccaccacacccagctaatttttgtatttttagtagagacagtgtttcaccatgttggttaggctgatcttgaactcctgacctcatgtgatccacccgcctcccaaagtgctgggattacaggtgtgagccaaccgcgcctgcccataaaataaattctttagctcttaattttaactgtaacgtgtgtaataccttgacttcctcttcccttttatttacaaaatttttaaattgttaaatattttgtgaattttttccctttattttctaattcatggctttgctcttttcttcattcctatgtgtaggttcagtggtcacctcacaatgagactattttagcttccagtggtactgatcgcagactgaatgtctgggatttaaggtaattcttgtattcattcctctctctacataattatttcctttatttacactttgcaaaggtagttactaagggtaaatctgttttaacttttaaaattatgcttttgtactagtaaaattggagaggaacaatccccagaagatgcagaagacgggccaccagagttgttggtatgttaaaagcattggacagtactgaaatagtctgtaatttaatgtcctctatctgcatttcacctctttgttttcttccctctttcagtttattcatggtggtcatactgccaagatatctgatttctcctggaatcccaatgaaccttgggtgatttgttctgtatcagaagacaatatcatgcaagtgtggcaaatggtaagggtttagtcatttattttggggaggtgaaataagtgagacatagaatcaatttacatttgtatattttatgattacagctaccatctctgttcatttcactcccaggtgtgattttaagacttgtctatacattatcattttcagctgcctgctcttgactgtatttggtcataccactggtattttaaactctgctaaacaaaactgaccctctctcccacttctccttttccctctcctccttctttctttctttttgtatgactccaacattttcctagctaaccagacttgaaaactcaagaattttccatgtctgtttacctctagttctagttcacttccagatttcataccatctatctgcggtgtttctcccatcttatcatcttacaagtacaaatttacatacccaaaggaggtatatcatatcacagcatcaaatactactatttctccatgaaagctgtctagatttcaaaaatgttccctatctctatctcaaagaatgtgaacaccctccttaaattttctttcttttttttttttgagatggtctctcactttttcacccaggctggagtgcaatggtgcaatctcggctcactgcaacttccacctcccaggttcgatcgattctcctgcctcagccttctgagtagctgggactataggtgcgtaccaccatgcctggctaatttttttgtattttcagtagagacggtttcactatgttggccaggctggtctcaaactcctgaccttgtgatccgcccacctggacctcccggagtgctgggattgcaggcatgagccaccgcgcctggcctcttaaattttcaaagcacttcaatttaataaaaataactgtggtgtctcatacattaatatttttaaaatagttatattcggccgagcacgttggctcacgcctgtaatcccagtactctgggaggccgaggcgggtggatcacgaggtcaggagatcgagaccatcctggctaacacagtgaaaccccatctgtactaaaaatacaaaaaaaaattagccgggcgtggtggcgggcgcctgtagtcccagctcctcaggaggctgaggcaggaaaatggcgtgaacacgggaggcggagcttgcattgagccaagattgcgtcactgcactctggcctgggcgacagagcgagactccgtctcaattaaaatatatatatgtatatattccggagataggtggtggttatggttaatgcagtgtgagtgtacttaatgccactgaactgtacacttaaaatggctaagctgataaattttatgttgtatggagtttgcgacaatttggaggtggaagacagtttcttgctctgttgttcaggctacagtgcagtggtgcgattacagctcactgcacctccaattcccgggctcaagacatcctcctacctcagcctccctagtaactgggaccacaggtgtgcatcaccagccctggttaatttttaaaattttttgtagagatggggtttgccatgttggccagtctggtcttgaacttgtgagctcaagcgatttgcccacctcccagagtgctgggagtacatgtgtgaggctgcccacccgccccccgcttttttttgtttttaaagaagtgcgtaacttggtggttgtctggtaaaggaaaagaattcagaagaaacttggtgtctctcagagtagatctagtaccaggaattaagttccagggaatagtttttgactcatcatgaggagagggaggatgttttcatcagtactttcttattttttatttctttattttttttttaattttttttttttctgagacagagtctcactgcctcacccaggctggagttcagtagagcaatctcagctcactgcaacctctgcctcccaggttcaagcaattctcctgcctcagcctgctgattagctaggattacaggcatgcaccaccatgcccggctagtttttttg

SEQ ID NO: 17471 - DNA, 11002 bp, Human
  misc_feature (1)...(11002): n = A,T,C or G
tctatttttgtatatatgtatttacagtaggggttctagagagtgcagtggttgctgcactgggaatggggaggcctgagttatacgtccagttttccagtgactagcagtgtaggttcagttaagttgttgcttttgggacctcagtttcctcatctataaaatggaagtttggcctcgatgactgccacagtcactcccacattctgttgatcctgtctaggtgagggtgtgtctctgggcatgtatttgcaagccagaagaatatcagcgtggcaattcattcattcgaacatcccggagtgcctcccgcctgaaagtgcagtgctggctgctgctttcatgcgcaaggatgtgtgtccctggctttgatggctctgcactggatggcaagggtgtggacgccaccatatgtctgtaggaacactaaccttgggtgtctgattctgtatgtgatgaagtcagtgtgtgtgtgtgttcaccagtgaggccaactggggaggagaaacctgtgtagaagtcttcaaggttaaaacaatttgtgtaacgcgaccgccaggcctgtatagcactctgcctggatgagaagcagatgttgctgtgggtggagctgcagggaagctgctgtgggtcccacctgtagcccagcctcccacttcccccagcccagcccagctcagcatgcagctcccatctgagcgccttacaaagcggccagttctatggcctctgcttccttttctccagacttctcaaaaggaagacagacagttcagccgggtctctggaaacatccctcctcagctccagatactggaatcggaatggccctttagggaggctctcttcccctctggcctttctgcttgggcagcctaagacttggaataggaattacttgagaactgttaaactttttcctcctagctgggaagctcccagaaggtatcttcgtttcccaaagatgcttatctgttctaatgaaaaatggtacaattttatttcctcttttttttttttttttttttttgagacagggtctcactctgttgcccaggctggattgcagtggcatcatctcagctcactgcagccttgacctcctgggttcaattgatccacctgcctcagcctcctgagtgagtagctggaactacaggcatgcatcaccatgtctggctaatttttgtattttttatagagacggggtttcaccatgttgcccaggctgatcttgaactcctgagcttaagtgatccacccacctcgacctcccaaagtgttgggattacaggtgtgagccactgcacctggcttattttatctcatagacacccccttagttaaattgaaacagcatttgctgagtgaccaccacatgctcagcacaccctgttttattttcttcatagctcccattgctatctggaagaccctaggtcagtatttatttacttgcatattatggaaggttagctccaccgaagcaggggcctcttctgtcttgctaataactagggtattgtctggaccacagtagtatgttaactaagtatttgctgaagaatgatggctctgtggctcacacctgtattcccagccactggagaggctgaggaggctggaggatcacttgaagccaggattttgagaccagcctgggcaacatagcaagaccctgctaattttaaataattagctgggcacagtggtgagaccctatctgccccacactccccaaagaatgatgagctaacagactggtaggggctgagcatcagctttactgggattttaactgaaaagtaagcatgagcttcccaagaaattctataagctgatccctaactgcccttctccttctcgttcagatggcatttgaggatcacagtcgctgtggaggttgggggctggtgcccacagggttggggctagaagcacggtgcacctagggctgggtaggaggattaactcagccctggcttcttcttttctctttagctgcctttcttggggacattgccctggacgaagaggacctgagggccttccaggtacagcaggctgtggatctcagacggcacacagctcgtaagtcctccatcaaagctgcaggtaagccgggtgccaatgggccctctgtgtcctagaaatgggttccaggcttagggaaacaaggaatctccctgttcccagccaggccctcccaggacagaggccatgagtttgaccccagcacatgggtctatcttccctcgggatatcttcatcccttccccagaggagtagtaaatatagatatccccagcaactaagaactgacattctttttgtttacagtttaaaaaccactttcaaaagtattgtctagcctgactgtccccaaccacctttaaaggtggtgtcaggacaactcctgttttacaagtacagaaactaagattcacagaggtaaagtgacctgcccaggatcacacaactagtgagtggcagagctgggactggaactcaagctttctcactccagacctgagactctgcccaacactgcaatccctcctgggctctctgttcccactttgcaaatttctgtgcatcctctgaggcccatttcaggagcttctcctattcttctttcccagttgcccccgaaacatgactgtcccttcattttccctgttttctccctcctctgtgatcacactgttaccctgtcatttatcacaccatattgaaaggatttgctcctatgtctccctagctctttaaggtcagggatgctttcttcttatccttgattgtggtccaaactcctaaaaacccatgtggtacttgtgcatggatacaggaatgggagggatgagggcctgggctgtgtctgttctttccagtcccttactgctctgtagaagggtgaaagctcctcactgccagtgctgatgtttgagacatggtcctgagagcacacaaatagccctccccttcccaaagggcaggggcagggattctttcttctttttttctgtctttttttttttttttttttttttgagacagggtctcagtctgttacctaggctagaatgcagtggcaccatttcggctcactgcaacctctacctcctgagttcaagcaattctcgtgcctcagcctcccaagtagctgggaccacaggcatgcaacaccacgcctggccaattttttatatttttagtagacacgggatgtcacggtgttggccaggctggtctcgaactcctggcctcaagcgaactatcctccctggcctcccaaagtgctggaattacaggcgtgagccactgtaccaaagggcagggattcttattgagggtctgctctgggaacactgtggtgtgcctgaagttgtcctgtccagcttgagggaagatcctgatgtgggcaccttatggaataaagtaccccagagggcaggtggcattggagggtgacctggtggcctgctaacaagtaaggctcatgtgaccttagtggggactagtaggtatggcacaacggaaagctgcatggaggggtcccctgctaacccaccaggtgactttggccaaacctttggccttagtttcctcatctgtcaaatacaatacgacacttgtccacatgccttagagctcctatgtcaaatgcaaacatgaatttgggaaatcaaaagaaggcatagagttctgaatgctccacaaatgtcaaggtttattcaatgagaagggatattttcctaatctcagatccccacaattcctagaaaatgagtacacctttgttctcttttacgattattgtcaattcttgctatttatggaagttatagaataactttatagttactctgtacagtcactgaaaacattagcaaatactgacccattgctcctagggaaaatacagggtcaggttccttcaagcctctggtcacaacatttttgtcaactgatcagtgcatcaccttgttttatgagtgtttctttttaaagacaccttacttaatatggagctgattcattaacattgaactcatgaccaacagcactctaactcatgcctcgaagaagcttacctagcacacgtatgttctctgtgaggcatatcacagccttcttgcccttgggaacaccagagagcacttcagcattatgctcaggggctgttttaaacagcgaaaccctcaacaaagcgcacaaaaacacaaaaaacagggcactttaactagacctcaaaaaggacacttggttacacaatgagagccgaaagcagaaagcggagcgttgccttattccacctcagctgggaacatgcatgttgggtgactgaaatttttcactgctctgcaaatgtccacaaatgaccgtgaaagccctgagagtattgattttggggactacgaataaattttagccagtagacaaatttgcaagcacagaatccatgaaaaatgaggtttgactatgcttttgctttcctcctctttctctccactcactagtcaccatgacttcctctctcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtgagcgtgctattgtgggtcccagagtgtaaccagcttccgggcctggccttgtggcagccctgccaggcacggaggcgtgggtgccacctgcagcccgagtgcccacacattcctttccaggcagtctgccctcagaatggctgtgactcttcagtggtgggtagggggtgggactgcctggacaccgtggcaacctggcttccttcctcctggcaggtagccagagggcagtcttccggcaggccatgaggcactgggagaagcacacctgtgtcaccttcctggagcgcactgacgaggacagctatattgtgttcacctatcgaccttgcgggtgagcaggaagccctaggcgctgtaccttccgccattgccccaacccaggttctgccctgggccctgccactgcccccagctgggcacagccttgggtccctttatcccctcctgctatggggcatctacccaggaactgccccctgtgcggctgtgacctccagcacacagcctgggcactcggtgctcagggcccacccctccccttcgctcccctgccgccccgcccccggcagcctggccccgcccctgagtggatgcactcccccagctcgggaccgcccccctgagctggccccgccctccaggtgctgctcctacgtgggtcgccgcggcgggggcccccaaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggtaggtacctgcccctcggtgcggccttggtgggcggctcccgccccagcccccacctccaggacccctgggggcagtggcagccgctccagccagccgtcatcgcctgggcccgcagcgctgcccacagcctgggttgagccagcccctgcccttgaggcatttcctcctccgtgtcagatcaaggacccgcatccattgtggagctcctctgggaggctgggccaggtcctggtcctggacagcggtagcccgggcagcctctagggtggggcatgggcatagtgggccgtcctggggactgctcaggcctttctccccacctttgcccactatctgccctctgcctggtctgccctccgagggcttttctctcattttctcgatgtctctgtccctcccttcccgcctcctccctctctcccaggcgttctccactcttcactgctccttctcagctgtggctctagaaatggtgcttccttcccatgttcccttgagtcctccattcaccaggccctctgctggacaggactcttcctgagaccctccccattccccaggctccccttggctgctccccggaccctcaggtagggggactctctcagatacaggaaggactccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagatacaggaaggactccattccctgccctggaaagtgagcgttgcatctcaggcagacccaccccctcctctccccccacacccttttcctgatcttggcagggcaggagtataacttcctgaagatggagcctcaggaggtggagtccctgggggagacctatgacttcgacagcatcatgcattacgctcggaacacattctccaggtgggagacgggattggggctgggcctctgctcgggcagccccaccctgccctctgtaggctattctcctcctgcctcccacttctggggcagtgacccaggaaaagagtggccctctggggggctgtggcctccaagcagagggtccgtggatgttgcctgccctcctgtcctcttccacgggtgggtctgtggcagggccttaccaccgtgtgcacccagggcacctggcggaggaggctgaacccagccactctgcaagcccagcagtgtggggtagccccaaactatcagcccaaagggtgctgagcttttatttgtgggccatttgtttgtttttgtttttgtttgagacaggatcttgctctgtcacctaggctggagtgcagtggcacagtcatggctcactgcagcctcaaactcctaggctcaaggaatcgtcccgtctcagcctactgagtagctaggatgacaggcacacgccaccgtgcctttttttttagagatggggtctcactatattgcccaggctggtctcgaactcctgggctgaagggatcctcccacctcggcctcccaaaacgctgagattacaggcgcgagccaccaatgcccagccattcctttttaattagtctgctttttttgtaattggccagtttgcacgaagcctgacccctgccctggactagcccccatgcccagctccgaagcacatcctccttatctgaggcccaggtccccagaagccacaaccagagccctcaaaggtggtggcccagcctcccctcccccaagattctccttagcagtgtgggaaatggcacctccctcctcctcaaactccttcctggcctggccattcccaggcctggtgctttgctcatcctctgtctgtgtcccagacagtggccctgccccctcttctcagtgcttctacccgatctgctcttcctgcctgcagacctgcaggaacagagaccaaggaagggtggtgaggtcattctgccccccacacccacagacccggccttacatttcccaccacatcccaccccaccccctgctgcgatccacccagctgggtgtgagtcaggggccctggggaggtggagggctgcctgcctccccttcactctgctcctcccagtgcaaacacccaggattcagcagggaggaatggccaggacaggagacactgatagattgggagctggtggggctgtccccggggcttggtctggctgcagtggaatctgcctttggccttgttccaggtgctttcagatgcagcctgtgccagcagggtgaggagctggcctggggagtcctgggagaagtttagttagggctggagcagcatgaggggctgcagaagcaggggcccagtggggctggagagagatgacccgctaggggcctgtagctttcctggggctgggagttgtggccagcctgagctgggagcaccagtgggtccaagggcaccctggacctgcatccctgacctcccaaagtgttcctggggctcccccgactcctgtggtgtggctgccacggagcagggtggctgctggtcagtgggtagcataatgacagggtgagacgactccacccggccctgaccctgctgaggaatgtctgagctccagcagggtcgtgacttgtgggtacagatgggcatgccacccactccctgcccactgtccatgagacgctcacccttacttttctccctcttcttcaggggcatcttcctggataccattgtccccaagtatgaggtgaacggggtgaaacctcccattggccaaaggacacggctcagcaagggggacattgcccaagcccgcaagctttacaagtgcccaggtcagggcagagaagggatgggtgagggcgtggagggcagggcctgagggaggcagaggccaggtgcctggtgccaccaagaaggcttaggctgcaagtcttagagaatggtgtggcgggggaggggaccccataggaggggcagtgtccaagtgaaggaggccgctgggggtaggctcaggtgggtggtcagaagccgagccgccaccttctgagggtctgtaggggcggaagtggggagaacagcaatcctaggagagggaggtggcacggagccccaccaagggagcttgaccttagctctggaacccatattgccttcacaaacagggcagcactgggctgggaggtaggatggcgtgtgctatatgtgaggtaggggggtggatcttataggggcaggaccattgcagacaccctcccactcctcaggcattctcccctcccccagaggatgccaaggttcaggggtgggtgagccagaagatggggggatttggcgcctgcagccctgccctgtcatttcctttcctcacagcctgtggagagaccctgcaagacagcacaggcaacttctcctcccctgaataccccaatggctactctgctcacatgcactgcgtgtggcgcatctctgtcacacccggggagaaggtacgtgtgggctcagcctctgagcctccccctcccctgcgggtccccatacctcagggacttctcccacagtgggggtcaatatgggtgccagcgacctacctggctaccgtaaatgtatcaagtccagagcgctgatggagcacggctgtaggaaggggctcctggcattcaccgccttccctggcatctcccaataattataaattagtgttaatttgcacatagcacttgctgtgtaggtctattttgattatctagttcttcttgggtgattttcctacatcacctcttttagtttttacggctacctccacctttattttacagatgaggaaactgaggcacagggtggttaagtaacttgcccaaggtcacacagctaacaaggactgaggtgggactggagctcttctcaggtctgggttcccttggatgaactgctcagcctgacgctcagctctcatccgtctcatcagggcttgggccaggggctcctgaagggctcttcccgattctgacaggctctagtcctgggaacaattaaggaatgatgcaggcgcctccagcaggatgctgcctggtgggtctctccttctcacccatccttccccttgctcaggccaggaccctccagtctttgctctgtgggcctgattttctgtgcctggctctccactggcactctatttctcctccctctacctgtcacctgctatatcagttctgatccatagagaaagctcagctccaccttctgtcttaccttgtggggaagtacccagttctcatacttgctgccacgtggggctggcttcgggcatactacgggatcgggtcagagctgtctccatcttcacagtctagctcggatgtgacctccttcaggaagccttccctgctcgttactaattggtggcaagtagggtggacaccgagtgtggggagggcccccgagcctgtccggtcaggtttcccactgcatggttgattagccctgtttgaatacctaaggtgatgagaggctcactacttttcagaataattcattctgttctctagccagctctttttttttttttttcttgagacagaatctcactttttcacccaaggtggagtgcagtggcgcgatctcagctcactgcaacctctgccgcccagggtcaagcgatactcccacctcagcctctgggagtagctgggactgcagatgtgcgctaccatgcccggcaattttttttctatttttggtcgagacagggtttcgccatgttgcacaggctggtctcgaactcctgagttcaagtgatcctcctggctcaggcttccaaagtgctgggattacaggcgtgagccaccgcatctggcctgtagccagctcttaatgttacaacgtctcttcttctcccttaagccccccagttgctccagtactttcctcaagagcaatgcaggataactcactccctctttcccatgtcagccctcctaatgtggggaggctactcccatcacttcttagatccattcccggtcttttcacacagactctggacctccgcaccaaccccagaccttctgtgtccatatttttattgctcccaagctacaagactttattttccttgattggggcatggttcttaatgtcatagtgcagcgttgagctggattcaattctattattgattgcattgttcatttcgacatctcaagatcattttgaatcagaatttcaccatccatcaggtagccctcctcttacctctgccatgagctcctttgataagcatgacttctaggtcttcgtcctggcctttgatcaaaacatagaacagcacacaaaccaaagaagaaccaagatttccctccaaattggcattaatcttttaatctaggctttgagcagagttattacaccagttatgatgccacttaaggtcattactatccagccacaggtgaccaccagttgaccgggatgtacgctccttctga

SEQ ID NO: 17472 - DNA, 11002 bp, Human; identical to SEQ ID NO: 17471
  misc_feature (1)...(11002): n = A,T,C or G

SEQ ID NO: 17473 - DNA, 11002 bp, Human; identical to SEQ ID NO: 17471
  misc_feature (1)...(11002): n = A,T,C or G

SEQ ID NO: 17474 - DNA, 29927 bp, Human; identical to SEQ ID NO: 11814
  misc_feature (1)...(29927): n = A,T,C or G

SEQ ID NO: 17475 - DNA, 29927 bp, Human; identical to SEQ ID NO: 11814
  misc_feature (1)...(29927): n = A,T,C or G

SEQ ID NO: 17476 - DNA, 29093 bp, Human
  misc_feature (1)...(29093): n = A,T,C or G
ggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcctctggccaccctctcgcctttgcttcctctgtcctactggggaggagcccctggaaggcagtggggaagggagaggctgggagcaggttcacaagtagtggctgggagtagtagtgaacagtgccctgtggatttcttgggctgagggtgaagatcatcctcaccacagtgtattcctcaatggtggtggtggtgggggtcctctgaactctagaaatccatgtgagtagtgggtcttgggctgcatttggaccaaggaatactccctgggctgagagctcaagtaagggctgctgtttttgactcctgttgaccgaggagccttactcttgatttaggcatagagctggaatctacctgggccagccagcgcaaggacagaccctgctcatagccaaagatagcttccctgagctagggagagggtgtagggtgagcaatgcacaaagattctatgctgctctgtgttgattccttctttctgtgaacacctgtgctttccacctatgccccaaatgaaatctcactctgggtctatttcagctggagcagatcagctttatattatgggactatgcacagggtttcttctgggtagagggagtaacactgccacagatactaagcctaaaaacccaaaagttgacttactccagcccaggtgggcctgggtgaactcaccagggatgctgctctctgggaggacctcaaagataacctcctcaaagataacttctctgatgtgggaataataaaaaggatttgttagtctctagtctttgaagcatctgggcctccaaaattccaaccctactacagtctcaagcataactgatcctcctgagagctaagagctaaagtcagggtactggccctagtgtctccaaactcaaggatagtcatatcttacttggatgaagccaaggttggcctggggtgacctgagggactggggcctatgtgtccatctttctagaatcgcccggaactgaggactgagagggtagggtattgtggtctatgggaactacagaccatagcgcatggtccatcactgtccagagcccaagggacccatcgggaccattgttctattcccttgcggctgcggttttctctgccttggcccagcctgcctcgcgccagctctggcatgggaccacaatgcgctgccttgccctggaaaagggtccagctggcagcctcgctgctccccgccttgatataatgctgcgctctcaagtggcaggtcgagtctccccagaggacgcctgagagcgaccgcgctccgcccaggattctctacggcctcggggccgctaagccccgcccatagttccgcccatccgagaatttgtccaatccaggcgaagtattcacgctccgcccaaagttttgtgttgtcacttccggcccgctccaggaagtcgtgctgcggagccaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttattttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcagcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcgtggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttggtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcnnnnnnnnnnnnnnnnnnnnaaaaatttaatttaaaaaaattttatggctgggtatggtggctcatacctgtaatcccagcactttgggaggctgaggcaggtggatcacttgaggtcaggagttcaagaccagcctggccaacatggtgaaaccctgtctctactaaaaacaaaaattagctgggcgtggtcgcgcatgcctgtaatcccagctacctgggaggctgaggtaggagaatcgtttgaaccaaggaggcggagtttgcagtgaaccaagatcgtgccactgcactccagcctgggcgacagagcaagactccacctcaaaaaaaaaaaaaaagttatgagtacatagtaggtatacatatttattgggtttatgagatattttgatgcagggatacactgtaataatcacttcagggtaaacagagtagccatcacctcaagcatttatcatttttttgtgttacaaacattcctattcttttagttactttaaaatgtacagtagattattgttgactgtagtcactctgttgtgctatcaaatactagattttattccttatatctaactttatttttgtacccttacttacttttatttctggttgatccttaccttgaaagtgtagtctttgggattccagcttaaaatgggggtgttatcagagtcctcatctctgagggcccctgagcttcgactatcatctctcccaaccccagtcaaagcccagaatgttgcctaaaggacagcttttggccaagccaacagggccaaaaaaagggccagctggttggagtcctgagtacccatcaggccttgcgggaggtgctgtaactgcctatgctactgtcctcttatttgggcaggcattgggtcaaggaggagcagaacagaccctttcgtggtcagaatgtttgcctggcttatgtccccagacaaaccagggctcatcagtctattgttctgcttttcattccagcctaattcagtggtttgagacagcaccaagtcggacctgcccacagtgccgaatccaggtgagagtattggggtgggaccacctcaactgaagagatctccttagcagagagcaggaatgtgaaaagagctctgaaactgcaatatctctgaccttttttggaccctcctggtttaaggccagttgagcctcacttgtgcccttgagtgtttgggaggtctgcttacacccacaggtagctggcagatggacttgttgcctgggccagttttcacttgggtagatttggctggcctccttccctgtcttttcatcagtgactccgcacctagagttcaggtatcttttgagcacttaaccgtgtaggtctgtagtaatatgacttcagtgaccacgaaaccagcagccccaacttggggtacctgcaggagtaaagaggtcttttgactctaaaggatgtactttgaaaaattaggtctgagaacaggcctgacatgcatgtcaggcaggtagtcagacccatgtacaacactctcctccttgcgcatgacccagctacacaatcatactcttaccttgttctcccatccaggttggcaaaagaaccattatcaataagctcttctttgatcttgcccaggaggaggagaatgtcttggatgcagaattcttaaaggtacccagaatttatctgattctactgaactccaagccttgtgcgagttcacttttcttttttcttttcttttcttttttctcttctcttctcttctcttctcttttctcttttcttttcttttcttttcttttctttttttagagacagggtcttactttgttgcccacactggagtgcagtggtgcaatcatagctcactataacctcaaactcctgagttcaagggatctccccacctcagcctacctagtagctaggactgtaggggtgcaccaccatgctcggttaatttttttattttatttatttatttatttatttatttatttatttatttattttgagatgaagtctcactctgtcacccaggctggagtgtagtggcgtgatcttggctcactgcaacctctgcctcctaggttaaaacaattctcctgcttcagcctcccgagtagctgggactacaggcacgtgccaccatacccggctagttttgtgtttttagtacagacggggtttcaccttgttggccaggctggtctcgaactcctgacctgaagtgatccacccacctcggcctcccaaagtgctgagattgcaggcgtgggccaccgtgcccagccctaatttataaaaaaaaatttttatagagatagggccttgctatgttacccaggctggtcttgaactcttgggctcgagcaatcctcccaccttggcctcccaaagggctgagattacaggcatgagccactgtgcctggcctgggagttcactttctatttccacataagtggagggttcctggaatatggagatgaagttatagaggtgagacttggtacagttttcaaggtggggacacaaaaatcagaggacaactgatgagacacagtcatcagagaaatgcactgtgagggaagaggggagctgcttgactgtaaaccctccctttgggatttcaggtcaattccaacctgaattctctcctgcggtcttgtctcctcatcttttaaagaacctacagccatcctgtacagcctactttgctgcttggacagttagtgacagattagaaaactcttctactccccagccacgggagatttttggattcagtgttccctagcctgcctgtgcctcaaaattgcctggggaggctgggcgtgatggctcacacctgtaatcccagcactttgggtgaccaaggtgggcagatcacttgagcccaggagttcaagaccagcctgagcaacatgggaccccatctctattaaataaaaaaagttaaaagaaaaaaaattgcctagggagcttggtataaagtcagatgcctgggccttccccagaccagagctcttggaatcaagagttgcagctcaggtgggaatggatatattaggggaaagtgggtagtttccctcctatacgtctaactgcttcccctcctaatctaaaatttagctttttttgtgtgcaagcaggctgcgttggcagagaactcttgaggaagttggatttgggttcacaaatgatccctggactctgagggttaatttgctggatatctgtcagatcagagttcatttggctctggccccagggtgtcatgatgtccttggaacctcactgcttcaggaacatggagcttttgtgcttagagcaagcatgttcatcgtcatggtaactgctcccagttttaagtagtgtcttccctgtgatgaaggcaacaaaggcagtttcatttatttccagctttcaaagccaggtttgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctggattccatctagctaccaccatggacccttggtcaagcgtttcagttttgtaaaaccttggatttctttgttatggagcaggcacctctcttgctcatggggatgttgagttctgtggcatcctgaacaggaactgggttcaattctgccacagcttctcaatgattctgtggcatggctgtgaaacatttgcaggggctttgagaggctcacttgatcctcacaatagtctagttagagactagacacatgggaggtttcatccaggggtacaaagctgtcctggcatagctacctccattggatactaggtctggaaggtttgtggtacacagagccagttcagagcttggaggaaagtcgactatgaatcaggaagacccagggtggagaggaggagtagtcgcccaaggtccttggccattcctattgtgtgtccctggtgagtcagctgatgcccagagggaatgagaccaacatagagcgatgaggccaaggaagtgatagaaacttctgctatggagactgatcacaggggccctactttaacttcccttccactattctacctctttacctgtcctggggccttgcccctgagattgttttcctccatcttacctacttttcaaaagggcacatagagctacagcagtgcttatctttccattgttagcttagcttggccttgaggcactgcaggattcatgccctagaaggcctcattgttcaatcctggggctccccacagccttatgggagaccacgtggaggtcagctatgatgctttcctgctgcttattgtgggtattgcctttcagaatgaactggacaatgtcagagcccagctttcccagaaaggtgagttagcaagagacgaggggtgctgggaagcccctgacttggatgctggaggaagggggccctaggaggaaggtttcaaaccgtttgggagagccagggcctttccctgctttgtatgtccaagagtcctgctagctgttgtggtgggcagaaaaagagagggaagggaggtgactgaagctgttcacctagaccaggtgagcctcttgtctctgagtgcagcttcttgcccaggaaccaagatgggagggggttacctgatgggactgaatatcttcgggagagggctcagctgctgagtttggctggaacctgcttgagtcctgggttgatgaactaactggacccatggcaggtagggaatgggcagtaaaatattttcctaagtagttcaagcagcagaaggtgggcttttccctgaatgaaggctctggctcagcttctctggtttggcacatcccagagaaagaagcgggccacccagctttcaggcctgagccttgtttctcacctgcctaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcatcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgaggctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttggatggtgaggcctgggtttgtgctctggacttcttcagccacctgcacaacatgtaccatgaggcccagaccactggaccttggcagcccacagtgggcctgtaaatgctggcagtgggctgtgtctactgtaagatacctttcaggaggaagcaggcagggaggtgaagaagcagctggcttagagccttttagaagaagaagcacaagcgagagtgggacccaggagctttacctcctggggtttgggagtacatggttatcagcattttcaaaacataagctgcagagagttctggagcagagttttcctagtgactttagcaatggctcctgagggcctccaagcatcaggtatgggtgtatttgctcttcagaagcagatgaagtacttagagcagcagcaggatgagaccaaacaagcacaagaggaggcccgccggctcaggagcaagatgaagaccatggagcagtgagtttggagctgggtcctgcactgtgcctttgcccccagggcctgcaagtggtacagttcttaggactgcagcagggagtgggattgggtcatgtccgaggctcaaatctccataggccatggagggctcaggtcagctgggtgtgggcacagatcttagcctctatgaactcttcccccattccaaggaatgggagcccttgccacattcctccctgtctctgctgcctgtggccagatgacctggtgggtctttccttccagaaacctctctccaggaaatccctgaccttgagaccctctttcagcacctcttctttctcagcagcatccttggagctatgctcatctctgccacagggcctttccttgggcacacccacctactaaagcatcctggcagcctagcctgttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccgtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagtgctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgctacctggtacttgttgggctcaggtgtcaaagtaggaatgagagtgagttgaggggttgggcagtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggatttgttttcctccagaagcaaggtaacttagcagtgaacagaggttgaaggagaagtggctctccttttgtcatgttcactctggtctcctgagcaaggccatgggacctgatggcacagctgactccctggggcagctggaggacttacagaaatttgttaccagtccttactgggcattggcctgaatatgtggcttgtccactaggggtggacagatcacagaggtatcccccaacatgtggacactgatgctcccctctgctcttcctggctcctgggtacctctcagctggctggagagcacaggcctcaaatgtgacagcgtcagaggcctatttttgtaccacatctggagtaggagggctcctggaacctgattcggtcagcacagctgcttttacttctggcatggtgcatccacaggctgcaggatgtaggaagcagcctttgcttctaggcagctccggatgtgcattgccagactgaggcctagcctcagagagctgggatctctgcccatatctctagtctcttctgggctaccttgatcactccctggggagcagcaggagggggcagggcacaaggctaccacttggcttgtctttcattccctacactttcttatagttgcagacagtctactctgaattggatcaggccaagttagaactgaagtcagcccagaaggacttacagagtgctgacaaggaaatcatggtgagggacatccctggcttgacaggaatgaggggtggtttgtgtgccctcccagagcagggctgggctatctctgcccaggacccttgcaccagtcagtggtggttctgggcccctgcatcctcctgggtcagggtgtgccccttggccctggtccggactggagcctgggcctcctcaacagagggcagacagaaccatgagtcttccctcatagtctgtcctgcacttacatccctgaggtcccttatcagaggaggggctctacctggggcttggcctcctgagcctaatgatgaggtatcaggccttgctctgttcccagtgggctggcctttcatgcatgctgctcatgtcctctgcattatctccggacttgatgcctcagcctttctctcacacacttttctttccctccccaagagcctgaaaaagaagctaacgatgctgcaggaaaccttgaacctgccaccagtggccagtgagactgtcgaccgcctggttttagagaggtttgttgagccttgggcggtacaggggtcacaaggtgggagagctttctggtaacagtctttactcctcctggctttggtggggtgggtgacctctgtggacctgatgtctgcagacagcctgccctgggagccagccaagatttagctggcaagcagccttgaagcaaattaggctctgacacggagaggccagagaaggccagaggacctagaagtggtctgagaatagggcagaagcactgactgtcttggggcatcctgtttatggagtagctccccacatttatctgtccaccccagattttgaaacaaatatgaaaccactgtaaaataattcccttagtgccaggagtgcgtgctttaaagctgccagcagagggagccacgaggcagaaggattggtgtccctgcaagcatgggcatccatttctgctcctgagagtttcacagaagcagactagctgagagcatcctcaaggctacctcctgcctgccaaaagtccccagcaaggacccagacagaaagcacacaactcctgtcagtggccccagtcttttttttttttttcctttttctttttttaatggagtcttactctgttgccaggctggagtgcagtggcactatctcggctcactgcaatctctgcctcctggattcaaacaattctcctgcctcagcctcctgagtagctgggattacaggcgcgcaccaccacgcctggctaattttttgtattttagtagagacggggtttcaccatgttggccaggatggtctcgatctcctgacctcgtgagccacctgcctcggcctcccaatgtgctgggattacaggcgtgagccactgcgcccagcccagtctttaatcttttttttttttagatggagtctcactctgtttcccagactggagtacagtggtgcgatctcggctcactgcaacctccgcctcccaggttcaagcgattctcctgcctcaacctcctgagtagctgggattacaggcatgtgtcaccatgcccagctaatttttgtatgttttggcagagacgggtttcaccatgttggccaggctggtcttgaactcctgacctcaagcaatctgcccacttgggcctcccaaagtgctgggattacaggtgtgagccaccgtgcctggttgcttttgtttactttctttacctcttcagggtgctggaaggcctggactcctacagcaggtccttgatgagtgcccactgcatggcagaccttctctgttctcttggagcttatgttccagtgggatagatgagcttggagcttagatggctaagcccacagccaaccagctatatactacattatagaatctggtctgtagctcccagttggggacgggcccacctcattctgagtaagcttcatgccagggcctgcagcccatcttggtacagggaggacagcaatggtctcccttggctttcaggccagcaggacactaaacttgacaagccttcttctgtaagctgggctgggcttctcatcaagccacatgaggatgacttcattcatttttgtctccagtatttttctgggcataaatattgaagtggttggctgggtgcattgactcatacctgtaatctcagtgctttgggaggccaaggtgggaggattgcttgagtccaggagttcaagaccagcctgggcaacatagtgagaccctgtatcaaaaaacttaaaacttagccaagcatggtggcacacacttgtagtttctagttactcaggaggccaaggcaggaggatcacttgagcccaagagtcgagctatgattgtgccactgcactccagcctgggagacagagtaagaccccgtctctcttggaaaaaaaaaaaaagtccgggcgtggtggctcacacctgtagccccagcactttgggaggctgaggtgagtggatcacctgaggtcaggagttcgagaccagcctgaccaatatggtgaaaccccgtctctactaaaaatagaaaaattagctgggtgtggtggcaggcgcctgtaatcccagttacttgagaggttgaggcaggacaatcgcttgaccctgggaggtagaggttgcagtgagccgagatcgtgccactgcactccagcctgggtgacagagagactccgtctcaagcaaaaacaaaaaaaaattacggtggcaggtctgtttgtttttagcaaaagcccttcttttaactaggcattaggcagcaccagcacagtctattcttgtgtttgtttgttggtttgtttgttggtttgtttgttttgagatagggcctcattctgttgcccaggctggagtgcagtggtgtgatcacagctcactgcagcctcaacctcctgggctcaggtgatgtgatcctgcctcagcctcctgggtagctgggactaaagtgctgggattacgagcgtgagccaccatgcccagcctaggcacagcctcttctaaactcatagcctcaaactctcaaaaatagttgttgaatcctcagcaacggcattgccctgtcttctttgtgttctgatggcaagaccctcagaactacaagtgacctcaaagactctgcctctacctttctcctgtgactgctaatgtgttactacagaggtctggaagaagtcttaagttttcttgggccacctactcgggaggctgaggtgagaggatcacttgagcctgggaggtcaagactgcagtaagtgatgatcacgccactgcactctagtctgggcgacagagtgagacctgtctcaaaaaaaaaaaaaaaaaaaaaaagtcatgtcaaggaagatggaagagtagaaagctccaggaatccatctctccatggcaacagttgatctggttgaaaccatctgaagcaaccactttggaaatctggtctagtagaacatttccagtatccaggggagagggtgatgaagaagctggtaaacttcagtaaattttcactgttctcatagcagctccacctcctgggctcaagtggtcctcctgcctcaatctcctgagtggctgggattgactacaggcatgcaccaccacgcccaactaattttttgtagaggcagggtctcacttattgtccaggctggtcttgaactcctggcctcaagcgatcctcctgcctgggcttcccaaagtgctgggttacaggcgtgagccaccgctttgctttgctttgctttgctttgctttttctttttctttttccttttcttttcttttcttttttttgaaacagtgtacttgctctgttgcctaggctggagtacagtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggttcacgctattctcctgcctcagcctcccgagtagctgggactacaggtgcccgccaccacgcccggctaattttttgtatttttagtagagacagggtttcaccatgttagccaggatggtctccatctcctgaccttgtgatccacccacctcggcctcccaaagtgctgggattacaggtgtgcgccaccgtgcccggccaagaagtttcttaagttttttaagaagcttcttaatttttataactttttactgcagcagtattttttattgtagtaaaatataaacaaaactcaccattgtaaccatttttaagtacatttctgtggcatcaagtacatttaattgctgtgcaaccatcaccaccatcccactccagaatgttttcatcttcccaaagtgaaattctatacccattaaacaataactcccctttcccctttctcctcagctccttcacttaccattctttctgtctctatcaatttgactactttaggagcctcatataagtggactcatacaatatttgtccttttattactggcttatttcacttagcataatgtcttcaaggtttatccatgtagcatgtattagaattttcttcctttttagggctgaatcagtaatcatatttaatttttttttgagacagggtcttgctctgttgcccaggctggagtgcagtggcacgatctcggctcactgcaacctccaccccctgggttcaagggatcctcccacctcagccttccaagtagctgagattacaggcatgtgccacaatgcccagttaatttatttaattttattttttgtagagatagagtcttaatatgttgcccaggtcagtattgaactcctggcctcaagccatcctcccacctcagcctcccaaattgttggtattacaggcgtgagctactgtgcctggcagtattcatgttttaaatttgcaagcattctttcttgctctttgagtatgtctgttttgcaaagcatcatgttcttgttttatggtctcatatttctgtttgtctcagagtcagtatttgtgcaccatggactttttcctgggctcccctcccatacctggtggtccttggctactttggaggccaacctatgtgggtagggtttgggggggatgtgcagactgctggcatcatgttgagtcttacctgaacccaggatgcagaaggctttactgttgggtccaataatattggctgccctaggtcattgtacatagtttgtttagtgtctttgagaaaagctcttctatttattggcccagggcagcagcctaactgcctagtgttctaccaatgcagattaggatggggtggagccaagctcacaatttcatcagtgttccagttttcaggcctgtttaatgcttttgcaaggccctccctttccttcatggaccccctccttgtgggttctggctgctgtgtcagtctcttgtcccctggccatgctttgtctcccagaattttttggaaatctctgggggctgatggtggttgccccttctacttgttgcagtaggattacccttcatacctgtcattttagggaggcatcagcatgtagccaccacccccaactacagagtcaatgttaggaagatctctctcatggaccccaagggcccctgaactccaggctagagacagccagggagacctttccttagggtagggtaaggccgccaggagccatgagttcatggaggagatgttgactaatcccatgccacgcaggcaatgggctgctcaaggccttagctctgttctggaaaggggagctttgagtgtcttgcctggctccctgaggcctctggcatgaagccctgtaacttgaccatgggtgggtgtcccaagggtgatagtgtcactcaggagggcctcaagccagcctcaaccagtgagggaaggactactaagccctaggttctttctccttgtaggacaaacagaaagtgggaaggaaagaaagtggacccctggcagaaagggaaataggcttcaagctcatgaaggaagaagaatatagaaacagtctaagacaaggccgggcgcggtggctcatgcctgtaataccagcactttgggaggccgaggtgggcagatcacgaggtcaggagagcgagaccatcctggctaacacggtgtaaccccatctctactaaaaatacaaaaaattagctgggcgtggtggcgggcgcctgtagccccagctactcaggaggctgaggcaggagaatggcttgaacccggaaggcggagcttgcagtgagccgagatcgcaccactgcactccagcctgggtgacagagcaagattccgtctcaaaaaaaaaaaaaagaaacagtctaagagaggaagaaatgtgtccatatgatccagatgtggatatggggagtgagggaggcaccgtgagaacctcctgagtcttgagtttagtgttgtggatgaccaggaggtgcaagtgaataagcctggcttgccttgagcttgggcaccactaggcaacgccttaggggatggctgggagtagaaagtcctgccttgagccacctggagggtaaaatttacaggacccagcgagatcctgccttcctcttgagtttacctttcctaacctgagcctcaacttgctggggttggtaaatggtggcagaatatggatactgcaaaaaagttggcatgagtggtcctggctgctgtggttcccagaggaggaagcaaagcagccagcctagagttggtttgaggtgggtttgtgcagtcttcattttaacttgcaggcggggacagaggtagagcttctagggtcctggacagggaaaggaagaaatagtccaggctgcctggattgcttagccacccaaatcaatgcaggtaggcttcctccctctgatgtgtacaccccagtggaagtgggattgtggtgcagctctgaaaagttcctgaggaaggaaagagagaaggcatctttggagctacccttgccattccccagggttctccttgtatgacaggaggtggggagccctgccaggtctgggtgggctggaagaatcctgtcggctgtagttttaatagannnnnnnnnnnnnnnnnnnnnnnnnnnnnnnnnnnnnnccccccccccggtgttataaaagtaaaaacacactcattgagaatttggaaaatagggagttatcatagaggtacttatggttgacatgtggaatatttccttctcctttttctgcatgtgggagtggtgggggggtgccaaatcatgtaattgcactatacatggagttttgtgtgctttttaaattaaattaaatttaaacttttttttttttttttttctgagacggagtcttgctctgtcgcccaggctggagtgcagtggcgcgatctcggctcaccgcaagctctgcctcccgagttcaagcaattctcctgcctcagcctcccgagtagctgggactacagacacaagccaccacacccagctaatttttgtatttttagtaggatggggtttcaccatgttagcccgggtggtcttgatctcttgaccgcttgatccacccgccttggcctcccaaagtgctgggattacaggcgtgagccactgtgcctggccgagagtagggctttcttgaggggtggccttgagtcaggagtgggctccaggtccctggagctgagttatctctgatgcttcaggagctgttgtcctgggttaccactgtggccccaagtaaccaggtcatctctgccttcagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacagtgagtgatagtcgctggcactgtccatgggctggtagggggatagctaagacagctctgcaggccctgtgctgttagctctgagtggctgatggggcagtgagggttgcctaggcttggccatggctttggttccagctacctcttgttccctcacctgagcactcaatctgtgcaaaccccttctcttgtctcattattcctcaccatcacctttcaaggcaaacgtattggaatgcaagttagagagaatgcagtgatgccagaaggggtgggtctgggctggagagggtgctcccaataccttgaaggcctgcccaccagagtcctgagcgagggactctgaacttcctcttctatgtttgcctctgaggctcatgcctgagggaggatcatctcaaaccacagagcccaaggccttaccacccaagggggtgacccacaggggcaagcatgagaagctgtctggaattccagtggggcaggtggaacctgctctggggtacagtgggaccagaaaaagggaggctgtctccttggccaggtttgccaagtgtaattcactgtggagacaaggactatactcattcatacaggtactgttcaggtgaggctggtcaagggctgggcaggtttcctctttttcaaagactttgtacagagagaaagaagagaaagagaaagaaactgagatgctagacagtggaggtggaagggagcaagagggcaagccagctgggctgtcctacctcccaaacctcagggggcatgggcacccctgttgtagagggcgaggcctggtagcaatgagaaacaaacctaggacccgtgggctgtagtcctcagggatcctgtcagtgtctgctgtgtactctggcttcctcccattgcccttcttccgctgtaaaggttgaaggtggacacctggggtcttcaggctgccaggcctttcagagacatttccaccaccttcatggcctgtggaggtagtgaaggaggtagtgaagttctgagtccctaactcagctcgtccttcctggagccttggttgtcatgtagccttaccacaggccgttagggcaggagcagaggagtcagtcatcaggccctgatcccactcttgtccttatggcttgagaagccacagggccagccttagatcaccatcttctcacccaccagggaaaatgccaggagagggtatccagctgctgggttccccaggaattggatggaaatacagtttctggctctggggctgggattgggagaccagggcctggggccatgcgctattctgccccaggcccttcttagacacactctctagggagatggcttggccctgtgttctgagaggattttgtgggctactttactgaaaggctaacttactgaggctctcgtggaggtagtgtcccctctctgggaagacaggactaggcctgagctcattaaatttcttttgctcgtatcagggcatgactggctttcctcccgtgggtggtgagttgattgggctcttcagccccatatagagcctgggacatggtgaggtgcccgaggacttgaggagcgttggaatttggccttgagtggaagccacaggattgggacatggtccagtcatccccagtcatccctgtctctgccaccctactggctgtggctgtccagctgttaacagacctgcacttggggtgggatcactgaggtgccttgcccagaatgcaggcatggcagcagcagtgccacatggtaactccccaaggggcgtgtgctgagcctggttcacctgcccccatgtcttgcttacctaccccttgccttctctctcattcttgtagctccccaattcaggatgtccccaagaagatatgcaaaggccccaggaaggtaagagctttctagaagaagcacagtctaacctttggcaggactggacttttgggagggcacggtcttgccagagccttgtcactcctggtccaggactgaggtacttcggagccacccttgggattctactcattatccctcctgcctcctagtgaggcatcagagatcctgatcttgttccaccaccactaccctccctcctttgctgacatccagctcatcaagtctggccctggggtcttccctgcaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtgagtgtggcttcccacagtggcaggagccagccctcttgggtagaaatgggtggccagccccccagcccattagcctggcccactcatctcttcccttccaccctaggtaaggacaggcttcgatgggctcggtggccggacaaaattcatccagcctgtatccttttcctgtgatgttgagctgagctgaactgtggagcccatactatgcctcacctatacccccagcctgccagtgccaacagcctcaggtgtgcagtgctgggcctcattctgtgtatcagcgccgcccacccccggctctgagcctttcttgccctgcattgcagtcctttctcgccctgcattgcagtcctttctccatgcctcttccttgacagctcctccagactgacacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaaaaacaatctcttcttcctggttctgagagtgtaaatttgcaccaacactttagaaaactgtttggcatgactttctaaagcaggaacatcgccaagcctcagatccagcagttccttccctaggcatatgccttgctgcatggggcacaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17477 - DNA, 27589 bp, Human
atactaccacataccacttactatccaaagcattctggtttagatgacacattgtacagccattctgtttataaggtgctttaagatctgggagaaatccaagtgtgactgcagtgactgctcttctttttctggatctaccctaaagccatttcacagcacaggttggcatgtcctcacagggaaatctatcaacagtcccatgactccagagaggacaaacccagaccaaagaaggaaatgtaggagtttgcccttttgtaaaatcctgggcaaaactccgaggctcatctctccaagatactgagaattgaaaggagagggggaaatcccatgggatcgccatctttgggcggaagcccttggtctctgacactgatggtggttctgcagtttaatggacctgtttaactattgcttagtcagtgcagccgtgaccagaaattcttctggtttctcctccttcatcttggttgggtcagatgaagatggcccaatctgcaagaaacactggttgtgtgcttctagacattttaatcttggagggccttgtttataggatggacctggccaaaggaaagatgttacttatggtagaaagcaagaaaaacctagataaacacttttttttttgagaaacactcttgctctgtcgcccaggctggagtgcagtggtgcaatcttggctcactgcaacctctgcctcctgagttcaagtgatccttccacctcagcctctcgagtagcttggattacaggcacacaccaccacgcctggctaatttttttaatttttttgtagaaacagggtttcaccaggtctcgaactcctgggtttaagcaatctgcctgcctcggcctcccaaagtgttgggattacaggcgtgagccacagtgcctggccaaatacttcattttctagatcataagatgcttaactttattcctggcaaaaagttgattcagcaaaccagggctttaagtgaagccggttggggcctgaacccttgacacctgcccagggtggaagacatagcagctgcatctatgggccacctggggtgtagggtgaccagctggaggctgtgagcttctctgctccctgaaatgcctgcacggggcactcaggaagggctggggactgggtgaggaggtgtggacagaatgtcccctggaaactgccccaggggcagcttgagtggcctgagcctgtgtctgtcctactgaaggttggagccccagagaaaagcctctatggaggcacccacttttcagaactgctgcttttgcgggagaacacctttttccaggtgttgtccttagggtagcagggaagactgggaaaaactgaggggcaagagctgttggaggggggagttacatttattgagtgtctattacatgccgggtgctgctgaaggtctgcgggtcctaccggatctccttttagcccctcacatccctgtagattacacgccgttcacagatgaccctgaacccagaagggctgtctaggcccagggcccagctagtgagtggatgggcagaatcagacctgccctggaagggtctgtcttaccctggcgcccaaaatgtgtccctcaccctctgccaccaggacaagtaaattcgagacaccctttcgttaggggctcaagtttatcatgggtctgacctctaaggtcatatctccgccttctcacctgacagacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccaggtgagtgcgccctgagtcgcgcggctctgcccgccgcggaggggcgcctgggcacgcactcagcgcctcccggtcttgccagccccgccgcagccccggggctgtcgcaggcggggaactgtgagaagtgaccgcagttagcccgggcagtgctgctcttttctggaggcactaggtccgtccccatcccgggccttcctgggcttcctggacacagttgacttccgcgtgtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcaggtgtgagttttccctcttgtgaaataactgcatggaaacctctccactccaaatcttggtgctaggtggtgatggttactgaaacctgaaagagcctgcagtcagtgttttgtggcctcagtccttgaaagctgggaagtgataaaggggctggtattgagcacatttaaagcaaatcacaatgtgttagctaacaatcagccctctgaggcaggtattgtatctactggtacagactagagaatattttgcatgcttctggttctggtgctgttgtgaactaaccaggacccaggaatcggctggagcaatagtgggctcaggctctgcctagagccctgggctccagccacccaccagctgctccctgagagtgaatgaatgggcaggctctccccacgctgggatactatcacagtggcaccgaggaaatccactgggccctggtagaaagtatatcagtatatcatgaagaggtggcttggagtcttggtgggattgtttggaaggcagagttttgactcttggatttgccacttaacgcgcaggtttccttggacaaactatttaacttctcaatgtctcagtttctttcagggatgctacttggggagcatattacacagaacctccaacacaggagtgatctctcagttactgtctttcttgtcctcccctcatcccttgccttcctcccagaagctaaggaggctggaggtgctggttgtctccctctgtcctctcagactgcatgttggggattttccccaggtgggatttggggatgggtactgagcctcccctcaactgctctcactcaactgctgcctcctgactctccagctggtttctggctacctcttttgagagagactgtcctcagccctcagctgctggagggcagcttttacccattgtttcctaaatccagcctcctcctgctcacggtcttccagtgaatgactctttgccttggagaggatatccggggcggaggcagtcagacgaggaaggaagtttatcctgcagagggtgtagtgtgggttagaggagagggaggagagaactgtctgcaaggcctgagatgcccaggatggagggtatggggaagagaagcaggagagaaactaaagagaaggcccatcaactctgcaattggcctgctaataaaatgggaaaaacaggggtgctgtggcctatttgcctgtggtctgtcttagcacctgccttcctggcccaggtgtttgctcttttaattgcacacatgtgcatctgcctctggagctagtgagtcctgactgggccagagttgcagcctgggagtgtagtgacacttgactgagtgatcagcaaacatttgatgaatgagtggggtagcaatggtctttcagctgagttggcctacgggatactcataaaccttgcaaatagttactagccagtttttccacttgggtagattgacaagcaggtgagagaaaaaaggcgtaggttttttttgggcttttttgtgtgtttttgttttgaggcagtcttgctctgtcacccaggctggagtgcaatggcgtgacattggctcactgcaacctctgcctcctgggttcaagcgattctcctgcctcagccttccaagtagctgggattacaggtgtctgccaatatgcccagctaattgtttgtatttttagtagagacggcatttcgccatgttggccaggctgtttttgaactcctgacctcaggtgatccacctgcctcggcctcccaaagtgttgggattacaggcatgagccactgcgcccggcctggtgttttttttttttttggagacagcgtctcactatattggccagtctggtctcgaactcctggcctcaagtgatcccctccctgtccccaccaccatctcagcctcccaaagtgctgggattacaggcatgacccactgcgcctagcaacatagtttttaattcactgtccatccctggtgtgggaagcaaattgggaaggcttttctggcaggttgttaaagttttaaatatgtatgtaagcctagcttattgtgaaacgttggcttgctagatgaagacacatgcgttaaatattttgggatccaaagaggtgctagtgagaataagactttttcctccaagtcagccatttggcattactcagggcatattgtcaaatatcaaaagagatacaaacctgaacgataagtgttagagttggcctctccttaagataaggataaccagatatctgcacttgcagtgtaccagacagtgtgagaaatacttcacatgtgttatcttggacaatttatgaggtagctactgatgctctccattttacaaatggagaaactgaggctcagaggtagtaagaaacttgctcaggatcacagctgatcagttgtggagctgccattcaaacataagctgactgtttccaaaacgtatgctcagtcactaccttattatttttctttgctcctctacatttcctttttccagatcaactcactaaggaaatatctgccatttgtgaaacacatcagctttacaaggtgctttacagtggcttataaactatttaaggaagatatctttcacttggatggatcagggttagaactcctgacctccgggttttcagtctgttgcatggccaggtaggagcagaggggacccctgagagttagttcccagccactaatggatatgctttcaccagctctgcatgtttgagtttcagagccaggtttgcagaaagaaaagaagcctggaaaagagcgtgcttgagaaagagagagctagcaaaacttgaggggagggcagagaaggtgaggtggaggggtcctgggttccgactgctgtttctagttgtcaagaatttatatggtaatgacgtgcctgtactacgcagctacccaggaatgtgtctgacgccagcactgagtaattcccatgtatggtaaagtgtgtaaatacgggggcagctagcatttccagactctggtatttccagtgcttccccagggccagaaggcagcgtctgagtcttcagcggtgacaacaggggaagaaatggaaggttagcagctggagctcagccccagctaggcagccagcaccccctacccccgactgtgtgcctggctttctttatgcaggggtggcgtgtgttggtgcttcctgggatgtcagctgcaaacgacctgtgtttttaaggcctaagtgctaatgtgttttaacttttaaaaaattaatcaaagaaaaatcattcagaccattttgttcagcatggaataaccaacatcattacagatctggataaaagcaaggaaaccccatctgttaatttgtctatgaggctttattataatacaggatttcctgtagaagttttgaaatactacaaagaagtcatcgacctccatttctacctgtgttgaccttcagacttcttttttttgagacagagtttcgcttttgtcccccaggctggagtgcagtggcacgatcttggctcactgcaacctctgcctccgggttcaagcaattctcctgcctcagcctcccaagtagctgggattacaggtgtgcaccatcacactcagctaattttttttttttttttgtatatttagtagagatggggtttcacgctgttggccaggctggtctcaaactcctgaccttaaatgatccacccacctcagcctccccaagtgctaggattataggaatgagccactgcgccctgcaaacttctgaactccaagagtagggagctctgctctagaaggcactgggggcaagtggggaaagggagagacatataccgcccttgtcagctcacagtctcacaagggccactggacatggatttgaaaagagaaagctcattcaatagagagaaggattcctgacctagaatgacagtcaagttctggaggcccatggggcctggattgatggtagctcagtgatgctggttaccttttcagagaggcgggtcatgtgcacggttctgaaggaaacatgaggtgggacatggaaagctgaggccaagcctgccccatctccatggcagccattctccccctacccgtgaccctgagcttcaggagaggctgatttcctgagctctcaggtgtcacttctaagacttggctctgagccctgaccagcccagccccctcctctctctgccctcagctgctctctggacactggggcgtggaggcaaaagccgagctgcagattggaagggatgccagccctcctgtccacctggcagataccaagcagctcagctaatgcgagggagctagataaacatctgacaggtttctactggagcaagtggatggggactttaaccctgtgccgtcagtcactctttggccctagggaataaatgattttggaatgggagagatgggatttttccactgtagaaataaagatatgggatggttttgaagggtttgataagaaggggcttgccttcagacactggtggctggcagttagggattttacatctctgcgatggttccttcaacctgtcacctgagccagactttatttatttatttatttatttatttatttatttattttgagactgagtattgctttattgcccaggctggagtgcagtggcaagatcgctgctcactgcaacctccatctcctgtttcaagcaattctcatgcctcagcctccggagtagctgggattacaggtgcccgccaccatacccggctaatttttgtatttttattaaagatggggtttcactacattggccaggccggtctcgaactcctgacctcaagtgatccgcctgcctcagcctcccaaagtgcaaggattacaggcgtgagccaccacacccagccgagcctgactttcatgagatttggggtgactgagagtctgtgacctttttcttctccttttgctgctgctgtaagagctgccaccttggctttcttgtctcaaggctgaggatctgggtacagtcctaactggggatctgggtacagtcctaatgggacagccaggctaggaagatgcagcagcagacacagcaggcttctagccgccagccgtttcaggaaaacagctgaccaggtgtttccagccattcagtagaaaattcaagctctgttctctgttgagatggtcaacagagtgaaatgggacatcacagacagctggggggagctaaaccccaaagaagggcaagtaacttgtcccagactcattcgctgggctagcagatgaatcaggagttcctggccctatttggcatggtacttcttaagcctcgctccttccatatgtggactagctacatgtggatggctggcccacatctagcagtgtggagtcgacgtatgactggtccagtcgtgtgagtggtagtcagaggggcgggcacttacagtgtgctggccatcacttccatacctcctcatttaatccttacagctgaattttagggagtccatatacggtccattttagagacaagcaaattgacactcagaaaggaaagtaacttgcccaagatcattcagctaggaaggggtaaatccatattgatcgaatcccagctcttgttttcctaaccattgacctgtacagcctgaactctgaccttgggaacttctcttgtcccagccttctgcagggcctctgtgccggagagctgggaaggcaattaagaaggagccaagtgtccctctaaggcactccatgaactctgagaaacaggtttccttttaaggcaattcggcctccctacaggcagaatttggctgttggagagaagggcagaaagggaggaggtggagtgaagactgagccctgcctgttgccagggttccctccagctgagcctcttccccacaggcagggtcacctggaggggtcctcttgtgggcagagggggacaggacctcatccacaggcactgcctgaaacccttcctggctagggatagagtcatcacttttcatctcaaggcaatagagccctgtcctttcactgggctcttgaggggagaccccccaccctcgccctaactaaatgaccaggctcaaaagagcagcctggctaagagacgtcctgagcagattttccttactggcaggtccttgggtttcacccatttctccgcccatgttcttgattccctggggccctgctggatgtgggcccctgacacggagccagggaaaacaaggggaggcctgtatggagctgtgggtctcccccagagggagaagggcttttgtgtctgtaacaaaacagtgcttggaactggctcccaaccatgtggctaggggaattttcctcccttaggggtgttcctaggggcctgagtatgtcccctgctggttcagggggttggaaaaggagaaggccgaggaagagggccagcactgatgtattgtatgcctatcatgagcagcccctcttaaatatgcaagggccacagcatggtgactgggacccagaggattcagaaatagatgagcttgcattagaatcccaggtctatctcttccagctgtgtgactataagcaacttgcctaaccgctctgagccttgcttgtcttgtctgtaaggtgggcatacattctttatcttcggatgatgaggatgaaatgagatgatgtggctgggagcagtgactcatgcctataatcccagcacattaggagaccgaggcaggcagatcacttgaggtcaggagttcaagaccagcctggccaacatggtgaaaccctgtctctaataaaaatacaaaaattagccgggtatggtggtggtggcgggcgcctataatcccagctactcaggaggctgaggcatgagaattgcttgaactcaggagatggaggttgcagtgagcagagattgtgccactgcagtccagtctaggtgacagagtgagactccatcttgaaaaaataaagaaatgggatgatgcagatgagccatctgatgcatagtaggcattcagtccatggcagtgtgggtgccatggctgagttccaagggtcacattgagtcaccttatcagagggagaagagagcttgtgtgggtctgtacaactggatacattattcacaagagcttcccaagcagacctcccctcacatctcactggccagaaatggtctcagcctgttcctgatccagccactggcaagggaatggaatctccatggttggcttaggggacagaggctctgttcctccatctggggaaggggcatctccccagtcattcaatggcctgaataaaatcggggttttgtagcaaggaagaagggggaaatggccgatgatcaggccgaccataacacacattgctgattgctgttcctgtctaactgtccttcacatcgtacggttttcagctccaaacctttgcttgacaagggcagctagcagtcctcagtacagaaagaggctgaaggaacagtgcaacatcagaggctgggaatggggactgtccctggatctgggggctcaggccgcatgggttatctgaggaagacagagatggggatgtgagcagttacagaaattcctgcggggcatgtcagcgatgtgtgggagcctgaggaagtgcggctgctccagaacctgggaaagggagaactgggcttatgcagcaggcatggtctacctagatcccccagcatcactaacaccacttccccacagtaagctctgcctctcagcctgcacacgcttaccaagcacctccactaggagccaggctctgcagagattcaccatgcagagaaaatggccccagaagctgtggctttcgatattagtgcatccttcattcattcctcagctatttcctggccacctatatgaacagccacgtgccaagtgctatgcagagcatggggacagagtggtgaacgtgacctggatcccttcttgagctgaggcccgtgtcaccctcaaatgggagctctccagtaatggagactgtatctccctctgcccttgacattgactctccagctgctggtgcaagccctgttaccaggagggtgggctctcgttgccacatcccggttttcaacatttccatgtgacaggttccgtgagctctctccttaggctcctttgcctcctgaggcaacagatccctctgactcccagcccctttatttcccggcacctccctgtgtcctttactcaccaagtcctgggcaacccccggcaccaagcctgtacccactgtaggtggtgctttgtatagcccttccctcatgaacttctgttgaaagagctggaagggtggtcttcctccttcagccacgtctgttgagtgagcgagtgaaatggaaggagagaagcaggccccatctgttctccacactcactagtgttaccttccgtgctgctctgtggccacgtgggcactgacctgaggcatcacttggacttctgtgtgctgtatatgtgccaagtactgtgccttgcctttgacatatcatatctcatttaatcaccagacatactcggtgaagtcgctatttttatccttttttttttttgagacggagtcttgctctgtcgtccgggctggaatgcaatggcgcgatctcgactcactgcaacctctgcctcccaggttcaagcgattctcctgcctcagcctcctgagtggctgggattacaggcaggtgccaccacgccccactaatttttctatttttagtagagacaggttttcaccatgttggtcaggctggtctcaaactcccgacctcgtgatctgcccacctcagcctcccaaagtgctgggattacaggcatgacccactgcacccagcttttatccttatttaacagatacagaaatcaaggtttggaaagactgactatcttgcccaaggtcacacagctaatgagtggcaggatcaagattgagccaaacctgcatggcatcaggacgccagctctgaaccaacacctagagcatctcaaagttggtctgggccacctgctttgtttgcctggggtgcttgttaaaaattcagattcaagtacctcattctctcaagtatctcattctcagaggttataattcattagatgtggggtggtgttactaaatctgattttgcaaaagcccctcactctgaagtttgataactgccctgtgtgcctacctcctgcctttttttttttttttttttttttttgagacagagtcttgttctgttgcccagactggagtgcagtggtgctatcttggctcactgctacctccgcctcccaagttcaagtgattctcctgcctcagcctccagagtagctaggattacaggggcgcaccaccacacctggctaatttttgtatttttagtagagatggtgtttcgccacattggccagtctgatctggaactccggaactcctgacctcaggtggcctgcccgcctcagcctcccaaagtgctgggattacaggcgtgagccaccatgcccagccctgcatttaaaaaacaaaacaaaacaaaaaaaacttttttcttgtggtgagctatagcttatatacaaaagtgtgcacaaaacctacatgtacagttcaaagaataattataaagtgagcccccatatgacaaccaccctgagttaagaaggagagcattgccaggcagtgccttaccagcctccctggtctcccaacccagtcatggtcccttccctctcttagaggtaactcttctaaggtaaaagcttgcgatcatcattcccttgcttttctgtagtaacttttccacctatatgtccatcccttggcaatatgagtttagcccatttgtgaatttcctacaaatggacttgcgttttcccagctctggtctgtctgcttcttccacattctctttgagatccgtccatgttgacgtgtgtaggggtaggcagtccatttttattgcagctggagccttctttataaagcctgcttcttctgctgatccacatcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccaggcattctacttttgtctttctctcctctggatctggctgttgcatttctgtcgtggacaatctgagatgtttccatctccctgtaaaattaattcccatttctgtgtcccttttcagaatgccgaactggggaggaggcaagaaatgtggggtgtgtcagaagacggtttactttgccgaagaggttcagtgcgaaggcaacagcttccataaatcctgcttcctgtgcagtgagtacgccccaggccctattgctgttgccttggacaccctggacgggcctgcccccacaggctgggcctgtcaacaccccagggaactgatcccatgggatgtaaacagcttgacatttggctgaagcgcagctgggcagggaaacacttcagggcctctttgttccgttcagaagcttctttctaagggatgaactggccagagcgggtcggggtggcaggcgttcaggggctgaaagccaagctgtaaagacttggttaagaaaactttccactcagctctctcttctctctctccctgtcatgatttcaccatttcagaggaaaacactttcagccctttgcaccctaattatctcttgttcaaaggcaacagaggccacaacctcatggtgaagctgaatctggaggaagagtggggctcctccttcctcagccccttgcaggctggcctgttcagttcttcacttcccattcccactcagcctgggatgagaggaagagggagtacaaagttccctgatatctactcctaagaagccagagcaaggtttgctccagtcataagcctagatgagtaagaaatcagacaaaagaataccaagcaactgacagaggtcaggtcgacccagggatcctgacaccgtgatgctgcacccactggtacctgggccaggtgatgtttccaggatgtggcaacttggtgaagcctctcctcaggttcctaaatgagttggttcattgtgatcagagcagaaggtctgggttagaagaagaggcaacttcagcaaggtgcattttctttcttaagacagagtctcactctgtcacccaggctggagtgcagtgtctcactgcagcctccacctcaaatgatcctctcacctcagcctcctgagtagctaggactacacatgcatgccaccatgctctgccaatttttaaaaaaaatttttagagagacagggtctccctatattacccagggtggcgttgagctcctgggtttaagcagtctgcccacctcagcctcccaaagtgttgggattacaggtgtgagccactgtgcccgccaaggtacattccccatgatggtaggcagaatggatggtagaagaatgtcttagttaaaaaaaattcggtgtttattatctgtgtgatgatggacaagttactcagtttctctctggttgagttttctcattattacagaggaggtaataatagttacctcatgggattgttgtgagaattaaaatgaaagaagcttgtaagacaaagcacttaaaataattatgagtgttgaagaaatgatatgcacacacacatgcgcacacacgtgcacacgcacacacacacacgcacactgctgagggatctgtagcaagatggtgtgatacaaagaagccctcaccagggtctgaggcccctgaagatggggagatccaagaatggggtcctgtctgttctgcattacacgaagcaaagtttcatgatttgtgctccagagtaggatacagatgggccaagagccacctgttcaatggacgtttgcatctctgcctgtcgctaggtagacccacctgaggccaccccgcacagggcagcaggggccccacatcctgctcagccgggcctggagtgacagctccagggctgcgtctgatgaatggggagtaaacaaggtttagtggagctttgttggcttccagcctgcaaaggaggccagaaacagcagcgtcttgttatcagcagttcactactcttaggaatttccaagccgtttatctttccagagggaataagagagagcttggtgctggctgggaagggggtctaggctgctggggtcctaagggcccctctctttgctctcggatgttgcttaatcactgaccataaggggtcagctgtgggcgggggtgcctgcctgcagacctgtttacggaggagtagtcggtcagagggttgagggaagtcaggaattcagggggtggcataggaaggaaggaacagggcctggggcagggtgtgaggggcgctgcggatgagaaacagttgtagaaagtcaggctggggagcagggctcttggcggggtgcgggggtgttatgcaatgagcagccgcaggaagcagtctcaggtcacgctagggtctcagggccagtgcagctattggatatcagagcaccaagtggaccccctagcactgcacatgtcccagcaggctgagccatctccacaacttgctcattcatcatgcctaacacagcacctggcacaaagtgggttcctgacaaagatttgtttatgaatggaaggcacatcatttctcttttccagtgaagtgggtgataagtgttcaccccattcagggtgcccactgaatcaaaggactttccctcccgaggaagggagaggctagccaggtctgggccaagggcagtaagggccatctccctcattggccaggcctggttgggtccccaaaagcagttgtgaccatgtgggttcttggctccagattctactcagcttgcccacctacatgcctgtattagtctactctcatgctgctaataaagacatacctgagactgggtaatttataaaggaaagaggtttaatggactcacagttccacatggctggggaggcctcacaatcatggcagaaggcaaaggagaagcaaaggcatgtcttacatggcagcaggcaagagagcttgtatgggggaactcccatttatataaccatcagatcttgtaagactttttcactatcacaagaacagtatggcggaagctgcccccatgattcaattatctccatttggcccaaggagagatttgggtgggaacacagccaaaccatatcagtgccctttcctgagtgtctgaatgggcgggaggaagacatgatgatgtcataggcaaaggtggggagaatgacctccaccctgggcttggcctgggaccagggactgagagggcctacagtatactcccatggtcttgaaaggggctgccagatcctatgagcaggtggtggttcagaggctggtgggaaagctcagctccgtggctgggaacctgccctgaggttatgtgcccatctctgagctgtacccagctccctgctggggaaggtgggttaagcagccagccctgaggaaagaagaactctgtgatggtggccgatggaacagggccccacaggttggccctgggctgttccctagaatccaagagcacaggggaagctcacggaagccttgcacacgttctgacaccagcgtctcctcacccgcaggctgagacttactgacacttttcaccctcttggccccacatgtgtggcccactggaggggagcaatggctggcagaaaaccaccaggtctggaggtcaggggctgggttctggcctggccctgcgtctggccaacacgtgatctggaactgttttgtgggcctcggttttccttccagaagcagagaatcattctccatttctgagtggggcaagggggctctgacctctcccctggggctgccttttccctttatttccaagcagtatcacaagggcccaccaaagtggcatctggaagtatgtgtttccaacaaatccagtcttttttttttcttttccccttattggcttaccatgatatggtagaaatttattcaggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttgggagctggtcccggggggaaatggtgggaagttccatatttggatggcccagagtgctggaatgagatggagatctccagagcaggacaagagggtccttatttagtctgaagtctccaacctggggcttagggtgagagaggagctggcagagggatggaccctttaaaggcaagaggatggcagttgcaaggaaaggagctgagagcttctccgagggtggtaaaaggcgtggcttctccagtggtatccctcggtttctatgttcaggacatgtttgaggatgcgtccaactgagatgctgaactccaatatttaaggaatatgatcaaaccgaattaggattacaggacaagtaaagaaaaagaatgcagttgaatctcttgagaggagtatgtgaaagttagaagcaatgatctcttgaagctggggcctgtccctcccacttccttgtctcccgatggtactaactttatataatactaataagagtagccaacatttattatgcatttgttgtatgcagggtattatgccaagtacttcacatgtcagatctcatttgattctcaccaccagcttttggggcagacattattatgttcatttacaaatgaggacacagaggctggaaaggcaaaaaaaacttgcaaatggctggaaagggagagagctgggatttgattctgggcagtctgactcttcatgaccccaggctctgaactgctttaactttatttttatttttaaaagttttatttatttatttatttttaaataaatagagacagggttatgccatcttccccaggctgatctcaaactcctgggctcaagtaatcctccagccttggcttcccactgctggaactacaggcatgagccactgcacccagcccaaactgttttattctggatagctgggcatagctcccctctgagattaacaggacgaaatatgaggcccacagcctttccagctcagaccattgcaatccctagttccttccgttccactctctcttaccccaggagtcaggaagttcttctgtgtctgaccctcacttcttcctgtggtaaagtgatttctgagattagaatcttcaaatcctcttgtgattagcatgagctgcatcccatttcaaagcccaccatgttgggcacttaataaatgttaaacatttcttatggggtatcacatcacctgcatctccccccattggctccctgccaacatgcacagatagtctcttctggattccactgttgaaggcaggaaaactgcccttcttttctttttcctcctcccccattgggacatatggtctctgttgagggcagagtgaggaacctcaacaggcgtcctgtggcttggggtcagcctaggctgttgcctctgaaccctgtgttgcactgcagcctgaggaagtttaggggtgcagaggaccaaaggagacacatatggattcctggaagaggaattggtgttggccagcatttctagagtcggatatgcagatcccatccctctgtcctcccacccattggccatcccacctgcctccatttgtagacagttcctgaaagatcaggatattatgtatgcaaagaggccagagagcttcagctgtaagaagcttgcaatgagcaagaaggtcaccccagcttcaactcaatgcgtccgcttccccttcccctccacagtggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggagtgagtaaaagatcccctcccaacctttttcttgagctctctcccccaccctgtattaggcctcatgtgtatttacaaccatttttgggtaagcaatggaaggctcagaaaaccagttatttaaaaggcagtcacagagcagtgtctatgtgtcaggctgctgcaggagctggggatgcagcagggactaaaacaggctgggctcctccctgcaaggagcgtgcattctatatttgtatgagagtcagagctgggaggggccccaagaatcacttagtccaatttcctctttttttgtttttttttgaaagggagtcttgctctgtcacccaggctggagtgcagtggtacaatcttggctcactgcagcctctgcttcttgggctcaagtgatcctcttgcctcaggctcccgagtagctgggagtacaggcatgtgccaccacacccagctaattctgtattttgtagagacagggtttcaccatgttgcctcctctttttatagatgagaaaatccagcccaggctcagtgacttgcctggggtcccacggctagtgagtgtcggagccagatcaggggctcagggcagcaccgttgccacaccagactcactgtctcagccctgctatctctcactactgagaagaagtcatttccctttcttcgaaatgccatagggtgtcatcagccccaccacacccccctcaccccacggcactccctggcctctgggtaaatggtggctgttggcagtcagcctggcttgctcctcggcctgcggggtggacggaaatgatggatgaattaccaagtttcagccaaggtcattgccccagtgggaatgattcatcagcagatttctcctgtaaagaatctgataatagaccagctgcaggaatgaggggcagaggagggcaattcttagcaaatggggtgttaaatgattctggggttaactgggtgaccgagggaagtatgatgttacaatggaaataacattgtgctgaggcttggtttgtccatctgtaaaatgggagatgaccctagaggccctagcctttgtgactttggcagagagaattgcgcgctgctctggcatgagatgaaggtagggtcatgccctctcagtgccagccccacctgtacttacagtgtaagtcacctcaccccatgcccttctccatgcagagcccctggccacaggcccaccaccaaccccaatgcatccaaatttgcccagaagattggtggctccgagcgctgcccccgatgcagccaggcagtctatgctgcggagaaggtgattggtgctgggaaggtaaggtggctgctgggcatgagagggatggggggagatatcttcctgaaatgtggattccagaacttttaaattggtgacctagctctgctcagggcagcctgagcactggggtttaacctcttctctttgtccctgtgggttgcatgtacctgtgctttccagtctccaaggagctcatatcagccatgagcagtaacatccccagcattgatggacaatgggcaattcatagggagtggcaatgatcaatctgtatctctaatataggagaacagaaagtaagggtacgtggatgggctgcagagggtccacaaagccctgaagattatatacaaagtttcatgggaacctgtctgtttcttagaagaagatccatagcttttattaaattttcaaaggatttgtgatcccaaaaatatacattctgtttcatgggatgtggactcccaaaaacccatccaaatacccccagggcagagattttcaaggttcagacctaccagagcctcctaggaggcttttttcacactgtttagaattgccgcacatgcccttcccccatgatattctgacagtagcccccaatcaccaatgcacagtgagaatcactgtagcaaatcaacagttcccaattgagctgatcacttccttcagataggctgcagtagagaagaggcagaactcttgcccctggggtttgcagtgtcagattagcagtcagaaaatcacagaagagatgtctttcagctgtggggccagagaggaattctggagcatcacgtgaggcctgagatagaaaagtgacttggccaagatcacacaacaaggttatggaatgtctgggcctggagcccatcttcatctcttctggattcaggttttggctttcaaggctttttgaccttgaggaatgggataggggaatggatcaagaaatgttaaacaattaacacttaggccagtgttagaatctctactctcacagtcatggttggacagagatggggattagtatccctgttgtacagatgaagaaactgggagtcaggaggattacataatttgcccagatccgctagctaggaaggggctaagccagactcaagcccaggtttgtctgactccgaagcccttgctcttactgctgttactactgttaatgctactttgggccatttagcctcttcaaacccatttccaaggctgcaaaatgggaggggatcctagcacggtgattaagagcttggactctagacagcctgctttgaatcctagttttgccatttattggctgagcgaacttgggaaaatttagccttcctaagcctcagttcttcagctctaaagtgggcctggatggtggaggaaatgcaaagtggaccaagtaatggcccctgacaaataaggcagttttttttgtttgtttgtttttgtttttgttttcttttggcagaatttcacacttgtcacctaggctggagtacagtggcgcgatcttagcactctgccttccgggttcaagtgattctcctgcctcagcctcccaagtggatgggactacaggcacgcgccaccacacccagctaatttttgtatttttagtgaagatggggtttgaccatgttggccaggctggtcttgaaccagcctggacctcacgatccacccacctcggcctccaaaagtgctgggattacaggtgtgagctaccacacccaacaacaaggcagttttaatgattaaatgagatagtacatgtataatgtgcaatgtagtgcctggtatgtcctcagtacagttttgctattgttattattattgttgtttattttcagggattattttgaggtcacaatgaagatccttgccattgactaaaggatatgaaaacaggagacattaatattattattaagttgggttttttgttctatctcattatgagaatagaaaattattaagaatagctaagaatcactatttccattacttaggcaggctataaggtaaagttagggctgtactaaggagtaggataagagaattttgcattcaagtggaaaaggtagggagaagccccacctttctattgcctcgctcaagaaatgttgagctgggagtacttttgggtgcttatgaatgagcaaagggattcagcttattttggcagggaggtggctaggaaatatgaggagaggtgttggtctaggtgtgattcagtttttctccagcctagagagcttggggtagcagcccctgctttacagaggaggcagcaaaggctgggtgactattgaggttgcaccagcactgacctagacccaggtccccccatttcagctctctggaggagaagccaatgtgcaaggttaggcaaccaggaaatctgaggggatgaatttcctttctcatccaccagcctgggcactgggagtgtctttgcccttaaaaggccttgttttgtcttatctgactgctgcctgcctcttgcttttcctgggttaagcagagctgtctacacatcagcctcttagcctgcccagctgttgatgggaactggctgcggagaagtctgtctgtgcaacgtcccatcactgtgtacaaactcgggcctcactttttttctgggacagctgtttgccctgtgttacagaatgcatgtgaggactagatatttaaacatatgatgcctggccacagagaaggtatttgtaattggattctcctggaccagcccagcctctgaagttctagaattaggtgcctcctttgcccaaaggctatcagctattggaggggagggtggcagtatgtccctcactgggtagctgtgaacactaactgacttcaccagtgtaaagtgcctggcacagggcctggcacagaggaagccagagtcaatgttgtctagtatcactttggaaggagaataagtctatgaaatgcattaaactcagcagggaaagtcctaaggagtagtttctccaggggccacagaagaccctttgggtctctatgagaggccccaaggcaacacagggcagagaggtctttccggtgagggctgttcaagtactaagtgacagtaccaggaggagtgcaaagccctggctcacaccactgatctactggcaagatgggtctggagaaggctcatctggcccagccagtggggtaacagctactttggtgttaaacccaccccctcacctgccttttgtggtatagctggtgaccctaatcatcaggccattgcaacatagcatggaagatggtgcgaggtggcgtgtggtccctggccttctccctctactgccttgcaccataggccatgtcctcccagcagcaccagctgagtagacttcagaagtggcttgagcccttataccatggttatgtcaaagggagtgggcctggggtggagggtaccctcatcactggtggcagccattaactatttccttccctgcctagtcctggcataaggcctgctttcgatgtgccaagtgtggcaaaggccttgagtcaaccaccctggcagacaaggatggcgagatttactgcaaaggtgggtgttttcacttctaattgagggtcaggaggcccaagggggtaggggggctaagtagttttgcctttgctgaatgtaaactaattcctggccttgggatccaagatctgaacatctagtatgattccttcattgtacagatgaggaaacaagaccagagggggaaagcaacttggccagcatcatctggcaaattgaggcaggcatagggctagaccctggcttcctaactcccagtccaatgttcttacagcagatgatgcttctataattttggtggcaggggcaatgggtacagggtacaaccaagagcctcttcgctattttactattgagattggggtgctgtggaggtgagggggtaccagtggaccttccttccctagcagtctggctgggcactaggagtgggggatcttcagcaggagggtgggtggtgtggctgggggtggaggaagaacatgcccttatctctctcctctctctgcaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcggggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaactctggtgtccaatcctgtgtctgtggagctgggagggaactcaatgggagcaatcaaattagcaggggctttgggaggccgaggcaggcggatcacctgaggtcaggagtttgagaccagcctggctaacatggtgaaattctgactcaactaaaaatacaaaaaatgagccaggcatggtggcgggtgcctgtaatcccagctacttgggaggctgaggcaggagaatcgcttgaacccgggaggcagaggttgcagtgagctgagatcacaccattgtactccagcctaggcaacaaacgtgaaactctgtctcaaaaaaaaagcaggcagcctggtggaaatgaatcaaagtggattcgttcctgctttttctaaggaccaattacttctcagtatcaatgccaactgaaccacactgtctgaagtgacccgaccagccaaacaccactggcttgtcctgtctggtctccacccccaaatctgggcctgggaattgcatggactttggacttggaggggctcagctaggccccaaaactgtgctcagaacttctcccagctcggaaagccccagcctaagagggaaactcaaccagaggaactttcacgtcaaatctagaaagctcacttctacctaggaggggtgtggtggaggggcctggctcagcctgctgtgctgttagggcccccacagcaagtccgtggaaggccacatttttttttggaaataggttcatgtgaggggttgcggcatccttcatcttaggcatacctgcctgatgcgttggggctgtgctgctttgcttcagcccttctcgaaaatgtgcccacactaagttttcaaaacaaaagcagatgctttaataacaacaaggcctcgtgtacctatttcccagatgaccagctccaacagtggccttgacagaggcccctcctggactctgagaaaggcacctatgcatgcataacacccatcaatggtgcagagcaatagaaaagtacaagatgaccgggagaagagctggaggagttcagggaatgccagcccagggtgggctctggctgggagttctgcaatcggggtcaagggctccatcttggtaacccctctggctccagcacagggggtggcccacgaaaggtgctccggacaagtttccgcagccaggaggacggctggttccacacacccaggtggacccttctgtctgggaggggcctacaggagtggcccggatgggagcctttggggcccaaagctggagagaggctgccctctgctggctgatcgggagggcctgtcggcgaccgtcctgtgccttgcaccactagctgtcttgctcccgggccactgtttttcagtgcagccccacggtgggcaaggggccctgacgcacctcctgggaataagacctgggtaaaggcagtaggctgtaagccagctgcggccaggccaggaagcactcactggacggtgaagggccagccagaggggcgcatcaaggaaggaggaacaccaggcaggggaggcacttggggaaggagggtcggctgacggggagggggcccagcatctgcaagcgcggcgcttgcgccgtcccgggagacaccaggtggtgctgtggggtcagggcaaaaggcaggcgctgcgtttccgcgcaccccacgccctcctcctctctctgtggaccctgaggactcagctcctgcgcaagacagcgcacgcgtctaatccccgacgctcacttctccttggagggctgtcgcgcttcggggccctgtggaataccaaaccctcaccaaagagtgagcaaggactcttttttttgagacagagttttcctcttgttgcccacgctggagtgcaatggtgcgatctcggctcaacgcaacctccgcctcccgggttcaagcgattctcctggctcagcctctgagtggctgggattacaggcataagccaccccgcccggctaatttttgtatttttttgg

SEQ ID NO: 17478 - DNA, 49472 bp, Human
cccttctatatcctagaataggaaaattatcgttatttaaagatgtaattaacatttattatggctagcatattaggttttagataggccaaatgtgtgatacaatagaattgtatttttatatgctgctgtgtatactttacagtacattggggcccttatataatcggtgtgcactgtactttaatgtccattttataggacttttataagggaagctggatgatgtggtggaatgagcactgtgccaggagtcacaaggcctggttaggatgcaggctttgccacatattaactggggcattgcaagcaagctacctcctctcctaatcagtgaaatgcagtgcttggctggatgaagtccaaggctctgtccagtcctggcggtctatggctagaggcagaatcttacaatatgaagtgataatagaggtttacaggtattttgtacacatctatgacatattttttatcacatctctggtttacttgaggttaagttcttaggaacagcgccctcaataataaaactgtttctattggaaactataatctgctttacaataatctgctctgcaaattgctactaggaataccttccttgggaaagctggggctccccgcatgtaacacccacatctcaggagttgcgtgagtgaccttcatgtacatggtccctgagacagtcattcagtcttcttgatccttcctcgacataaaattcccaaaaagaatagatctctgattgtcctttcctctgtagattagaagagcaaactaaaagtaaaatatgtgagctgtgagcggcagcctcaaatgacagcaagagtgacggctgtgatagtgtcacacactggtggaggccccaaaactaagaaactgaccggacagcacgactacacagttcagtaatggatgtccagaatgagaaacccagggcatcaagaagtacagcaaatatgttcagtgttgtttgctttaggaggcaaacagaatgcgataccttttagaaagatttccatcaaagtaaatacttaaaaaaaaaaaaaacactcagctcctgttacacaccaaattcactgatgtgggctccctccacgcctggagaggatgctacatgaataaagcttcactgcacatgtgtccccaggggtgagtgtatataggggaatgcacacagtggtcccagaataataagtccagagtgaaatttcagggtaaagcagcttttcaatttttcagtgaggatctggttaggatccgagttagatttaatttaccttaaattaactagcattcacgtattcacctatttaaaatattttttattaagcgcctaatattatgtgtgccaggcattgttttagaggttatagtggagtttcagagaggatccgctgttcacgtggtgttttaccggggtatactcatgaacaacaaataaccaccggttttaccaaggcatacccactgtgtggtctgatatcccaagtctgctccttgatgtggccttactgcccctaccccactttcttcagaggaagctcctttagagtagactgggttacccccataagatggagcactcctttggagcaagagctatggttctgccatcagcccgggagcctccaccgccggggttggtctctgctatgacctcagtacagagggagatggacgcctggctctcctgggcagcctggtcaagaaagactcctttctttcctagagagaggtctccctcggttcctgagctgagcacatgctttctcagtgagccggcagaacaggacagaggggcgtctccctggggcctcaaggcttgcgacgtttcttgctcatggggagagggaagggagagaaaaaaaagagcgagcaggaaggcgcccagcgtcccacacaggggactcgcagccctgcccccaagagcgctggctccgcagcagcagtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggtaaaggctcggcccccgcgtggtccgtgcgcccctttccagagcaccctggcccagtggcggggaccaagagacgcacgcatccccggggatgaggggaggcgaggggctgccggccccaggcagggtctacgcacctagtgcgagcagccgagctcccagccggttctgagctggtgtaaacgcgacccgaggctggctcgacggccccgcgagctcgatggcgcgctagtgggcaaggatgggtggttcaccgggacacagccaggagcatgtcccagcgtgccaggaggttgaggatcccccgcgagcggttctcctgtccctgagccctgggtctggacggctttctctttcggatgctgctctagggatctgccctgcatcctgtctggccccggctgtcctggggcccatggtccccgcgctcgcaaacggttgtgggccacccttcacccttcctgggcttgatctcctggccttcagctggaggccgatgcccagcgtccaggccaaggggaaccccagtccctgtggggccgcgcatgagtatccgcgagcggggtgagggagtcgctgagacaggagtgcagctcaggagaggcgctgcgggacgggaaagtggcacagggagcagggacgagggcctggaactccagggcactttatcgagagcctcctgaaagaggctagcctagttggaaggccgccccagggccagtgggtcccttgacgacagggaagggggtcagggatgctttctttcccgaatagccaatgcagaaatcctctttcccactggattcttcttaccccacccagcttaggtagaaacaagtgtctcatggggagagtacggaatggcaggttggaaatccccccgggccccagggagacctccagctgaaccctcacgggcacttttccaagctggatcccgggcctggcaccccctcctccagcctctgagaggccagatcccatgactgggggaacctgggagaaaggggcagcacccaggaaactcaaggaggaaggggcagtacctgacaggggagagcttatagaccaagtaaacactttaatacaaaggatgcctggtaagaattacacacaagtgagcaaagattccacttgtttatttatttacttattttatttagctaagtttagtaaaatgctaataagactttacccattaccaaacagtacaggtcaaccaagacgtatgtattaagacaggccttaggagagagtgaggggcagggggtaataaggtggaaggagacaaaagaaaccgaccctggcccttccaccacacacacacacacacacacacacacacacacacacacacctcacacttccttctacctgtggcttctgtccccccacctactccctagcccccattcctgagtggccccttgtagagccgagggaaggaaaatggccggcagaggacttcctgggccccagacctaaaggcctttgcttctctgtgtgctctttgcctttgtgtgggctccaggctcctctcgtcacatttccactcaagatcatgccacctccagagcacttgcctccttcccttttatttggtgccttggtaggtgcctcctagcctctttagaattaggtttggaataacaaagtgcccccatttctggctacagcccagagcacagctcaacctactctcctctctgcacaagacttggctgtccccttcccactcccactccatcccagcctgagctcttggctcacaactccagaaaactcaaacctgccctgggtgccccaaggacccctttttcctcctacctatcgggatattggctgagtgtctgtcagcaagaagtgcactttctgggcttggtctttgtggggaacttctatctgataaggtctcctttgttccctctttgtttttcctcccaaggtcccccagggggcttcactgggggagggttgatgctgatggctacctctccagaaactccaaggtctagccctgtgggcgtgtcccctctaccctcagactctgcggaggttcctaaaggaggctgcagaggcatccttgctggaagaggcggtttggtcacttggagctggtgtttctggtttatctggcttagttttcatcagatttccttgtcctctccatcagaaacacccaaacgtcccctatttgctctgcggccacctctactcactctgctccctctttcttatgctggtttacctgtcaggagcctgctttggttcctggaatggaatgagctggtagctgtggaaggaccatgccccaggcgttttccctcgccccctggacagattcaggttcttgtttagtctcttccaagagcagagtcagtttacctagggtcttcttgagccccttgaatcccatccaaagtttccctagttaagaagggccaaccataccccacaggttgcctggaagagtagccactgctccttgtaccccaggaaggacagtcaggaccagccatccttggtcctgtgatagaagtggcttctcagttcctctccactagtgctcttttctctcttgtcactgagggagtattgagccactgaggactggaggaagggcccctggagcctgtcacaaaatgcctgtctgcactcatgctctccctgaaatgccacagatcagacaagcaccttgccctggtcatgaaggccccgggcaggaagaaggtggcttctgtggcctggagaccttgcagaaggaggttgctctgaacctgcctacccatcttgaactgcccctgaagtattgctcccctgtgttttcaggctgtccctgtgtgcctcagggtgtctggcctccttttcttcccagactgtgtggaaggcaaggggaaactgagggggatgtcaccacccagcaaaagatctttgccagggaaatgacctccctgaggatggggaaggaaacacttatccaccttccagatctttataacttcacttggaatctcttcctaaagctgaacctgaatctcacttgccctaacccaagcgctcccccgccactgtgaatacagatcatacccagctcagtgaaaggagcttcctttcacctgtcctgtctccttccagggaagtcctaacaacaccagcaccattgcctgctttgtctcactgcctgcttagccatctgtgattttttatttcagcctttggcctgaaattctctttctcccttcttcatagaagtactgtttcccatctaaaattgctaagcctctatttctctctgatcagaggtaggggctggaggcaacattgagccaggggaggtgcctgctccctttctgtagttcctgtgtctattcagccctcatcaggggagaggggggcatgcttgtacgaactccgcagcctgcacagtgaaggagctcgcctcaggagcccccactttgatggctttttgtatttgtgtttgactatgtctcagcatgagcttctgcccgagtgttctgctcattagagtttctagaaagttgtcctttcctgaccacaggcatcacttctggggttgttttcttgggaccgaagctgagattgcagatggtaatggctatgtgtgctttagcttgttccattggcgaaacataccaattaaacttcaaatgaaccaattcttgtttctttacaatgtaccttggcttgaagttggagttttagccagaatttccattggcctgttacaacacatgcaaaaatgctgggtattctagggtgttttgcagcaaatgctgcttctctggatcctgctccttgacagagattttttaaaagtacaaattcctcccccgaccccataccattgtaagtatcattgtgccaattgttctaggtttagaaatctgggaagcgcttctgcgatgggccgtgacccttacaagatgtgtaatgtttgaacaaaataaaatggacgaatattagatatcttcatgtgaagttccttctaggcatacgctggacacatgcgcacacatgtatacacacataggtcacacatgcatatatgcatgtatacacaatacaccccacacatgaatccacacacccacacatgcacacacgtacacacacataacatgcacacacttatgttatgtgtgtgtacatgtgtgtccttgcagctgtgctgtgtcaggagcccagcctggcatctacctggtgtgcgatcttggacaagtcgctgcctctctttgggtctctgcagctgtcagaggttggattagatcatctccaaagtgctttgcaatgggaacactctttggaaatagattttataactctctagctctgcaaaccatttgcccagaccgccagcagctgttctgccaaaaagctcttccccttaaggcatgccactcatcgtgtctctctcgtaaacatcctaacatattaaaaagtcttctcatccactcttctcaaacttggctacatattggaatcacctggaaatttaaaacaacacaaatgcgtgagtcccacccccagagattctgacttagtgagtatgaaggatggcacgggcatcaggacttcagaaactcccaggtgattctcatgtgtagccaagttggagaaccactgttctagtccctgtccttcactcacacagatccagcatgggggagcacccctatacaatgacatacacccatgtctttctctcatacacacacacacacgcacacttaatgtagtagttgctggcgagagcctttgactctgaaccccacctgaacccgtcaacccttgcccactctaacccaccaccctgccccctcacgcccatcctgtccccacaggatgctcccatgctctgcccagtcctcaggcttggtggtggccatgaacagatctgctgaaagagcagcaggattgtggcagagctaggtctgaacgcgtcccagcagagcctgagggagtcacatgggctggagagggagaagagagaacacaggccacagcaacccagtttgtttcagcatttctgttcagtacgtacacccaggaaaaggtcaagagccacaccaaagtgcccggtgaggctgtgctgaactccttgccctccccatctcctagaagctgccaagttggggaggcatgtccacggtgctcccagcagcccagcagagggggcaggaggctggccagcccagtcctccctccaggagctggaaccatcccgcagacacagtccactcctgcccactccgaaacacctctgagggtattctctcagcagtagcttcctggcagttcttgttatctcatttaaattcctattgctgtgggcctagcttttctgggcaccatgggtgaaagagatttcagagggtgaagtaaaggcattttcaagactaaaagaaaatgagcttcctttctcaagcttttcatgctgaaggacaggtgggctttattcaaatgtagaatatgctagaagaagcatcggccttaagggagacagagtaagcaagaatgtgttccgagcagcttgccctgtgacgaaggagaaggatttgaggggagggaaagtggaaaaagcggatttccctatgacctctgtctgcaggaaggctgatgtcctgagagccttctctatgtagaacctgggcctgggattgggggtgtggagtgtggatctaccaaaggtgaagattccttgcttcagggagctcccagcttggttggggagacccaggccctaccttctgggaggagtgcacacacacacacacacacacacacacacagtgtacagaagccacattccaaggagcccacaagccagtgcagagtcagccgctggattgagtgctgacatggttatgctggcaagtttggagtgctcagagctgggtgcggtcatctttaggagaagctgatttttgtgcaaggttttgaatgcagggggagggttggagaagaagagaaagaatgtttcaggtgcagtaagtgtgacctatttgaaagcttggaggtggaagaggatgagtcatccctgcaaaggctcacctgcccctactggagagagatttccactcatcctaaagaaggagctgcctccagtttcaaaggttttgaggcgagaaagcttgagttgcaccgatgacacaagaaagaatcagcctgtcgttgtctaaggcaccaaagggaagcagtgtgccaggacactggtgacctgagcggtagattttctgagatggttttacaccctaaaacgcggatgtaaaatcagacgagctatgtggacagagcaggttgtgttgcttgtatacctgggaaagtggcagatgctctgaggcacttgctccttgaccttggggttctgtgggtgggcagatgcttcctgaggatggcacacaggttgggcacactgtcagtgtcaccgagaagccaccacatccctgctcatgctgcatgcacccatatggggagaagaggggcaaagcagatgcttagctggagggtaggagtgattctgtggggtgagctgggaactagcccctcccccattccccaggaactaagaatcctcctcaaagaggtggccttgggtatttgagagctgcagcagccctcctctcttcctggtttaccccactcaccagggacctctttgagtgggaggagagcctgaccccattctaagcctctaagcaccaggcatcagagcacgttcaccacaagggttgggcaagggagaagaggtcattgacgcaaagagccagctcaagccagtcaggcccagacccagctggggcaatgccctgaactcaaggtcccagggaaagaaagacatggttcgcacttcagagagtgtccaaagtacatggtggtggagacttgtacgggcgtgagatggagatgggagtaggcatcattcatcaggaaaggcttcctagaagtgcattctagagacatcggggaccaagtggaagagtgagctagcaccattacactcattagaagcccatgctcttgctattgaacttgacttttagagggcattacttaccagtcagacaccccagggtcaagagagggaaaatcacttttgttgtgggagcagtgctcttacagacagagcacacctgcccccagtactccttggttatctggcacactgcgagctgtgatttcaggtgtgtgacaactatggacttttcccctctctcaccacctccgccccaaatactgtcaccttctgccagattagcagtgcaggcaggtgtgatgttaccctcattctcaccagagccaagcagaccccaactacagataggtcttaggagatgccttcaggaactgcctggaagggcctgcaggccacaagtgagtgacagtcacacctgcctttaccagagttcatgctggacatggggactggctttgggaactgtagggcattctggcctctccctccatgtgtctgtgtgtccactgccacctccatggcagagaggcctctaccttcatacagagaagagtgtatgagagggaggcaggcaggtgcagggtgtggcgggaggagatggttcgtctgatgacccatggggagagcagcatcatgctgacaggttctctcccagaagacgggcaagaaggccctggtgcaagccccccggggctgcttctcatagcaggaggcctccccggtgctccataaagttctgtctgtcaccaccccaaattttccacccagaagcagctgactgacccacacctgacctttggtgagaaatacctgctcacagggccagatccaaatgaactctatcctatcaaaccttggaagaatgatcaaagtgggctgggtggaagggaggcagacaagacctggtggttggccacctagggtcctgactatgagtgtgcctggctgcagcccccttccttgggagcaccagtcctgagtgactgagcccatgagattgcctccagcctcttcctgataaggacagtcttgccagaggagcggttgctggagaaaggtggaggaagagctgtgtgcactctacagggagcttggaggaagccagaggttcaatgggccacatggcagagtcccaggatgttgctcataggcggatggcccttctggagtcagggctaggcctggagtataggggaggcctctcagaggaccctgaggcaggtggcaaacgaggcggtagtgtggcctttgatgtctgcccttcttccttgtaagctgagctgtgtctctggagaggaggagtcggctcctctgaacgcagtcaggcacgtgtcactatcatcacaccaccacagggcagtggaactgtacggggcctatgggaggtaagaggccaaccctctcttttgacagaagaggacactgaggctcagagagagcaagtgacttgcccaggtgccagaaccaggacaaatatcaacaccgctaggcccccagggcaagctgtgtctgccacagcttgagacccctaatgtccatgatggaagggtgcagagagttgggcagcactctctgctgtgggctatgggtggtgacctggcgctggacaggggaggtggcacgaggtggggatccctgcctcattccaaagctgccccttggctattccctctactcccagctcagatattccagccctgctcccccaggcaatggccggggagcctaagtgggtgtggcagatggggaggagctaccttggccgggtgagatcactgcccaactctcttccccacagacagggtttccgatgggggagtctgaccatcgctttagagaaaaggagtgcatatccctcttaggaggctctcactggatcccactcaccttcatcccccaaggccatcacttaacaagagtgtgggccaggccacggagccatggcttgctcttcgtggagctcccagtatagctgagggaatgggacgcagggcagaatgagacttgggctaccaagagcaggacagtatgtgtttagaggcaggagagattgccttgtgcagaactgatcagaaagggcttcctggagtgggtgaggtcttgagcttggcttcaaaagatgagcaagattagaaggtagtggccaaggagggaaggcaggtttggcatggagggagatgtgagtaaagtggtgagcctgtcaccattggccatatttcaaggacagcaggacagtgaacagaccagcttgtgcagagttgatgctatcccttagggtgtccctgctggccagtgaaagggagatgaggggggtggccccactaggagccccaaatccagttctgttttctgtgatgcaaagccactttgccactaataaccctaatgacactctgtcctcctgcggagcctgtcatttgtgggtctccaagcactccgaaaacattaattaatcctcactgggcctttgaggttgatcgccgctcccccttcaccagccagagcatgttagaggtgaaagaatgggaggaagtttggtcactggtaggggctgggctgagatttgaatccagagtcctgtcctgaatcaatctctaatcagctgttgctgctggactgggaatgtcggaatcctgcctgtctcccctgagtgggaatcttatccttgtggaacatggagtgatgattccctgggctggaatggccgtgctccaaggccctccagaccaagtcctgacctgtaggtgttaacctacccaagcagcagtggagccactgggctcccaggaaggggacagatgagagttttagagctgtccctgcaggagtctgtggtagcccttcccttggtcccggctgtggaggatgtggagatagatggagatgacattccccaccttctcctccaggagctcagacctggtctcctccatgggcatagtggacctggatgcagaagtgatgccctgaggaacaggggtggatgaagatcatggccatccctgtcctaatcccctcctttctcctctaggttccatgtatgatggcttggctgacaattacaactatgggaccaccagcaggagcagctactactccaagttccaggcagggaatggctcatggggatatccggtaaggaactgcttccatcctaaaagacctggagtacttgtggggatggtttgaggtttatagtggagaaaaccggcaccagttgctaaaaagagtgatgtaggctttggtccgtgagttgaggctcatcaactctgactaggtctgttgacttggccattgtttcataggtggctctcgtttgggctgactggatatttttgaatgtctcaaatgataatattttaggaaaagcatttttaaaaggcatttaaaaacaagtccatttcccagtaggtctgatttgatcatggatttgggaaatgtttgcattcttgaggtctattaatggaccagtttagatgtttctaggaaaatcctaaagggtcatctctgttcgttctgtgcctatggtcaaagagccaagagaacatgtccactgcattgactcctgcatatgacactgcatgctagagtggagcctccctgacaacccgacacatttgggttcaaattttaactctgctactcactgagatgtggctttgggcaagttacttcaaactttgggactcagcttcttcacatggaaagtggatataacaaagaacttctggggtcattttcaggattaaatgaactaatgtacatgaaaaaagattacaataattcttaagattatttgttaaattaacatggatagaggttattttagatcctgtaatcctggctctgtctgctttctaagtgatctcaatccactatacttcatctatccatttactgaacaaatatttattgagccctaattctgtgacaagcactgcagtagatgctcaggatacaaccacaccagccagtgcaggaattttctgctgctctaaagtcaggagtaccgggctagatgacacccaaggtttctcctagcctccaaattctatgactttcatttactttcgctgatgcaacattagcctgcattattcttgggaattcttttgtaaggccctcaagacattgtcagatggggattaaaggctgcttctctgtgggaatctggggttctgtcttggtggggccttaggatgcagcagcatttgctttaagacacagatgtctcacagatatcactcctgattgactgtcaaaggtcctgggtcctggggagaggagagggtgaggagtttataagtttggtgttcttttgtcatttgcttgattcttccattcctgagttcttttgggggctaattttggaggctatgtctttcttacatattacagcttggggatgaaaggagacaattaactagatttgctgtgaatttacttccctcgcttttttcctgattcttgatggcaaatgacactcttagtgcaaaataaacccagcacactgagcccggtaaactgacagatcaagcacagatgtgaataaaagggcttttacacaaagggtgatgaccaaattgagaaaatggcttaggaatgcagcataaagggattagatgaaacccaaggaaggcagatcactgcaccagcagccggaatggatgattatgctgacagtacagatggtacgtgtctttacttaaatgacattaccagttcagagcttaggaggcttaggttctagtcctagttctgcccctctctggctctgtgactttagatagtttaatttctctgggcctcagttttctcatccataaaaagggaatgatgatactcgtgtgtctacttcactcacgggttgatatcagatgacattaactgtgaagtattatcaaatgggtaatgtaaccatggaaatttgtaaccaagaactgtaaaggaactctttcggggaaggtgtttctaaagaaaaaaaaaaaatcttcatttggcccatgttgaacatttcacttctggttaattaactcagtcctcagtcatctcactagcttttaatgctcccaaactgtcctcacccctccctgtgcccatttcctgacaaccagtgaaaatctctttccttctccccaccctaagacccaaccctccttactccctcgctggcaggactgcagacatgactcatggcagggtagctgctgaggcacgtcccatctcctttcagttcaggagaggctgtgggaagagggaagaactgagcacacatgaagatttggcagagggaggaggccaagtagggaggaagtggaataattgatattggagccagacatataatcagatgaaacctgggcaaaaccaaacgaggtccagacataaggagaaggagagcaggcgaaaaggcaatagagatctgtggcatgagataatcctatgtccgtgggattttcccatggatggtacaactggcacaggacgatgttattcctcccctctggtgaaaccaatatggcagcagaaggcagggagggtggggaggagggtgtagtttgtctgcacaagcatcatcagcatattttcaggagcttctgagagctgatgaaggatcatttgctgcagatactttatattcactcggtcagccaacttgtattgagcaattgctggggcacagcagtgagtgaggtgcgctacagaaacacagttgaaaagaatctgactttgccctcaatgaacctgcagtcaagttagaagcacagaggtcaacagacaaataagataaaggcattagtttctgtactggagcataacaccaatactgccattgctcagaatgtttctagaacccctaaaagttcagaactgtcttcagcatcatttcaggagccagacaagaaaaccagtctcatttctttattgtcatgacctgggtttgaccagaaacaatattactcacttggagcacctcactcctcagatctggctctagttctaaatatcaaaccattctcaaatagcaaagctttgtcacctcctatacatatctcatttaaatatgtaaaggatctgtaggcaattccaaaaagaaggctctaaaaatatttaaaaagcaatggtcgtaccttatagttttaccttatagtctatatcaataatagccttgtaattaaaaaacaatcatcatactatttataatctatgattattcacatcacaaattgaatgtagagagactttcttataataaaataaaacttaaaacaaagatagtgtgacacacaaaaagcatctaggggcttaaggaaaataaaagactgctccaaagaaagtcattggcccagtccatgttctgctctctgctggccaccccagcctcctcctccttcaggcagaaggatctgctggaggacaatgttggaacctcagagccccacagacctcagggagaggaagcagctggtgagatggagcaaaagatggggcaggttttagcctcgctgcctggtttctcagctgcatactcagctatgctcttctggttctcagcaccaaacctgtagaatattagagcccaacactgtttgcattttacagttgaggaaacgcaggcccagagaagagaaattactccttgaaggccacacagctggttactggtacagcggactagatctctgacctcgtaactcctaacctagtggagtttgttttcattaccccagacatttgcacttcttatgactgccattctgtgggtttccacaatctcaatatttgaacgttacaactaaacactaaacactaaagtttagggatctgcaagacactcatgagtctgaatccctccatttcctcccttcccatcccctccaaccaggcctactctcaccatggggagtcagcctagctcaaaagaggcaggagagaagctctgtttttcccttcctagactgaggctgggttcacttgggtataagcattaatgggtttcagggcagggttaccagataaaatacaacaaaatacaataattgagacatgtcttaacttagaaattatttgctgtttatgtaaaattcaaatataactacatgccccgtctatctatttgttaaatctggcaaccctctgtcaccatgtctccccactcattcctgtgataaaaacaacactcctttacgtgctcctctcctaggctagggacccagcagaattactttaggctgcagcatttctggtgagaaaaggaggatttttgtcccatcttagttgtccttgtaatatgtcccttgaatatcttcctctgggtcagcaaagacgaggatgcggggaatagagagctggagccatggaaaggcacagcccttcaactccaaagctgaaaacaggccttgatcacatgggtttgtcctcaatgaagctgaggcgtgtggacaattttgatttccagggaatggttctggattaagatgacactccttttgtctatcatcttcagctccaaagggtttacttatttttaaatcaagaagtgcaccctgagcacttcttctgggagtcctaccaagtaaaaagttcttaggtggcagattgccctacaccaccctgctcaggatctaatcagtagagaggaaaaccactgaggcatcatcagagggaggtctggaacagggtgaccatggtgactgccacattgaatcactcagttaaatccagcctggcatgcctaagagtgagaactcccagaatataacaagggagaattctgtctttgtcttggcattgtcctattcattgaccccatttctcctctttaacgcaggacttactagcaaatctttcttccagcttcttctcagttgtacttgcctaactgatatgtctgtatttgacgatcccattgtgacagagtcttgtggacaatgtgctaggggcccttaccctaaggagaactgatcttggccaccctagacctgaagaaatgtggatgaagcctctgttacagatgagaggactggggttgcatcacactccagcaggggatgggaaagccaagcacagtgctccccaggttggtggttcaccctcagtcacagccatgctaatcgagtgtccacaagggcagagccatgggccaggtactgcagaggggctgccggggagaaacacggtaggactcctaccctagcagcagcagaaacagactgtccttaccaatccgcagtcaacagaggccatgcccagagacagcccggagtggaggaataagccctggactttggccaggaacttcactagccatgtgactcttagtcaagtctgctccttaactagctgtgtgactctagtcaagttcttaatctagctgaacctcagcttgcttatctctgaaatggatgaaaattcctgtctcaaagagcagtatgaagtttatggatgtgacataccagatcagcagtgggaggcgtggattccagtctcagctgggctgctacaaactgagggatctggagtggacttcacctctctagaccctggctttctcaattatggagcaaggcaattggactaaagcacagccaaggactcacttagggttgcatgtggcttgagagctgactctgagtagctacagggagctaaagtctgtgtgctggtccctccagggtcagaggtagtgttaattcctccagcccagatttttgcttcaagcctacagatggataaaagcttcttaatttcctctttgctttcatctgagcactccaggcaccaggaaaacagcagttagttagcccttgcaacaggatgaaaagatggtaggacttcatttactttagcttcacagacagggaaactgatgcacaacaagtagctctgctgagtaactaccctaacttaaaacagacccaactccctctttccaaaccatgtgtctcagctccaaatgccactttctaggtgtatgagctgggttccttcggcagtgcctgccgggcctctcgtcttttcttgaaaagtccaggtgagggactgatagtagaccacagcctcctactcccaggcaggcatggatcctgctccaagagggagcaattgatgtgtttgccaactcagtgtccccgctgccaactcatgactcacccccacccagccctgggagataggagagtcctacaagggccccaggctctcaccccaacaagaagaggcaatgatcctacttgccaagggacagaatgtgcctctgagagaaaatggaggcaagtgagcgggagcgggcgggccggctccaggggcacccctccctgtggaaggagcatgccgtgtgctttcacagacaaactgctgccactgggacactccctgtattaaactgaaggagaagcctatggcaaacactggtgtctgggtactccttgggaggggccctcctttctaagccacagtccatcagagtggctctgcttcccctaagaagcttctgttgcccttagggttgggctgagctcggggagcttcctttctgggcttgctctcccctccatggcaggtgagttgaggctctgcctcctggctgaggactgggtaagccagggaggcccctttagagcccagagagaatgtggagaaaaggaagaaacattggtctgaggcctggttccccgtgactgtgttggggactcctcttctgctgggcctcaggcttatcatcagcaagactagatggtggctcagaccacctccttgtaactctgacgtctggcttctgtgtccctcttttggggagagaagtcagagaatggccccatgtcagcagcatgggcttgcaaagggaggaggacacggttccagtgaacaaatgcaagtggtgtcctccaagggcaagctccaggtgcaggaagtcgggatcggctcctggaggagctgagctttgaactgagtgtgcaaggagagagggctgcccttagcagacaggatggagggcagagcaggaatgcccctaggtctggactgtggtctgagagtaccttgctgactgttcacaaagcataggcatcccctgcaaggagggcaactggttccatgttgccagctcctgaggtctcctaagcctcccaggccttcatcacaaacccacaacaatgctcctcagggccgagtgagcacgctggcccctccatcctcctgccccagggaggagcaccagacccaggagagggcagactcccaccagtcactgtcctgatagtgtggacccttgtagaggaatggagagggaaggccagggcaatttggtcaggatgtgcagggagacttgtcactgctaagggactcagtgtggcagctgcttagcaagtggggagcaccaagctttggcagcccaggatgcgatcagcagcggatccttctcaggatgtctgcaggaaggaactccactctccccagagacaacagaagccagttctccttcctttagcttcactaatcaacaactaatcttcctccatcatttccattcatgttgtgtagagctctgagttgatggctaggctgggaacacttatgcttggatgggcctggggctcgatttcttccattctgatgagatactgtgaggcagacaattccctggccacagagaatggaattctgtcttctccggagaaggaagcttctggatgagtcggctgttgctctctccccttctcccctaatatgaaactttagagagaagatttgaagaatcaaggataattataaacttttttattttgccccagcagaaattggtggagtttcattttgggcttttttttttttcttttggccctgacaaaaactaatctactcaaccaaccagtatttaaagtccttacgctatagttgaaaacaaataacagacaaaacaacagcacaagaagatataattaaaagctaaattttgcagcacacgctaacttaaacctctccaggcctcggtttcctcatctgtcattgaaggcatgggaccagatgacctccaagccttgcttccccagcttcagttctgagtcttggacatctggggagggggtcttgggttctggatgagccgcaggtggtggctttcgagcctgtttcagctgcgctgtgtcctcagtcagctctcaagggagaagtgctccaacccgcggcacctggttatttaataatcccttgaattagtgtagcattttgaacttgtacaaactgcttgtgttttcatctcctgacttgatccttcagtctttgtgagctcagtaggtggaccaagctttgttattctcattttatttgcagggaaatcaaaccacagaaaagtgtaggggcttgcctgtgacctcacagatagatctggcagaactgagtctggaccccagtggactttgagcggggtgtgaagagcaagaggagggagggacctagaagggcagggggagaagtgggccaagcctctcctgctggccaagtttcgaagccagcaagcagggcatgggattaagtcatcaaaatacagtcctgggggtatcttctggtgccttatttctgctttgagagttttccttttgtcactagactcagcgagacaaatgcagcagaatttcccaagcgggtggaagagccgtccccaccctttgcaagggtgaggctctactttctcccccagggccctggcatgtctctacggaagcctgcctgccccaggagagcaaactcagctgaaaacaaaatcagctcaggcacggggaggggacgggggatctgtagagacacaggtggggagaaaagcagctctagacccggagcccctcccctcccgcccccacagcgtgcccaagggcgaggcctggaaggggatgaagacaggctgggaaggaggccgcttgtgacttcagcaaggggtgaatcacagactgccgaactgccgaactgccttccttcagaagaagccttacagggcatgctgtggttggggaaactgaggttcagagaggcgaggcgacggcctgaggctgcacagctaggcaggggagaccaagactggagcatggtctcctgactcctggctcagggctcctggtcacactggcacatcatggtacttttgccactacgggcaatcatgtttcccagacattcgtcatttgcattctactgtcacaatttttgcaaaatcataccaactattatttacttatttttaagggaattacttatcagttccactgcacttatttatttattcatgtatttattttagagacagggtctcactatattgcccagggtggtcttgaactcctggattcaagcaatcctcccgcctcagacttccaagtagctgcaactacaggcacgtgccagttttagagatggggtctcactatgttgcccaggctggtcttgaactcctgggttcaagcaatcctcccacctcagacttccaagtagctggaactacaggcatgtgccaccatgcccagctattccaatgtatttattttgaaaggaaactttatatcactcacccaaatgacaaaaaccggtatcttttgccacaaatgaaggctaaccacaaccttggtaatcaattataataaatagaataaaaacataacattaattctagctaggtacttttacctggcagaaaagttttatttttttgtttgtttgtttgttttattttgttttttcttaaaaagagaggttggcaaatattaaataaatatattaacacccagctagactttctccctgtggtaatcaaaatgggaaaaagaagtcctttctatgagtttcaatgttagatattgctgtgtccttgatttccctggagtcaccccacagccaccagtagtgtgttgccagcacttgggggagattccgggtcatatgctaatggctcaggataattttcccaaagcaggcaaggtaggagagctgaggtcctaagagcagagccatgaagtagagccctctcccctcaccgaggtgacctgccccacgcctggctgaacacttttttaactggcacatttaaggtggatgtttctgactgagcacctacagttctctggactcaccagggtctgctgggtgctatgccctgtgggaggattgccctctgtggccaacctggagagggcccccaggaagtccctaagcttctttcatatctacctagggtcctaatcagctctcaggaggccccacagtgctgggatctgagttggggtgctcacgggtagccagggacccattcctccctcctcctccttcctggccacgccagaagctcagcaagactgaactaattccagaagatccagggctcagcttcaggtaccagctttaacactagtccctgttttctcagccccagttgtgtgtgctcagtggtgcgtttagagtaccactaagggtggctggagaggaaccaaacagtcacattcccatcactcactgcaccttcattctcatggtcctggccaggacagaacagttatcatgaccacaaggtctccttgcccacaggcctggcatcccttgggacagatggtcttccagcccaggtctttgggcattagaattgtgacacatagctaagcaactacacacttcttaaatgtcttcaagaacctcccacagttggctcaaagaagaagggctggcacctcctgtgtctagaaccactggggatggggtcttccaggagtcggggccagcaactggccagagatgctagagtttctgtagagggccccctagctatagagactctttgccctgtaggctttgtttgtgtcaccagactctggtagcagagtggctggaagaaaatcactgtaagagacaccaaagacctgagtcctggcttagggtctgccccatcttagctgcgtggccttggaccagcctaaagttctctgagcttaatatgctcacaaacagaacaaagctgctgctctctgccctgccacctcattggccagctgggagataatcacaaggtgatgaacggggaagccctctgcacactgggaagtgccacaccagtgatggtgttcaggatatgctcaagcaacttccaaagaccttccctacctgagtccactttgggcatgggatgtgtgtcccacgtgggcaggtggggagtgcatatagaagtgtgtgtccgtgtgtgtgagcatgcatgcacgcatgcttctcttccaaaggtgagatctcttacccaagcactgaaggtcccagtcaagtgtctctcccttcatgtaaaattcttgactaacaggccaggcacagtggctcacacctgtaatcccagcactctgggaggctgaggcaagaggataacttgaggccagaagtttgagaccagcctgggcaacatagggggaccctgtctcataaaacagttaaaaatcagctgggcatggtggtgtgcacctgtggtcccatctgcttgagaggctgaggtggaaggattgtttcagcccaggaggtcaaggctgcagtgagccatgatggcagcactccactccagcctgggctacagatctgtcttaaacaagcaaacaaacaaaaactgtaaccagcaggagtggtttctttccactgttgggtctccagggacctcttttctgggccaggtaagcacctgcccttcaggatgctgccacctcccagcctttggccctcctcttcccagggctgggaagcacctcctgttccagtgcatggggtggctctggggccagccagcctctccctccaacttcccagtatagggtggggggcatctggcccagtgggatcttcctgaccctcaagggtgctcttctgaggtgctggctcgtcatccaggactccaggagttatttcatatcagaacggccccctcagctttccctcttcatgatgaaccatcactgggacaattgaaccagcctctgggtttgaaagccaggagctatgacctcagaacatggagctcctggagggcagaatgaccatgccttccacttctctggggccatggaagggagatggctgagggccagtggtcctccaccactcgggctgtgagagctgcgtctgaagtggcaaacgcctgccagggatttcccttccaaaaggaaacagacatgtctgtgtatgaaaccttaggttcttgtttccaaacccatcctagcagtgttcagagctgagaaaaacctatttctcaggtgtagagggggaaaggtaaaacagaaacatttcggaaaacctgttttttccacagtgcagtaaataggcaaggagcaggaagtggagacagagctgatgcaggagctggcatagttgcgtgttgatggagcaccaggtgtcggctaggcgctgggctgcacaagtgcgtgttgtccccacaccaggcttaggaactgccatggacctgacctttgcaggcaggcttagagcctggagcccaagaggctaagatgccttctttatcccagaattgtggcctcactggagaaagaagcatcttcccaaaagacccgcaagctacaaagttttataggatattttctacttagaaaagttgtcctcagttatccatagacatttgttaatactggcatgattgaagtatgctcacagtttctgcttttcaaagcttataagggatactgaccattattaaccagatctctggggaagtctctactctgaggatgggcaccaaaacttttactttttttttttttgagacggagtctcgctctctcacccaggctggagtgcagtggcgcaatctcagctcactgcaagctccaccttctgggttcatgccattctcctgcctcagcctcccgagtagctgggactataggcgcccaccaccgtgcctggctactttttgtttttttgtatttttagtagagatggggtttcatcgtggtctcgatctcctgacctcgtgatccgcccgcctcggcctcccaaagtgctgggattacaggcatgagccaccgcacctggactacatttttttaacatttaaaaaattcaggtggcaacatgtacctgcactgggcatcaaggtgtttatggcttctgctgtgccttctctcagtggacacttagcgacttcagttcagtagcacttagcaagtaccttctggagttctcacctgggtgggcactgctggtctcggggtgctggtgatggcattgtgggtgcagctccctctgcctttgaggacccacagtgaggcacacccaccacacctcctccaaggccaaatgggattgctctgtgtccaggcgtcaaggcttctgagcaatggggctgctctgcccaaagcagtgttccaggaaaagaaaggagggccagcccagggtggaaccccctgcttctcagagaaggagccgtgcccagaggagtcaggaggcagggatcgacacttcccctgctgaagtcccatctgttgtgactcaggcctcagtggttcccatgctgactcagactgctgaataagcaggcacccctacccctttgggaagattctcgaccgcctggagccctgtgtgccccattctcggcagccttgctcggggagcacctgtgctctccaaacccctagagagggtagagcagagccgctaagccacttgcgaggtgccccttgtgatgggtcagctctgcccaatatcccagtcctgactgaaatcccagcaagatgaacaagggtcactacatgcctactacatgagagcccctcatctgggcactgagtggggagtggcaggtactaggcaagtcgcaaatggaacctgtctttgaaagacttctaatcaaggttctttctccagcaagccctcaccaggcctgagaggcacgaggactccatgaaactgtgcgtgcactccctttcatgaaaagggccttgggagatcacgctgctgaagatggccctgttggacactgctgggtgtgtgacttggcaagcagaccagggtgtgtctcgctggagaaccggtttggccggccccaccctgctggcagaagcttggtttcaaaatgggctaatagctggggacacagacactcttttcatcatacccagctcccaaggagtccagcagcttctgtctgtccagctagagttggatagaattctctgggctcaaccacccagctgctttgctcaggtcaagcggtaaagggaagcattctggacatcacagctggaccccatgccgtgcaccggcacaggctgcctcaccctgcctagaacggccctacctaccgccagcccactttactcatggtgccttctctctcttctgtgccctggaggccatgggaactgcagtgctgtcagcatcctgaatctccacccctagcacaaattctcacagtcacagtccacctttcactgagctcttgctgtgagctcagccctgttttaggcatctttgccctggagagctcagggaaatgacagaaacctacattagcaactagaaaacaaacaagaccagaggcccctggctttaagggcaaataattccaactctggtcattatggagacagggctgggttagaacaggccttttggagatgacaggtggagaagaggccttagataaatgtaggatttgggaggctgcaggtgaggaaaagctgtccagggtggaggagcatctgaacagaagcagggagcctgggatgtggctgaggtcatggggcagcttagaggggtgtgctggggaggggaagagatggctggacaggcagggtggggctgggctggggagtttgtcttgtaaggagcagacactgtaggttctccagcacggcaagagctgatgaaagctttccctaaggaaggtggagtgatggcatcgcaaggcagggaccagagccctgggggctgggcaggggccagtggggggcactggagtggcctggtggtaagctgatgggacccggagtcagagcctgggcagtaggggtgtaaaagaggggagtcagtaaggactctctaatggaaggacaggaggatgccatctctttttgaatggttagttactgccctatccgatgatttgggcaagctggagcttttccagctttgggggccactccacactgaatggctctctcaaggggcaactggtcatattcagttctttgaggccctggatctggggcttgtattgcttcactgagactgtctccttgcctataaaggaggggttggcctctgagagcttcctgacttaatgagggacaggaatagaggggagctttcagtgtggggttaaaacaccccacttctccaagaaggaaggggagaaggggaattacacaagcaggcggcaaagcggggactggctggggggctcctagctaaaagcagcttttcctggctcacctcgggctgtgggacccctcaaaagccccactggtctcccaagtgaagaaacatgtctctcagaatgctctggatttctgtctggctgtccagtctagcctgctgtctggcagagtgaccaactctgctctcaggaaattgagtttccagcctctggaatgttctgatccatgggataaccagacaagaggttgtgtgtgtgtcactgtcctttgtattcaaacagccagacgctgccagcagattgctatctgagtgtgggggtgtggctgggagagccggcattggcggtgaagctctcccacctgcagcgggcgcacgtgcactgcccgtgcatcctcttctggctgcagctgctctctcgggacctggaagacagtgtttggaaacgtgtggggacattttgcaatgactgtgaggcattactagcatttagaacctggaggctggggcactaaacatcctgccatgcttgggacagcctatacaaagaattgtcctgcctcaggtgccgacagcacccaagtaaagaaacactgcaccattcatcataaagcctggcttcactcgaagtgccccatctgggcagaccatgctcctccacttttctgagacatatttagacccattctatgtctgtggggtgagactagcacggggctctgatactggtgcatacactttcctgggctgtcttggcttcctgggttcatcctctctcttatgacacctggtatcccatttaggtatgtcacaggtgacataaaatctctcctttaggagccaagtcctaaggcagccagcctgtgcccaatctaagagtcagagggatatgatgtccctaccgagcaaacactcatatcgtggactgtcctgagtgctttactaacattagttcattggattctcccaacaatcttctatgttggctacaattatactagttttacagatggaaaaactgaggcacgttgggcttaagtaattgcccaaggccacccattgggcaacgacaaggccaggcaggctggctccagagtctgtgttcttgaccttgggtcttcctccagtttgtagatctcagcccagtgagctggaggaagcacctggattcccaggcagttgctgccgtttcagccttcaaggctgcaggcttcatccaggtcccaggccaatttgtgcagggagagctggtggcagttcacctccttgtgccttggagggaatccaggccccctcatggtacttggggaggacggggtctgagaggaggctttactcctgcttgtcaaagtgacagcaaagggccatgatgatgggagagagtcatacccagctgtcgtcaggcagcacagcccaccagcaccatgacactaggagctggggtggggttcccaggaatgggtgacgccactagggtgtggctgatggtggtaggctgggaaatgcagtcccacggggatgtctctgccttccccaccttgcccgctcccctgcaggtgcagccaatgcccattccctgtgggcagcccacccttgctgagacttggcaaggctgccagctgctccttttcccagcacaggaaagcaaagcccaaagcctctgagaggctcaatcagcatgatcacatctttgctggttttgggccaggatgagtgtttggacttctcattaggtgtctgagatgacgtccaggcgtgtcgtttatggagaacaagggtgctccttgttgcatttccatttaaggcttagctggctctttgccctttggcaatgctgggcttccccctccatgttgtcatctgccaccttccttcccctgagaggagaatggagggtgtggccatttgtaaaggctttcatggcatattttgcctgtaatctgcaggacacgcattccatacccagatgctcagaaaattgcccagctgctctccccatgccttgtgattgtccatctatgcctctcccaacaaccagacaccaattctctttggagtaggttggttgacccagtttggggaagaaaattatgcctgcctgagtgcacagctgggcgtgtgggtgaaggggatgagcaggctattgccaaggttaacagtctgtggcttctgagttttgaatgcaacttctgactggtggtttgacacccagtctttctgggagctcaaaccatgggagtttcctgctgtctgtgactccctgcagagatgaaaaaggaccaagtcgagtgccagcccctccccagcttgtgtggctagatctggtgcagaagggaattacccagttgcctaacgacctcccctacacacacatactctctctctctcagggaggggcaggggtgggcgggcaggccctaggttgctgggtttggccctggcccatcccagcaaaggtgagtcccaagtcagcacctgtgtggagatgtttttttatcatacttgatgttgatcctctactatgagaacaagttggagcaggccagacccaccagcttgtgagctcctgggaaagtcctcctcagacagttctgttccagaactgattcgcaccaagtctccaacctcacaggcccctcccaaggaggccgactccccacttgggctcacacagagctcatgaggcacctcattgtctgttgtatgtttttgtgccggattgagcctctgcccagcttctccccattgccagcctgacaacaaagcccaggaggccctccctgtaccccaccttgcagccccaggcctgcctccatgtgtgcacgcaggcccctagctcacagtcccttgtaaaagggcccagggagcaggaatattgtccctctttggcctttgaggtgacctgttaccctttgcttcttgccctggaagaggggaggcaagatgaagagtttagcagaaaagaacagtagaaaacagtcctggccagaatagaagtttctgtgtgctgagtataaggggcccaagaaggctggctgtgtgagaagctgctggtgtctgggaatggcatagggcttggagacccagactcaagtccaggttttgtcctttcctcaccgagtgactactagaaggtcactcttctctgggcctccaactccccctcctggactgtaccatgtgggaccagatcagaggttgtcaaacttttttgacagcaattcacagtaataaatgcgaaggattgttctgcctcaggtgccgacagcacccacgtaaagaaacactgcaccattcgtcataaagcctggcttcactcgaagtgccccatctgggcagaccatcctcctccacttttctgagacatatttagacccgttctgtgtctgtggggtgagactagcatggagctctgatactggtgcatacacctttcctgggctgtcttggcttcctgggttcatcctccctcttatgacacctggtagctcctttaggtatgtcacgtatgttgcaacccagtacccatacactgtttcacaaaacaatgtgtgactttactacctgcactgcactctgatattttatattccaggatatattattctattccatctttttaaaaatgatggccatagtcttctaaattgattttataatccacaatgggtcacagcctgcagttagaaaagtaatatatcagatgatggctcaggttccttccacgccaaacattctgggattctgtaagcgttattatgggggctggggagggctgtatctcatgccctgctggatccaggacccccatttaggaaccttgactgagcttttctccctttccctggccagatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagtgagtgctgctgggctgggttggggagccaggagggccagtggggagacacacccttagcctgactgcaccctgcaaagggctcctgggatgacaggagagacatagcttctgtccctggggagttcattgcccctggtgtaatggactccctaatggggagaacctggccccatgggcccttgaactcaagaagttcttagtgtgaaggtgaaacagacattgactgtgtaggttttaaaggtcacagtttatgaacagaaagaggctaatagttctcaaagtgtgttcctccaaccagcaacatcagcatcacccaggaatttgttagaaatgctcatttggggacccacccagacctattgtctcagaaacactgggagaggggcccagcaatgcatatattaacaagcccttcagtgattctgatttacactagagtttgagaacctctgatcttaggcatgtaaatctctatccatgttctgaaagagcaaaggaatatgccccggtatggacgacgggaatagaatgggtttcaggttacgttataagacaggtaaatccaaaggacaaataggacaaatagacataaaaactgagggacatggcctgggtgtggtggctcacgcctgtaatcccagcactttgggaggccgaggcaggagcaggtagagggcgcttgagctcaggagtttgagaccagcctgaacaacatgatgaaaccttgtctctacagaaaaatacaaaaattagccaagcatggtggcgggtgcctgtagtcccagctactcagaaggctgaggcaagagaatcacttaagcccgggagggggaggttgcagtgagctgagatagtgtcactgcactccagcctgggcaacagagtgagaccctgtctcaaacaaacaaacaaacaacaacaacaacaacaaaaaccctgagggacttcatggggcttcatgatctactgctacagaacagagcacaactcctgtgcatacatgtggaaggccatcacccagaggaaacaaaggagaccaaatggggtgccccgttaggagccatagacgcagaggtgtcgtgagtgacactgagcctgcccttcagggctgggggctccctgaacctttgaactgtccttcatcaccacctactgctcttgttatttatttatttggcaaatgtttgccgaccatctactacatgccaggctctttgacaagtgcgggagacacagccatgatagggacaacccagagctgttctggagctacacaattaactccttttctgagagcctcaggagctttgcattcttcatctttaatcctcacacccgccaccaggcaggcatgagtattcctgaggagaaaacaaggcacagagatgttaagtagtttgtccaaggccacacagctggctctccatcctgtgctcttccctactggtaccacactgttctgaaaataagcagaaccccgttatagagctagacgtttccgaactacctgatggccgtaaggcgtatttaggatgatctggagaagaactaagaaacctctctgtcttggaggctgatcagggcagcctctggcttcagctcattgtcccaaccagaggccctgagtggaggttctaggtgagatatggaagggatgagtgtcaagccattttggggtgacattttactgatgaatgcagggtgacattctctcaatgcaggcagcagtactacttacccagtgccagagaactctgcacctcgggtggttttcctagaaatgaagttgggctgctatagctaaaaccatgggtatttattgaccaccaagtatgtcaaagcataaggatagggctccctctttgaatgctggacacagccagtcaccaccctgtgactctacaccaggggagctggagaggttcttagaagagaggtttcccttccctaggaaggcttcacagatgtggggcatcagcagggccagtggtgtgccttgaggcatgcctgagacctggccagggtacagtgaaggggacagtcttgctggagcagaccctggataggggctggggaatgttcatagtggagccgggttattaggttaaaacatatgaaatttctggttttatggctgaaaaaaggttgactacagacatttcctatgattcaacctaatacctgcccttggacatcaggctaagctgtttaaacttgaacctgaagtatggagaagccgctgatggtttctgagctagagaacaacacagtgaactgggttttagaaccacttatctagtaaaaagggtatgaaattttagatgggggaacttgaggaagaaagccaaatatggaagtcccttgctgcctttaaagtgatcaagatcaggaaattggtggctataagaatgggaagaaaggctagatgtgaacatttttgtgtaagagccagctggacttggggatggatagatggatggataaatggatggatggatgcatggatggacagatggacggacagacggacggatggatggacagatggatggacggatggacggacggacggatggacggacggacggacggatggacggatggatggacggatggacggacggacggacggacggacggacggatggatggatggatggatggataggatcatggccattgtcttccattttcctaataccagacacaaacaagagagatggcaaggtaggtgggaagcttcccctcagggaatagggaggagtttttcctcagtggagagataacatacctgctaggacattaactgtgaccaggggctcactattctcacatggggcaaatccagtgggtgtagccttccctcctctggaggagaggagctgttcccaggggtattctccaagtgggcctgggctgccttgttctggctctccagagggcagatgaggctgtggcagcttagtgtgctgggaggaattctgagccccctcagcagggctcccagcccaccccgtaaccacccccactgcctattcttcacaggatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtagctggttgcataccttcctccttggtgggcctgcggagggcctgggtgtgtcagcctgactccgcttttagagatgggtgagggcatctgcagttggcttctcttgccttgcccagctgccaggagccttcgcattgcccaaggttagagctgggcatcttaactttctgcagagcaaagccctctgtttaagtggacattaggcaggtacaattcctccattggtcatggaagagacttcaatgccagccacgggttcaacagaaaccccttttctcaaatcccactaaagaacatgactgctcctcacctctcaactcctgccctcctacctgcttcctctctcccactccccttctctctccaggcatcttacggtagaaaacaggcctgttgatgcctccaaagctttgctggcaggaaggacactacagggttcttcagttcagcccaaggatgtagtgtcaaaaatgagtttcccagagtcccggataagtttgtatgcatttctatgtctgtgttctgctttagggttttgaaatgtatttacatccactctcttatcaggtcctcaccatcattctccagaggaagaaagcaggactcaggaaagaggagggaccctagctgaggttctcccagctaggatatgggagctaggatatgggagctaggatctgaatccaggtcttttgcctccgggtctgggtcagttatcatgacctcacactgcttatttattttggttgacttgaatatttctgaactgatagattttttggtctgaaaaaaaaatcagctttgagtagagaataactagatcagcctcatctcccttgaccaggcagtgtggcaactctttcctggcaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactggtaggacaacacggccaccgagagccagcctgagggctgtgcaaggccactggctatggccccaggctggggtgcaagcctgtctctccaggctgggccaagacacagctgtgcagatttggcccagggctaatatcctgagagtttagtgacactggccttggcccaattaggggtgtccagagggtgaccttgggtggtgtgcacacacaaggggtcaccatctttttgaggttaaagagcaaaaggaggaaggctgatgtccaggcaagatccatattccacaagccctgggattcccaggtgatggaaagagagtaagactgaggggagaaggggttaacaggccttaagcacctaccctgtgttcaagaaatatggtaggcactcaaggtggggggcacaagaggaagaggtcaccgtgaagacctagaattgggctgggaagatcagaccatgtacagagtaatgactgataagtatttctggcataactttcagatggaaaagagacagcgttagaagactccaagtgctaaaatttatactaaaaaccactgatcaatcaaacgttttttgatcactttccacatgcataattttggccttgacagagaactccgagatgttccctgcctgcaaagaaccttcagtctggttggggcattgagaaatagcctcatgacacagacagacaataggttctacagaccagggctacctggaaagcgacatttcagtagggcccatttgccagagtccaggctggggctgttacctcggtccctagggcatcctgagcctggcacaaattgggttgatggtctctgacccccagggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggtgagagaagaggatacatggggtctttttgtcccagccttgggcccttccccaggcagccccatctcagccaacattcagccagtgcatagaacataacagacaacccggcactccctcttatgggcaggctccaagacacagggactcaggccttcctaacttccctggaactggataaggcccaggaccctaccaccccctttgagagaatgcagcggacattagtcagaaatctgagcttgaaaatgcctagatctgaatatccaaactggttcaaccatttccctcctccaccccatgaaaaaaaatgcatttcttgtgctatcttgaagagtgttcttttagacaaaagtctaccgatgggttgctaatgagtcacttcccagctgtggtgttaaaaccatttgccatgttcattggcatgaagatggcactgcttcacccaaagttgcctaagttccataccagggtgtggcaaagcccctgtggggctggtgggagggcttgttctagaagcagtggtttacaagctggcgaaatgggtgggtgtggaggggcggctggtacagggcttggaaccctggagcaggatcccttttagggtctttaatggggtttgtcttgctttaatggggtttgtctttcccaactcctgagaatccccccagagtggtgggtgcagctggcatgtgcctctgtgtctcaacttgtgtttctccctgccagcctccggtagcagcctccaggaagcagagaggctggggagatgaaaagtgaggataattaagagttttatggggttgatgtgctactggtagcaacagcagccacaccccacctgcaccaggctgatgagcccacattgcttggggatgagcccacattgcttgggagtgagcctactgctgggggcagaacacagcttgggtggagagggagcttctggtgcccagcccggccacccccagctccacttctgatccagcatcaacagggcttcttcctgtcccacagaaagagactgggcatgcgggagcttctggctcttgttccgcaaagggccactagtagcagggtgtgagccttgggatgcagctgcggagggaccgttgccacatggagccattgccagttataaagttactgggcagagtgaaggaggagaagaactgagtgcaaatgagacctcatttcagcctcagccagggccaggcggaattggctaaatggtttctctttccttccgttttcatcttttcctctcttcattcctttcctccctttcctcttctccttccttccttctaccacaacttccaatctccaccccgtcgtctcctctctgccctcccctctcctgcctgttctctctcctgcctgtcccccaccacactctcttgtccccaccttccccgttctctcttccccctttctctgccctcttccaccctcttctctcccccaggaacctgagctcggccgatgcaggccgccagaccatgcgtaactactcagggctcattgattccctcatggcctatgtccagaactgtgtagcggccagccgctgtgacgacaaggtgagtgcatcccctggtggcaccctgacccctaggcccagccccctacattttctgggtgcctttgaggcctggcccagtgacaagacaggagcacagactcaggggtggtagaagaggcatctggatgcagggcccagtggtggctacaggagtgggctctggggacagcgtgcccatgcaaatccactctccctcacttagaagtggagtagatgcagctgcttccctaatctctctgtttcccggttcactcttcactctaatggaaagggtcataatcatatcaacctcaagggttgtctgaaaggcttgattagttaataagcaaaacacgaagagggcctggcacagaggaagctcccagcgagcatctgctggctgtgcttcattggtggtgctgaggcctgtcctgtgaccctgagccctgccccacagcccagaggaatccatactggtgcccccagggcttagtgtcccccctgagatgaggctccttctgccactgctatcttcccactgcctcccagaaaagccattggcagtcatcttgctgccctctctggacttctggacacacagcacagacaaacagaaagaaaaaaagttgtggagggcagataaacagaaggctgagatgttcccaccatggcaggacagtggctcaggagatagtgaggtccagcaggctccagatcgccagggaacgggctggcatcacagcacctgggttctcagcacagttgccgtaaggagggattttatctcctgctccctccactggaagcaacagcagggccacagaggagagccttgtcactgggctgctcagcctgcttccaaagggcaagatgcttttctgctctgtgtgcaatatctccaacacctgtgtaaccccaagccctggaagtcagattcccttagaccccagcaagggccaaacatcattaggagggtaaatctgctgcccccaaaccctagtcctttggaggtttgccaaaggagattgacaaagatctgagcccagctgccatgatgaagccctgggctccaggtgttgctgtgttttgtgtggacttagcaccgctgacattgacagctaaggactggccccaggaagaaagaatgatgggggcactagatggctttggaatctagaggcatggggcttcttctggaggagtttgttctggaaaaaaaaaaagacacattcttcaatatcccagtctgcccattggcatgttgtccatagcagtcctaccacacactaggccctgtgataagtgctttctctgtatcatcttccaaatagcctagtgaaatggacaattgtagtctcattttacatttgagatagctgaggcccagagaagtgaggccagtcaagttcatgcagccaggaaatgacagattcaaactcaggtcccagaggtggccctggaagacttcccaggctgagagtgtggtggtgcctgcgctcatctttcccgatgcagcccaggtgcctctgctctcttattagctagggtaggtggtaggccaggagcctgtcgggccgggcagaggctcaggcccatgcctctccttggtccccagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatggtgagcacagcatcagcagggcggggcctgccccatcaagcacccccccaggagccactgcctcatctgccctttcctctgggccctcctggagcctgaagccagccctaagggacaggcccatgctgacaccttggcctggggctcagggtgcactctgggagctgggtagaggccattcatcttgcacaagggggaatctgttcttggaactgtaggggctcagaccaccttagaggtcaaaaactccagccttctgtttgcaggccttggtctttcttcctgtataatgggtcaagtctcccccatcttctcccttgcccttgaggatctgaggaaagccagaactctcactctttctggccttggttcccaccatctcctgagccctgccaggtttccccagaagcagaagcctaccagggatgggttgtcaggtctccttcactgggcccagctgtggaatccaggtctcagaccaccctctttggcccagggtgggtcaaacctactgtctgagtatggaagaggaggaagcatcatgatgggagagcccaaagcagccccacatatctggaaggtttgggccaaggctgccctggaacacagctcccaagatgccaggatgctctcttctcccacatcctgggacagtctgggggaccatggcccattcctgcatcccatggagctgctgcagtgcatagaggaaaggggtgcagcggggctgtcctgggccccctgcctctgcaggcgcttcctcagcttgccctacctggaaccacgaccctgaggctggggggatggggacagaatgcctgggttgtgtcctctcacaaggctccccactgacccccctgaccggctctttatcctcagaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctggtgagtgggactgtaccttctctactgcagcagccccatcctccagccaccgtccagcctctgctccctccttttccccccagcctgtcccctgacttcggagcctcccatgagcagagtgtgcctggcatatgctgggctctgggctgggcaatggggaaacactcctgccctttaggagctgctgggggatgcagagagggtgggcccactgatgctggattctgtccatgcacacacaatccccttggccacatggctcccggtccccagctggcctcctgggctctgcttgaggtcggggaatgcggcggagaaggtgtttggcaaaaggagtttcccatttgttgaactgacaaaggtggaaaaagagggtttggggtccaagcaggtccagagaagatgtgacagaatccgtgcagatgttgaggccaaatgtatgtagcttggagggcacagtggtatggggcagagccagaggaaacctgttgcaatcaagaagagttgagatgggccaggcggccaactgttcttcagctttacttaggaaaagggaaccgagcagcagcagcactagagtagaccgagggcagagaacttccctggctgtgaggagagaggctgggcagttctgagaatgccaaacccacctagacctgttacacccaggatagctatgttgcttagaggcctgggcgaactggcctacctctaggggaccccagttctctctccatgtgggcccagaccctttcttagccctcttttctcaggcaagccctcaacaaatatgtgttggattctaaagaggtaggaaagttggaagaagatggccagatgtttaattgacaaatacccttgaccatatagtttcacatgggcagatagcgtggggagatgtaatgggggcagcgctgagacagtggggtgagagagcagcattggacgcttgggttactctggaagctaactctgggtcactatgagtaggggaaatgagacttccctctctccacccatctgggctgcaggctgatccaggagacaggatcagggctgggaaaggggaggtgcatgttagcctaggtttctgtagttgcccacatgtgagctagtgcttccaatatgaaagagaaagggttctgggatgtctgcctttggggctccttgcccctttctgcctgccatggtgcctgggaagccacaggctagctcatcatctactccttctctcttagatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatgggtaaggtccctctctctcctccccctctagctaagacatggcaggctccctacaattcaagcctgcttgaaggtcatcctttaagccattccctgggatgagcattccaagaaaggaagctggccaaagacaggtatggagacaggagaagggagcctgtcacctgagggctgggagcagatctgcaaaagtcctatctgggtctctgagccctgagttggagctgccaggaagccctgagggccacctggctcagagcctggcagaaggctatcgaagagtgtggccccagagggaacccctcagcccttccttccccagtcatcctgaccctgtgccccaactcgttcctctcccagggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcaggtgggcggggggttgctcccacgggctgcaccccaatcagagcccctcctcaccctgcacagcaggaagcagtcccgcagctctccatggagtaggggaagcaccaagggcagggggagccagggacgggggaggcttgaatggaggagaagttccagaagccgagagtgcgtggagagaagggtccagcatccaggccccagggctgcatggagggaagaggcaacacacttcctggctgggggactcgggggcacaaggtcctcagagggccagcaggaggcatggggcagcaggtccaactgaatagggactttatcctgctctgtggggctccctcttccccggacaaggctggggactggagtggaagagcactgccacctcatggcccctgaggagagtcctggggtgctctaggtgggcaggggcatggggttgtgcccactgggtagggtgaccaggctcaccacaccccaatggggctcctctcttttgcacacctgaggcctcctctgaggcctcccctgtgtccaggccctggcagtgggggtgggagggaagagggtgctccttctcacacctcctggaatctcatctcacaaatgcacttctcacctgcccagtgcctcacccaaggccgcagaagctgcccggcttctcctgtctgacatgtggtccagcaaggaactgcagggtgtcctcagacaggtaagagcccaggacatcatcctcttctgaggttcttcctgctcatgagcagagggcctggcatatgctgggctctgggctgggcactagagaaacgcccctgcccttcgggacagtctgagagacaaagacagcgtctacgtgaaaatgaatgtgatgaacgttctgatcaagtctctgggctctgagatctgcgagggatgctgagaacatggagggcagaggaaatcaaggaaatgtgtgagaggcctggggtgggatcctttaggagcaaactgaaaaacagagtggacaaaaagcacacaagtcttttgagggcatggggttcactccagctagaaaagtaggtgtgggctaggttacaaaacccttctaatgtcaaactgaagagcttggacttgtacctttggcactggggaaccattcaaagttttgaatagagggtttcatgatcaaagcagcaccaaagctcaccctgtgagcaaggcagagtgggctgagaagcctggaggctgctgtccttgtcctgtggtggccttggcctcctctctgtcctccacccctccccagctagccaggtacagagtcctctagggtataaggtcttgttgtatgacatcttcacatggcctcttctttcccattcctcagtgataagcatggacataaaggacaggaggtggaagaaatggagcagtggggctgattaggctggagcttttagcttggagactatggttatattcacaaagacacatcagatgaggagagcctgagaaggcttttaggtgggagtaagaggggtcccaatttggagaggttgagtttggaagacttggatgggagtccaggctggaggtggtgtgggccctggcagaggggccagagctaccatacagagtggagctttgttcaggcaggcgaagccatgagaacaggcaagaccaccatgggttgcatgtgtatggaaaagtcttgaaggacagggcagaaatatgaagaccatctgctggggacaagaaggaggaaaggccagggaaaagaggaactgtgcagggtgccagaaggggctgaagacctggtaagaagagaaagctctaaggaaggcagggcagcagttcccagggctacctagaggaccaggggatggacactggaaaaggccctggatccggtgcttcggaagtctctggagccgtccaggagcactgctggccaagcaaggggagccccatggggcctgctgcagtgggcaaggcagtggatggggatggatggggagttgctgagaggagatgctgctccctgcaatttagcctgcagaaaaaggagcaaaacagtgggtaaaaagagatctgtttaaagacagaggagactcaagcatctctgtcatgggaggagagggagtaggcaaagaagggagaaagacagggatggaggacagggaagcctggggattggttgagcagcgtggggcagaaggaagcccagctcttcctccagcatggcaggggacaatagggagactcatgaacgcacggtgtccaaagatgattggggaaatctgaaggtcacagcaaagggtggcccttgttctccatgtgacaatccagagctcctttccaacagcactgcattgaagatgggcttggcaaatggcaactgccagatagacaaagggagacgaggaggcaggtaaggaggactggtgtgagcttcctcccgctgtgtaatggtggtccaaagcattcagcttaccccaaaacacagagtccacccccggcctaagacacacagagaatccactgacatcgctctcggtgggaattcccttctacacatgcctttgggaaccagcgtccccattcagtctccactcctccttccagctatgcttgacaaccatcctgggcatgatctagttggtgcgtctgttcccaaagggccttcacatccatcatgcattgagttgtcacaagcacaggtgagacaggccacatggcttgtgtccattttgctgaatagggaatcagggtccaaggagtttgtcttgattcagtgagtcagggcatgagccatgctcgacaggaatgagcatgccaatctgcagaagaaaaatggcatcatgtaatacatgcccaaagacaggaggggcagggcttcgaaccggctgctgtttcggatcccctatgccatctcccctcctgttcccacaggtcggtgatggctggcttggctctcagagctcagggctggcagcaggaccctcttttcaagggcaccttggcctattgctgcattcaaatcatgctgtccacattcacttggaagcatgtattgggcacctgctgtatgctgggagaaataacaggaataagactcactctccatccagcaggcactcaggggctagtggggctggaggtgaagaacagacaagtaaacagaaccttctagcacagcggcttcttaccagtgcgagccccctgctcctgtgtttgagaaacaatgggcatgtcctctctgcccaagagctcttgtcagaattgtttaaaaaaagaaaagatagaggtggtcagagggaagaacaattgacagcttctctaatctgattttgattgttgctctgtttaaaaaataatactagcctaaatcctcacgccttgactcaggtttctgcaaatgcaagtaggaaattcaaatgtgtcagtggaagttcaaacacattgcaccgactcatggagagttattatgttttgttacacagttactgaggccagttttcgccctgacacatgtacttagtgataagagagaggctgtgtgagccgaggttgctctgggagggcagtggacagtgtctgaccccacagcaagccccacacagttttgtgtcatttggttgctgtttctccctttgcagcaaggtttcgataggaacatgctgggaaccttagctggggccaacagcctcaggaacttcacctcccgattctaagaagagactgtccaagcaagttaggcttgcaggtaagaatcaccccaccctcagggatgcctctgggaccactgcaacagcctcagccagtctcagagacaagggctaggcctgtgctcccagggacacagaagcatccttttgcctggctctggacaacacaagcagttgtgtagactgcttggctgggggcgtagtttgtcccaccctcaggacgttaggggtgtataatgtcctgggagtttcagaggggtcagagggtctgggcaggactgctaggtacaaatgtgtgggttgtacactgaacaacacaggtggtgcccttcacatggactacagtgagttctacaatatggataactggagttctagaatatgtcattctggacttggccatacacagctcacttttttatccttttataattcactttccactctctgcacatgcccagtgtggacaagtttatttccagctgatgattctaggcccccaaaactcagaaccaatcctatgacgaaggcttgccaacctcagtgttcattggaattatatgggttgcttgctaaaatgcacacacttggcccagccccagctattctgactcaatagccctggagtgggatccaggaaagtctatttttaaacaagcgtctaaagtgtttctgatgcgggtaaactgagaatcacaaatagagatactgcagccagatgtcatcacccctagagaggggcctcaggggcagcccagcatggagccatctgcaaatagcctgggatcaagacagggtctcctgagctaagggggacctcttaaccaggctgtctgccagcaccccccaccccaatccctggtggggagagaggattgtaactttggtctggatgaaggttaaataagacttcagatatcctctcctagtaaacaagctgcaacaacttgaaggcagaaaaggggaaagagattcggtttggcaaatccttaatgaacaccaccttctttcttagtgaggaagacggtgggcaggggacagtgtggcagggtggcagacaaagctgacaagcttctgaatccacagggcaatctataaatgtgtctagggcagccttgaatccagtctcaggccagggcacacttgagggccgacgtgagaagagggtggcagtacaggctgggcttgtggtgtggaaacatctcactgtaaacactaactggaggactttctccttttccaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggggcttatatgtgatgtcaatatttcttcctctgagaaatggtatatatatgtgtctaatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaagggtgcaggagtaactggggctgggccagcctccccccttacaaggctgctttccaggaagggaggtctggtgtatctcatgggagaatctggggtgtctgtagtgtcacccctccagcagcgccacaaggactgaggttgggtaggtgtgaggttccagaggacagcaggacactctcgcatactttgccaaatgaggcctgctcagaggagtaggagctgaaagatggtgccttccaccctcttgggctgtgtgcccatc

SEQ ID NO: 17479 - DNA, 14264 bp, Human
  misc_feature (1)...(14264): n = A,T,C or G
tcagagaggtgtgcactgcgtactacccatcatacatggccacacatgcctgtggctgtgagaaatactggtggtgacaaagacaatgagatgccagagaaaaagatcagtggggtttgcaaaagtgattaagatgtcgtcctaggtataattaaagacttaataaggttgaaggaaagagaggacattgcacataccgaggcccctgagagatctgcctggcaacccagaaagggacatatgggggaaaacgccttagtgtaaccaggtcagaattttcattctgggcagaactggaatttgaataataatactgagtcatatagagcatacagctatgacatttcatttatttctctatataatgcaataaagtagatggattaaccgtgacgtttacagatggagcaggggagaatgaagaggcgtcagtttgggcatcaggctggatcttcacactctgacctcactctgctctatcctgcccagtgttgcttcacctgatatcaggggtgcaaggcaaccagatctgacaccagtttcagtttagatcctgcctttacctgggtgtgacccgggtccatctcttcagctcggcctctgctttctcttcataaacttttggggttagtcctcggatgatctctaaaacatggcccaggtgctccttgccagtagagtgtagccggatttggagggactggacactcagtgtgaacaagacgaaggcctcaggaggcagtaaaagctgacaagaggagagaaaatgaagcgcctacgggtgcatactggactagcgggcgaaaggccatgactccttagtttggagaaagaactggggccgagattggggaagtttcccagtgcaattaaaaaaaaaaaaaaaaaagaactagaagaattacccaggtctggcttctttcgtgtagcctggggctgagtcgcaggctgagaaatccagtctggccagtagggggctccaccaagcgcagtctcagaatgcccaagagctccaccgtcgcccggggtctccaccaagcgcagtctcagaatgcccaagagccccaccgtcgcccggggtctccaagaggagtgggtcgtggtgggcgttgaagggccgtaaaagacgagcagcccgcgtccgcgtccgtcctcccgggtctccagtccgcaggcggccgccgcctcggccccgccctcccacctccattcccggccccgcggacccgaacggtccctctcgcaaccgatctgctggctggggcgctggggatgcgaattcctagaagccttaagaggctgcccagcgttggaagttcgtatccccaagaatgctggaggttccggctcacacaccccctccgggcacagagtcagctggggggtgctgggagggagaacgccccgctcctcaccccccatccccgtgcaccctggagcccagctccatacgttcggccaccccaggcggactcggggtggccgggtagcgggtggtggcaggaggggaccgggtaacggcaggcccgagaggaggtcgctgggccgggccggaggcgcacaggggctgcgtggctacctcggcggcacccgccccacctccgccggctaagcccggagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaaggtatgcggcggggcttggggaatgtaccccggcaggagccggggtggggggcagtggtttcgggaatttggggatgtctggaaaggttgttgccgagggggctgggcgcagccaccctgtcccgagcagatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctggtactcccagggcgccctgcgcccctcctttgcttccccacacgctctgggacccctgagagagttcttgggttaggggttagagcggttaactgaggggagcttgggtgaggggtagagggaccccggccgacgtctttctccttcctaccccagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtaagggaccggagagtaggaaaagcaaggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgagggatggtgataggacaaggcttggtaccagggcactggggcggggctgggtcaggagccagagcataagcataaggtgattggagagtcagggtggacacgggggttgcggggtggcgggataggaattttcatcctctggggttagcctggtggaacaatggtaggaaaatgctcctctggaggagaggcctggctgggtgtggggctgggtggggcctggctgggacggcgcagagagcatgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttgggttctgtatctagtacaggaatgctcaaaatagaaaagctgtaattacaaaatggttcttgccttctagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgtgagtcacaggcactcagaccagggagtcaactcggggagtcaaattaggaaaggcttcgaaggatgggcaggacgtaagaataccagagaggagagggatgtttggagaacagaaagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgagtgggagagaacaccgtggcaggtgtgtgggaggctcccttgctttgggagagtgactggtgaggcaggaaattccctttgatgagggccagtcatggtgtctcactcttaggcccttctggtgagcttcctccacctggagatgcagggcagagaagtctgcttccttgctgcccaacctggcttatgcgtgcgcacaccggggatgaaagccctggctaactcggctggccctttctgccccttccaggcagtacgccccgaggtgctccgtctgctctgagcccatcatgcctgagcctggccgagatgagactgtgcgagtggtcgccctggacaagaacttccacatgaagtgttacaagtgtgaggtcagccatccctctggactccttgggcaggttctgaccaggaggtggcgggagatgctgcttactaactgggaggtggaaagcaccagcattcaggaaacagggctgtgattttgagggtggctcatggtggcaccccatctgtcctgccagaatgcttcctgccactgcaggaaatggggctgtggggcttctgaggtcactttgagtcatggataagccaagaaatgggacaagccaataggagagaagaagggcatggtgttttaccgtggtaggggatggggaaacaggagctgagagaagaggtcttcgaatggaggtgagccaacctctattttattagggtggtggtgggcaggggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaattctcagtagtcagctcttttgtagtgcctgcagccctcatgggtgggatggaggcagaaaatcagttcctgtttatttacaaaaatatatatatgtgtatgtatgtatatatattaacccctcagctccctcccatgatcatccttttacttctacccccacctcccttttaaaacaaagaggttttctggggtgcagagcagggttctcctgaaagtgggcagaagcagcaccgatagcctagtctggcaggttgtgggaaggggcgcagggagtgaccatgagcgaccttggccccgtccttgctccttgcaccctgattgggcatggggtgagaggagggatcagtccttgaatccctgaatactgcaaagaatgcgcttctggtgcccgggcagtgtgattcccatctgcgtcaggtccctgtgggcaaggaagggtgggggcatgagtccggaggctccacccccgcagccctcccctgcccagacagctccagctccttactcagcggtcagctccagcacacactccatggtgtccagcccagccgagtggaagtgcaggatgtagcgtttcatgcgtatggactcgagccactcagagacggttcgatacgggatcccatctgagccactcaggctgggcaggcgaagagtcaccctgtgggacatgggcatgtcagtcacagcgggtacatgggctgatctggttggccttggcctctgagcatcagcagccagcactgaagttcggtgtctgggcacagagatcatctagactgtggattgaccccaccattatctctgagcccacttcctggcctgtttcctggtgtgctcacaacagtggactggctgacagtcctgctatgtcgacaggcctataggaagggactgtcctgggaagccccaacagaaggggatcaccagccggtctcctgctggagtggccggttctgggcacctgactgagggctggttaagacatggaagtctcctgtctgagaggaagctgaaagtaggagaacagaggcctggcacctgggcgtggtcctgcctttttccatagtggctgcttgagttccgggagcagtccttcctcaccaccttcagcttcggctgttattcttgcactctgacacccacaatacaatgagtgttcctgtactaaagctcgccagagccaaaaaccattagcaaagtaaatctgctgggggaaaaaatatccagcattccagaaagattagcacacgcagtctccagtgtatgagggagttgcgctccaaaagatagtttcaaaagttggaacttagagcatgttttctcccagaaacaaggttatatatggtggttggatacagaggccagttggccaggctggctacccaataaagcacttgaagaacagccttgcctgcttccccaacctgagcgctcccccacccccccatcagttcattctctacactcaggccatatttttggtaaaatgcagctctgaccatgtccccccatcctgtggacagcttttaagaattggttctccaggccaggcgaggtggcccacgcctgtaatcccagcactttgggaggccgaggtgggcggatcatgaggtcaggagttcgagaccagcttggccaacatggtgaaaccccgtttctactaaaaatacaaaaattagccgggcatggtggtatgtgcctgtaatcccagctactcaggaggccgagacaggagaatcacttgaaccctggaggtggaggctgcagtgagctgagattgcgctgcgttactccagcctgggcgacagagcaagactccgtctcggggtggaaaaaaaaacaacaactctgcactcatggtaaaatccaaacttctcaacagggctggtcctctttgtgttgactggttgtctctccagcctcatggctgctattcctaaacacaatgccgcagccatcctgcactatctgcaacctaccagccctcagctccccacaga

SEQ ID NO: 17480 - DNA, 14967 bp, Human
  misc_feature (1)...(14967): n = A,T,C or G
ggtctcaaattcctgacctcaggagacctgcccgcctcggcctcccaaagtgctgggattacaggcatcagttactgcgcctggcctcaaaatacttcagagcaatggctctggactgtcagggctggaaaggaccctcctctcacatgctgagctccttggagtggaggccaaagtcccacagcagaggccgactggcccacccagcatgcccatctcccaggagtgcagagaggcaagccctgggcagtggcaggcacaggccttcttgaccccagaccttcagcctgtcatattttggctcctccttagtgaaggttgttgagggtgttttgcagagagacatgacgccaatcttaatttttgacaattttccatagcatgcagataatttgtttccaaaacttttcattttcctgaagtcatcttgattggtatcagctatttccataaaacgatcggatgagttttgatggacagatcaggcttttgtttacaactgttttgctcctaatcattccaccacatcacatgtcatggacctgaattgcgtcaagaagacgggcttgtctgtcaggccctggtgggcactttgatagcgggcatgctgtgccatgacacgtgtggtgttgggtcttgctggacaagctgtgctgtgttcagtgtgcggagcctctgctagatgctctcatttggggcactgggccagtgctactgggagcacttctgttttgtgtcactgacatccaatagcatcgttatgtagagcaaacaccgaagggctgcatttctttgtgggcttattctcgagaaaactgggggcagatccctcctcaaggaggggagggccaccttggtttccagtcaagtattgtgaaaattatccaacactcaggcaatccacccaaccctgctgcccatgtctggagaagcaaagtgtcaggggtagtccaggcccacctggagacaggtcaggccctgcagagaaaggtctgacagacgggggtgagggaagaccccccaaaggcctccagagtcccaccaggtctccaggtccttgtcataaccagagaggccccagccccagaggaccaggtcccctgctccactgtccacaggggcccacctgcaagcacactggcagagctcaagaccacacatgcctgcaaggtgaggcctgtctgggctctgtcctcctgcaggccccaggcctgggtggctgggcgaaggcagctgcttatgcagactccagggggaaagccgcctctcatctctggccgtccccaggacgctggatccaccaatatctcaccaacctggagagccactcaacccctcatttcacatgtttgaacatagaggaccagaggggtgtggcctgtctaggaggtcttaggagctcgggtcctgactctgccacttaccagctcttgtctgtcccatgtgcctccgcttcccctcgggacacagagatattgtgaaagttaaacaacataatccccgtaaaacacttcgagcagtgcctggtatctggccagcaagtgatcaatggtgatccattaccatcctgggaccccatcagagccttctgaggtggagggaagggcgtgctggggagcacaggtgcaggtcacaagaaggaagtcagtcccataagccaggtatctaaccccatccctgctcccccaaggtaagggccagcatctaaccccacccctgctcccccaaggtaagggccagcatctaaccccatccctgctcccccaaggtaagggggccagcatctaaccccatccctgctcccccaaggtaagagccagcaacggaggcctgggaggctcctgggttctgggccgcagcgcctctgcgaggtctgcaggcttcgctctaggaggggatgggggctgggcaggtccctgctccagaggaggaggacctgggcctgcggagcgccgcggtgggagtgctggagtcctggcccgtcatccccgtctgccccacagcgaggacgatgctgccactgtataccgcgcagccgcgatgctgaacatgacgggctccgggtacgtgtggctggtcggcgagcgcgagatctcggggaacgccctgcgctacgccccagacggtgagtgctgggccttggcggggtccccgaacggggaggaccccacgggctctgagtcgcatgctcgcctaggcatcctcgggctgcagctcatcaacggcaagaacgagtcggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggtgggcggggcctccccggagctgggcggggctgctcttggggaggtgggcggggtcactccagagatgggcggggccgctcttggggaggtgggcggggccactctccagagctgggcggagcagctctcaggactaggcggggccgctcttagggagctgggggagcgctcctcaagagatgggtgggggcactctcggggaggtgggcggggtcgcttccaggaggtgggcggcgtcgctctcaggggtactgcagtggagcctgctgccaacatcctctggacactgttacttctctcctctccccccacacccccagcaccaccacatctaatggcacaatcatctgccctcttctcaacactgacaccagtacctgggccgtcactggagtggggactggctccactgcctccgcccctactttccacactgcagcccaccctgaaacagcacccctctccctgtgtggctggcagcctttgggaggaggctcttgatgcagatggggactgaaagcttccagggacccaggaggccagacaagcagcccaagaacagcacacgagccttagacagccagggttggccaaggcccagagacccaagtgaacatctgcagtgtggcaggagttagctcacagcacgcctggacaccatgccatgccagctcacccccagatccccaaccactgagtagcacgtgcagagccaccatccacaacgcccacataagtgcagatgtaggcagcacgtgtgcacacacacgacacacatacacagaaccatgtgtgcacacagactcaggcacatgacacacatgtgacacaagcacatgcatggggtgcaccccacatagggatcacgtgtgcacacaggttcactgatgtggcccgatgggtacaatgcacacgtgcacacacagccggacaggacagcctggtggttagagctggctcaacctcgccttcacttgctggcaagagggcaggcatccttctgagcttctgcctccgtctctgtaaggcaggatggttctgaggacaacgtcctaacccacagaaagccgggtctggcacccataaaccactcagctgtcatgaaccacaccgtccatctggtgcaggcagataccacggtgtccagggtctggcgtctgctgatctttccgttcttgggactgggacaagggaaaagcccaagctgctcagccggcaggagaaggagcagggagaaggagcagggggaaggagcagggagaagcagcagggggaaggagcagggaggagcaggagaaggagcatctctgagaagcctcagctatgcttccttccctagagtgctgatgtcttccaagtatgcggatggggtgactggtcgcgtggagttcaatgaggatggggaccggaagttcgccaactacagcatcatgaacctgcagaaccgcaagctggtgcaagtgggcatctacaatggcacccacgtaggtgggggtcatgagggggtgggggctggggccttagggtcctggggccaagacccctgcgtggccaccctccatctcatactcccacccccaggtcatccctaatgacaggaagatcatctggccaggcggagagacagagaagcctcgagggtaccagatgtccaccagactgaaggtgggggccccacagacctccctcagtgtccccaccccagacagcccatccaccccctctggcctgaaggaggagggtgcggtgaggtcaatgaaagccactaaaggaagtgggggtggggcctgcttcccctggacaccgtccagcacacctggcacagcacaggaagcagagagaacaggagggaggagaggaagctgcccccatcccacagggggtctccagtgcccctcttgacccagccctacttaagtctggggcagttagttgtctgacaggaccctgctggggaagagcagatgggggacagcaggcagacctcagcttcagcactcgctgtccccagtcctggtcctccacacccctcatccctcctccagcctgcattgctcttgatgggaccgggtcaaactgtcctcttccaccgtgtgggacagcccttcctgactcccctgggcctctgagagcctctgccctcgccggcttcctcctccagaacatctttcccttggctccctactccagggtgctctcctggccattcctccccgggcagagccacactacccccactccacacacactccagtcctggtagcatcacagaccaccaaaggcaaggacctcacaggcgacacgcccaccaaccttctctcggtcattccaagccctcaaatgtctcttgaccctgtctgttttctgagcccacccctgaagcttggtgtcagcccctgtgacctctcacccaggctccctcccctgctctgcaccggcccctgtggcctctcacccaagctcccttccctgctctgcagacagggtggggttttccagtgccagtgtgggtttcattgcagcccagacacctcacactgaaaagtctgaaagcagcggtcaaacgctaatggccaaaaggccccatctaggctgtgagatggagatggctttttacaaatttgtttctggcctcactaattttttaaaaatactagcatatatattacctgtataacaggaaaatgtaatgaaagttttataaagcaaatcaacttcttcaatggctcctgattcccctggggataaaagacaaaatgctgcctggaggctgagggtgggcgggcctgcccccctctcaggctcaccctgcctaggacatgccgggagggtgcctctcccaccacccccacgcctccctgcctttgcagttctggactgcagactcctctgctccacctgccctcaggcacctgcttgatccctgcccaccttgagggctcagctctgacaccatctcccctcacagttctggcagtgtgctatgctctattccagccccctgtgccccagatcccttccccacccccatgccatggtcccttgaaggacagacaggagggcgagcccaagcaggagtgtgggtcgaagaggccacggcgcggtggagcacgtacacacgggcaagagaaaggagccagagacctacattcaaagcctgagggcttcgggactgggggccgggacaggcagtgcgccgggatgaagggaggcacgggtgggtggccccacgggtcccaggtcctgtgcaggtgcagggtcggctttgtggacatgcccctgtcctcgtggcacagcagggtgggggtcagcctgcaggctgggctgtttctcaccccaggaagatgcctggcatacacgggacatcagcggctcctctgctggagggaatcatgtctttttttttttgagacagagtctcgctctgtcgcccaggctggagtgcagtggcgcggtctccgctcactgcaagctccgcctcccgggttcacgccattctcctgcctcagcctcctgagtagctgggactacaggtgcccaccaccacgcccggctaatttttttgtattttcagtagagacggggtttcaccgtgttagccaggatggtctcgatctcctgacctcgtgatccggccgcctcggcctcccaaagtgctgggattacaggcgtgagccacagcacctggcggggaatcatgtctaagccaagactggagaaaaagtggccaagagaagggtccagctctccaggagtcttttctgagcccccagcccccacccccccggggctgcaggcagacgatgctgacggtggctggggaggacgtgtcctgaacacttgggctcgtgaagaagctccagagaggggcagtggccggcggcgcagggcggggggtgtgaggggtgcgtcggggattaagaggggcgccaggggaggctgggagctgagaagagactgccgccctgggcagccttaggtcggtggtccaggctgggtctccccttcccccccagattgtgacgatccaccaggagcccttcgtgtacgtcaagcccacgctgagtgatgggacatgcaaggaggagttcacagtcaacggcgacccagtcaagaaggtgatctgcaccgggcccaacgacacgtcgccgggcagccgtgagtgcgcggggcagggcgcggggcgcggggcagggcgcggggcgtggggcggtctggagcccagcagttaccgcccgcacctacccagcccgccacacggtgcctcagtgttgctacggcttttgcatcgacctgctcatcaagctggcacggaccatgaacttcacctacgaggtgcacctggtggcagatggcaagttcggcacacaggagcgggtaggctagacggcgggggtggggaccagcgtgagaggggcctgcaggcgcggtcggagtgggtggggcatggagtaggcggggcttgcagatggtggggggtcctggggtgagtggggcatggagtgagcggagcctgcgggctgggtcctggcgtggataaagcatggggtgggcggggcctgagggctgggtggggcccgacatgggaggggcctgacgtgggggtcggagtgggtggggcacggagtgggcagggcctgcaggcgggggtctggagtgggcggggcctgctggctgtggtggggcccgcccggcgtgggaggggtctgcgagccagggcggggctggagtggggtggggcctgcgagctgggtagggtcttggggagaagacccccggagtgctctagggcggcttcagtcgggggtacctgtggcgggagctgggaggacgctgcctgcatgcccgccggctctgtcgcctcgcaggtgaacaacagcaacaagaaggagtggaatgggatgatgggcgagctgctcagcgggcaggcagacatgatcgtggcgccgctaaccataaacaacgagcgcgcgcagtacatcgagttttccaagcccttcaagtaccagggcctgactattctggtcaagaaggtgggcaggggccgggtggcggggtggcggcggggggagtccctggagggcccgggccgcgctgacctcgcgtccctccgcaggagattccccggagcacgctggactcgttcatgcagccgttccagagcacactgtggctgctggtggggctgtcggtgcacgtggtggccgtgatgctgtacctgctggaccgcttcaggtgagcgcgacccggggctcagacacctccatctgcggggcgcggagccggccaggggcggggcagggccgcctctcccgccctctctcccgcccgccctctgcgccccgcagccccttcggccggttcaaggtgaacagcgaggaggaggaggaggacgcactgaccctgtcctcggccatgtggttctcctggggcgtcctgctcaactccggcatcggggaaggtaaggccccgcccggcccgcctggtcccgcctcggccctctagggtctgacagagccccccgcccgcccacaggcgcccccagaagcttctcagcgcgcatcctgggcatggtgtgggccggctttgccatgatcatcgtggcctcctacaccgccaacctggcggccttcctggtgctggaccggccggaggagcgcatcacgggcatcaacgaccctcgggtgaggcctggccgggctgggggagggaatgcgaggtgagctggggtcggcctcggttaggggcctggggagccgccgccgcgatccctgccctccgaccctgcagctgaggaacccctcggacaagtttatctacgccacggtgaagcagagctccgtggatatctacttccggcgccaggtggagctgagcaccatgtaccggcatatggagaagcacaactacgagagtgcggcggaggccatccaggccgtgagagacaagtgaggcgcgggcggccaccctggcggggcgggacaggtgcggggagggggagggtggcctccaccgggcaggagagcgtccgggccgggcaccccggagggcgcgggcgtggggcttccaggctggcaggaccaaggcccccgtgactccgcctctgccggcagcaagctgcatgccttcatctgggactcggcggtgctggagttcgaggcctcgcagaagtgcgacctggtgacgactggagagctgtttttccgctcgggcttcggcataggcatgcgcaaagacagcccctggaagcagaacgtctccctgtccatcctcaagtgagtgtccgtgcgcccgcgtccctcctccgcccctctccgccagaggtggacgccctccccagtgccagaccactccgaggccaccactgatttcccacccaggccgggcgctgcccactccacgccgcaccctaccccgcaggccccgccccggccccgcccccagcttgctccttcccgtcctgggccccgcctcactgcaggctcacttgttcccaccgccaggtcccacgagaatggcttcatggaagacctggacaagacgtgggttcggtatcaggaatgtgactcgcgcagcaacgcccctgcgacccttacttttgagaacatggccggtgcgttctccttcatccattctcgggtgggttctccgtgggctgcggcctccctggccagcaactgaggctctgggtcccggcacacaggggtcttcatgctggtagctgggggcatcgtggccgggatcttcctgattttcatcgagattgcctacaagcggcacaaggatgctcgccggaagcagatgcagctggcctttgccgccgttaacgtgtggcggaagaacctgcaggtagggcaggccaccctccgaggcctggtgcccagggcccggcctggccacggccctcctccatccccgaaggccgtggcactggctctggctctggtgggcaggactggagctaggagccatggccaggggcagtggtgagtgctcccagggcacgggggcagcaccggtggggggctgcctgcaggtggctgcccactgcaaagccggggccgagggaggccacgcaccctgctccaagcctccgcctggcccctctgtctccagagtcgcccgccggtacccattccataggaaggcaatcaggcagggtaagacaggggcccgcctgtgtatggcacgtgagtccaagatgcattttgccctccgccgacccaagccccttgacacccttcggagacccccccctttcctgctatgtccttgtgctccgtgactctaatccgaattgggccaggtccggtcctgcctggtgcccaggttgtatccatgagaatttgccaccagcaagggcagccacggcccacctgggacagggtgggcagtgggcctgtacaggcctaagggctcgtggcccgcggtcgagttccggttcactccgtctcttctctttctctgggtgccgtcctggagcctgtgtcctgagatgaagccgacagtgcggccagggctgctgggggatgggggttgctggaggctccacacctctcatccgcccgctcttgctcttggcccccacaggtcccctggggacctggccgctgccagcactggcgggcacaggccacctggccatcagacctgaggccagagtcccgggagctgcctctgtcactccaattccacctcgacacctgcctccagccctcggccccttcctgaatcttggtgtgtgccccttgggggtcagtggcctccacgcagacagctggtgtggcctgaggggcaactcctccagtcctcagaggactcctcctcctcgggacgcctgtaagccagggccacccaggagccagggagccaggcggacctcccaggaagagccagccgagagcccccaagcccagccccagcacgagcaaggtcaggcccgagaccccgggcaggagaagaggccaccctcgaacgtccgctgtcggcccgtctgtccagcacagggaggcaggcaggagcgagggcccaagtggccggccaggctgggcagcggcccatgcaggagcaggcgagggcaggtgtggccaccaccctagccatctaatcacttatacatattcattttaggatagaaagagtggtagagcagagcctgaccctaaaaagaaagccacatttagggctatcacctccaccctggcttccagcttcaagaggcgtaggtcctccaaagacacggtaagggggagagcaccccagtcccgcgtccgactccacctgccctgccctgcgtgtgtctcccgccccatcaccccgccccggaccctgggctcctgtggcccactctgcccctgtctccctgtggcggccgctctgcccagcccgcccatgctgctctctctcactctctggacctttctccccggccctcctgggtcctcggctttccccgtgtgtctccgttagtctgcccgcccacctcccctgccatgacccacacgccatcttgaagcctgtcatctcgttggtcagtcagtcagccacaccacctctcggggccaggtctggggccctgggagcccagcgtggccccatcctggactcctcagctgccgggaggccacaccacttctctgttatgtccccgtttctctcgcctctcccagaggggcccgccgccctcacttcgcccctgcgacggccctggagggggtggctgtgatgtcccatcccgtccgtctgtctggccactggccccgccccccagacacctgtctcacctgtctcaccagagccatgcgtgttgcatcttcatgtggtctctgtgtgggccgggggctgggggccgggcctgggtccgtctgggtggacggctggggcctggagttggaactggccccggccacaggggactgtcaggcagggagtggggtgggaccaaaaggggtggctcccaccccaggctgagcgggggccctgcaggaggtgtggcggcagctcccagagggtctgagaatgggtaggggcggccccacaagccctggcctgcagagcccaggacgacactgaggttcccagacagggaggcctctggaagggaaacgaccacctcagctcctgaccccagcaaccccacaaggcccaccccaaagagccaggccttctgccctttggagcccagaatcccccacctcctgctcggggcagcttgtccctgtagcggatatgcacactcggaccagaggcccccagagcgaacccagccttgctagaggcaccccaggcccaggcaccatggtggggaggggctgcccagagaggcagcggagacctcagccccgtggccaccctgcagtccagggaccagtctggcccacaggaagcccccagcccataagcagcatcaccagagagaagcttacgcccgggggaggaagtgcgatttgcagccacctgcccctcagtgcactggaagcggggcagacctccagggcacagacaggacttggcatcaagcaagccaaatcccgagatgaagccaccagggtgccccaagagggacccatgaggcctggctgctcagcttcctggggaagggacttggcatgcaggatgggtggacagtgagagcctgtaggcctgggggccactggaggctcaaggagcaggtggaagcaccattcctggagccacctctgctgcggaaagcgggcagagctgatgctgcaaagtctgagccaggagtcccgcagggaacagggagggggaatagcgcagggatcgtgggctgggcaggctggggaagagggggtgtccaggcagacaggagaaacagcgatttggggcaggcagccacggggggcaagcacaaatgtcgtgcaggtgatgggccactttcagagggtgacactgggtcccagggccctgcctggagcgaggccaggtgcagctcagagaccctcatggtgccctcccagggacatgttcccagcggaaccctcacccgagcctctctgggcaccagggaccgtcctctggggccagttctggcatcacgtggcatctggggctggccccgccctgcaaggctgaactgtggggggcactgccagctgggggtctgggcaggggagggcagcccagctcccacctggtctctggggctgcgagcttattcagagggaggcgtgggtggggggctcctttgggtagggtggggtcagtccggctgcggagatcccctgcccctgtcctgtggccggtccgggccagggcggcactgggcgctgagggctggggtccctggcggccggcggggccagcgggtattgattgttggttcttatttatagagcaccgggggtggacgcggcgctttgcaaaaccaaaaagacacagtgctgccgcgacgcgctattgagagggaggagggccagctgcagctgtgttcccgtcatagggagagctgagactccccgcccgccctcctctgccccctcccccgcagacagacagacagacggacgggacagcggcccggcccacgcagagccccggagcaccacggggtcgggggaggagcacccccagcctcccccaggctgcgcctgcccgcccgccggttggccggctggccggtccaccccgtcccggccccgcgcgtgcccccagcgtggggctaacgggcgccttgtctgtgtatttctattttgcagcagtaccatcccactgatatcacgggcccgctcaacctctcagatccctcggtcagcaccgtggtgtgaggcccccggaggcgcccacctgcccagttagcccggccaaggacactgatgggtcctgctgctcgggaaggcctgagggaagcccacccgccccagagactgcccaccctgggcctcccgtccgtccgcccgcccaccccgctgcctggcgggcagcccctgctggaccaaggtgcggaccggagcggctgaggacggggcagagctgagtcggctgggcagggccgcagggcgctccggcagaggcagggccctggggtctctgagcagtggggagcgggggctaactggccccaggcggaggggcttggagcagagacggcagccccatccttcccgcagcaccagcctgagccacagtggggcccatggccccagctggctgggtcgcccctcctcgggcgcctgcgctcctctgcagcctgagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17481 - DNA, 14967 bp, Human; identical to SEQ ID NO: 17480
  misc_feature (1)...(14967): n = A,T,C or G

SEQ ID NO: 17482 - DNA, 76962 bp, Human
  misc_feature (1)...(76962): n = A,T,C or G
cgggtacgatgggcacgatagagacctaggagctccgtgggtgaagcgaggggcagggcctgggactgctccgggcgtcctgcgtcccctccggggtgcagaggggctccccaggacggtcatccctgggtctggctcccgctcggcctcaggtggctctgctccgtccttccttgccgcaggcgcagtccagtctctgcgagtccccgggatgcgagcccgactttgagccctcggttaccatgccactgctctccaccagatggcctcagatactagcgacttctttgggagcacgcttactcctcgagaaaggaacccagaggaagggatgggaggccagattgctgctggcgctcagcccagaccgaacctacagactcagcagaggcgacctgtgtgccccggtggcgttctctggcttcctgggttgggagggggggttactccctccccgcatcccccccatgaggtcgtctagttttgtcccaggttgggtggggactgtggtttttttccctcagactgtaagccttgggggaggggggcgtgcatataggtacataggcactgcgtcggcaccaaagagctaaataaaaggattgttgaattttctcattcctagatcattgtctaccctcacccttcctggtgcccctttcttattctcactcccagcccagagtacttgctgggaggatatgtggggttcgctgttagctcagcacatttaagattcagtgttgttagctcaggcgttcaatgaatttttttttttttttttttttttttgagacaggttttgctctgttgcccagactggagtgcagtgattcaatccctgctcactgcaacctccttctcctgggtttgagcaattctcctgcctcagcctccagagtagctgggattataggtgcacaccaccacgcccgctaatctttggtatttttagtagaatgcgggtttcaccatgttggccatgctggtctcgaattcctcacctcaagttatctacctaccttggtttcccaaagtgctgggattaccgtggctatcctcaatgaacttttctttttgagacaaggtctcactctgtctcactctgtcatccaggctggagtgcagtggccagatcttggctcattgcagcctcaacctcccaggctcaactgatcctcccaccttggcccccctagtagctgggactacaaacacacaccaccataccctgctaatttttgtattttttgtagagacagagtttcactacgttgccccgactggtcttgaagtcctgagctcaagccattctcccacctcagcctcccaaagtgttgggattacaggcgtgagccaccatgcctggcctcagtgaacatttacagggagcatagtacatagggggactgtgcagagaaggggccagagtcccagagataatgcacacaacctttacacctgtagggatgggaggagatggggaagaaagatacacagcagatgctccacagtgaggcaggtgctatgccagaggtgtgcacactcagggttgttctgggagccttctagcccactggagaggggtttactgtttctctgacatgggattgcttgtgggggtgggttgagggtatgcttggggagttttggctgatggtgcagatactgagatgggtaggggctgctgtggagctgtcctgacttaggctgcccagtgccttctccagacaatgtcatggggctgaggaggggtaagcctaattttggcatgagggggccactctgcagtttgaggttccatatccaaggctacctattcctgacctctgttgccccaggcttgaaaccttccatcctgtctccctctcccactgcccctgccccatcccaggcctgtgtgtaagttcttcccccgacccaccccaccctcctcaggggacagattgggaagtcactggctgggctgggtggaatgacagctgcctggcctcagaagctcaggcccggcagcggggagccgagtggaggctaattttacttgctgggagcgaggagagtaatcctcctgcccccactcctgcccccgccccctggctggctcagcagggcaggctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggccttgttctgcctgaccctggagaaccccctgaggaaggcctgcatcagcattgtagaatggaagtatccttcagggcccgggccgtggggggggggtgtgcgtcatgagggagggattcggggtgatcacagagcacaaacttcctacaggagggccagggaggcctggcacttagacatggggtgaactcacagaattgagtgaggagctgggggaaggagccctcggctaagcaggagaggaggaggaggaagaggaggaagacaggaggtggggagaaggnnnnnnnnnnnnnnnnnnnnaagagaaggaggacttggtggggcttcctgggcctgagtgggccacccaagtcctggatgacaaccagagatgcctactgaccacctatgggtggggcctgtttcatggggactgttcccatgtgtgcccaaatccacattatcatggggtgccactaggtttttgaagcaccagcctcattttagaataggatagggaccaaaaaagatgcgatggcctctttgagaaaactctcccttgtttgggttgggtggggggtgacagtggacagaggtgagctgaaggaaggcttcctctgggggcaggtcccagctgaggacagagccaaggggagaaatggatctgaaagacacctggtctcagtggctccaagacacaggccaaacaagcctggttgttctagctcagacgtgccaccctggggacagggactttgaaactcatgctatgtttgcatttgctctggtggggagaatgatgaaaatatctgggttatttggggaagggaggaaggagtgacagagagaaggggagggctgtgtcaagtgggttctgagagcgagggtggggcatatttgaaatatttctgaagagttctggaaggctgggctcctaccagctgttccctagaaggaaggagaatgagggataactggaaggacaagagaaacgtggggcaagtagagatagtttggggtcagggtcagccctgttcccctgacccgctctcggccaggcggtatatcgcccacatcaaaccctcctaggccctccctccttgcctctcttctgcaatcaggtttactctgtgggttctccctctcctccatcctctgctcctctgcgccctgcccctgtggccctcctcttttctcaaacactggaggttactgggaagagaatgggatttttctgtcaagcccaactacgtaatatgcctccccatccacccccaaacaactccctcgcttcctcccttgctttctctagctctttccagacttgctgcctaatgggccagaaagtcgagaaagccatgggcctggggtaccctctggaaatggctgtggcggggtgggtgtgtctgggaggggtgaggtgtgatgggtgtgagcacgtgcacaccagcatgtgcacatggctctggaaattcagcattcatctctccatctctccttcccagtcctactcagtgagttctcaaccttaccctgcatcaacccttaccctcccatgccatttatctgggtaagcctctgtggattggccagaatctgccaaagtcatggctccttgggagcaggcaagggcatggacaggcgctgagagtggagcggtgtgaagaccccctaggccttaaagctgaggagccctcagccagggaccagacctttgccattccaaggagtctacatgaaagtgacttgttcctgaggagagggagccagaggtcaaggcaggaacctggtcctcactgtaccctgcaggggctcagggaaggagcagcgtgggcgagcgtccatgagcctgtccagcagcctggcatcagagtcacagtccagactgaccctcagcgccctcttccccttaaccctgtaagtcccttgcctcactcgagggctctccttaaccctggctccaggcccttcgagacgatcatcttgctcaccatctttgccaattgtgtggccctggccgtgtacctgcccatgccggaagatgacaacaactctctgaacctcggcctggtaagattggcccttccatctcccttcctgcgagcctgcagccccaggcttggggaggcccccttggtggactctgttctgggggatggtgccggtggttcaactccctgacgatgcaggccctgcatccccagccacctgcagggctggctgagtggctcaatgggtttccagggtcaacctgcttattccagattctgatactgtcagccagcactaagcacgcactcattggtcccaggcactgtgctaatacctgatgagagtaaattcatttaatcctcacaaccaactcataaagtggttccatttgacagatgtggaaactgaggcttagtaaggtcagctagtgagccacagaggttgaatgctaatttctcttccccaaatgtaattcataagaaacttgtgtccactaagtttgccttcatgggagagttttatccaggaatctgaagcaaggacatgttttagagttttataataccactatctcttcaccccttcatcagtaacacatacctggaaccataaaatgccagggctggaaggaatattcaaaaattaagctgtcctacctcctccccacctcattctgttttatggatgagaaaactgagacctagagaggttcagggacttacttactcaatagctaattaataataaaaatggctagcatttagtaagtgcttattaaatgccaggatttgtgctaaatattttacattattgtattatttaatccctataactactcctgtggggtaagtaacattattagacccatttaaaagacaaaggagactgatattcagagagtttaggcacattacccagggtcacccacatctatatcttgtggtagggcctccagcttggtctctctgattttagaacctctttttttttttttttttgagacagagtctcactctgttgcccaggctgtgtgatctcggctctcggctcactgcaacctccgcctcctgggttcaagtgatgctcctgcctcagcctcccaagtagctgggattacaggcgcctgccaccatgcccagataattttcatatttttagttgagatggggtttcgccatgttggccaggctggcctcgaactcctgacctcaggtgatccaccagtctcagccttccaaagtgctgtgattataggtgtgagccaccacacctagccagaacctgctcttgtacaggctgtgttgccaaggtgatgggtgacggcagaaagacttctaggggaagccctcttataaacagtggcctcaggctccctaggggacagaacaatggaaccaccttttcaacagggcttttttcctgcactgaaactgcagggcctgggagggaggaggcatatttgcatgtgtccagggcctgacacatctctgcctttcctttatgctggtttccatgggaatctatcttgagctgatgggaagctgggattctaaatgtgtgcttgctatgaggggaaaacactctgagctcctgagtgtggaaggagagtgggattaaatgttggcagggccaatgccacctttgccggcaaggaaggcatttcttaaactctgggcattctacaccatagggttagtctccatgtccctgaatgcagggagagctctaggtctaccccacccttcaggatttcatatttttgggcctcagttccctgtgacattgactacttttgtaaaaaaactctgccccaccttggaggatattaaattttacctctgctggatgcagtgactcatgcctgtaatcccagcactttgagaggctgagacgtgaagaaatcttgcatccaatagttcaagaccagcctgggcaacatagagagactcccgtctctacaaaaattgaattagcggggcctggtggtgcatgcctcttgttccatctactcgggaggctgaagtgggaggattgcttgagcctgggaggtcgaggctgcagtgagccaagatcatgccactgcactccagcccgagtgacacagtgagaccctgtctcaaaaaaaaaaaaaaaaaattacatcttaatggttatgtcatcttccatcctgaaacaaaattggctcccttaactgtttcacgtggtcctgtgtatgtttttctttagtttgtgggctggagttgcaaaaccttgggttaggcctagagttcatagagacagtattatgagttccctgcaagtcggaaacctaatcagaaatgtttccaaagcagcaaatgccacctggcatgtcagagctctatgggaaatgaatgctcagtgaggactcctaacctgaccccttaattgtgaagcccagagaaagtcggtgatacccaaggtcgctcagccaccttcgagctcaggggtcctcactgttcatgtccacaaaacccagcaagagggagatgagaggagtcagagtagaaaagggcagtaggcactctctctcttgccctattggctgctttgtaggtagcagagaagggttggggtctttccagtcatccagaataacccgtagctttcaagaaaggaggcctaaggtttaattattcatgacctttctcattcatttaacgaatgcatctttagtgtctatcacatccctggcacatactggggatatcactgtgaaccaaatagacacatttcccatcttcacagagcttcattacatggattaaacaagtaaatataataaaaccaattaaacaggtagttaaaatgaaatgggaaaggttcaagatttggggatattatggtagcatattgacagagaacctaagctagtcttgagatcaggaaggcttccccaagtatgggatgtttaacctgagacctaaaggttgaggacagggacagctcacacaagtgccacctatgcagtcccagaggactcccactcagaagggccccacatttggggttgaatgctctgtggtcaaagtattgagattttaattaattttatctttgaatttatgatttgtaagtgaagtccattgggacaatggcacatgcacctcaagcttggaaccttggctcacaaaaggtcctgacttctgccatctccctgcctctaaggaggggctctcagcttgatgttttgccctctggggtcctgggccacttggcagaggcctgagtgggagaatgggaagggccgtgtctcagggaaggacatggctctggttgtctctaccctgggctgacattgctgcagtccattcagtaaatgacctatgaggttgagcctccaaggccctccccgattctgggtacttactgtttcccaggaagcagagattgcaacacccttgggtgccggatgtccactatgggttgaggtggtgggtctgagtgaaggggagatgcctggctccacacctccacctctggccagggcacaggatgtcgggctgtgggatggtgagggtggagggggaagattaggaggaggcgcttgtggcaatctgcacttgccctgcacaacactgaacagcaatcaaaagacaccacagtaggctgagaaaggggctgaaagaaagggaaaagctttatatttagtaccttcatcagcactcatttcctactgtttgaacgtgggggcccacattttcacttgtactgggccccccattatgtagcctggctgtgaaggagcgcattgtagaaggccaagcgggagaggggattctgggcagaggaagccacgtgggcaaagggctggaggcaagagacagagaggtcagggggggatttagaaaaatctctcaggccccatgtggagcatggattggggtgacgtggggtgagatgggaagcagggaagggggcagggagcccagggaagtcatccaggcaggaaacaggggaggctgggccaaggcactggtgatggtaaagatggctgtgaggtggccttaagaaagacctgccaggtggaatccatggtgaggactggaggtggggatggaggtgtgggggagggggaggatgacacttgggggtcagaagtggacagagcagatggcagtatcacttaccaagactgcagatgggggtagggaggaggaaggtggtgagttcaacttcagatgtgtggtgatacaggtgcctgtgtccactgatgggtaattggatttgcaggtccaagcattttatgacagaggtttcctcactttggcacatgccaaactggctgggtggggcaggggcggggatggttgtgggcaagaagggcttccctcagttgccgtgtgtgcgagcagggccgggggtgtgactgctgtctgtgggaataggctcccttggcagtgtccctccatatcccttctgccagcactggctgagggtaatagacttggggcccgggtttcctggggctagaggtacacctctgactctgcctgctctgtgtctgtgggaaatcccaggatcttccctgaatagaagaggaaactgaggcccagagagagcaaggagtcctgggaatgaatatgcagctgatcagagggtggcaagaggaggatccaggatgctgacatcctggccaactgtgggatgtcacagtggcacgggcctctgaaatcagcccattatggcatggtggttataaaaatgggttctggagctagaatctgcttttgagcccaggcccactcacctactagctgtgtgatcttagacaagttatgtaacctttctgttccctcagtttcctcctttataaaatggggatgatattgtatacttgagagaggtaactggatgagtgaagaccttctaagttgtagtgctttatctatcaacagaaggaactttgatcatgcaggccccacagagcaggctcaccagccaaaaagcctatagtcacagagacccccaggttgttctagattcaaagggtctaacccccaacagttatgccaaaggattatttcaggtaaagaattcctcttcaccctgcccatcgtttgtccctgatttctctttaactctgtgtcttctctccttgaaacccctaacttttcttaatggctttcctgatcacccctccccagtcctccagcaaatcagcagcagcagcagcaacaatgacattcaatatttatcgattacttgcatattgtcagtcactgttctaatgccttatatgtgttatcacactgaatgcccatgaggcaggtacttttatttttctcatttgtacagaggagtaaaccacagcgcagagaggttagatcactgcacatgcccaggtggctctgtgggcaggcctacatcctttattgggcagggttaccattccagcctaggccaggctgaggggaccaatgtggaaaagcaaaaacaattatcagacttcctaattgttgggcagacatgataaactgattgcttttgctacattatctcatttcaccctcaaagcaatcctatgtcaaagtatgatgttcaaaaagtgaaaacacaactgtgagtaaaatatccaaggaacacatatcaaagattagttcaactcaaaagagaacaagcaggcgtgtgaagctgagttaaagggaattagagcagcagaagttatgacaccggagagagaatgatggaataggattgctaggttagataccaagctggttaatgtcctacagggcaataaaactctaaccattggggttatcttcctatcaggcagaattcatttgcatctctagaggacagaatagtgagagctaaacaaagttacattccctcctaggtcagtggttttcaagggattggggaggggaagtagttctgccccagaggacatttggcaacaactggaattgtgagggggaggggcaggggcggagatgtgtcctactagcatctagtggggtagaggcaggggccctgcaatgcacaggacagccccctcccaccaacaaagaagtatccagaccaaaatatcattagggctgaggttgagaaaccctgacctggataattagataatccttggccaggcctgttataaaatgctccaacatgatattacaaagatatggcatcctttctttgctttatttccaagttctggataatttagatttttcttaagtagatggtgcctgctctcctcgagggcagggcagggcagggcagggcctggcaagctctgcaagatggctgcccatttggcccctcctgggctgcagggtggcttcccacccctcaggcatcagcaggctccaccaggcccctgtcgcattcctggggttcaagttgctgcagcgtcctccacgaggctggagcctaagcctctggcagccagggcgtttgtctttttatagggtctggaatgcgctcgccaactcttgtgaccagcagcccattcccctcgccatctggggaggctggggcctcagaaggaccgcagctctggcctcaccccttagagatccaggacctgcagagcacagggtggtttgagcctgggccactgtacagagaagtgatggtgctccaaaagggtctgtggaaatgaatgaaagcctggattttagacccacctgggagcctgccctcccaccactgcaagaactcaggtcccctttcagggcacttagattctcccccgcccatcccaacccatgccccttcacaccaggcacaggggctgcagacactgtaatagctgaacaacagaagccttggaggaaagccttggaggaaagcctttgcccaagctttgctagctccctggggagtcgcaggaaaggacggcctctcaagtcaaaccaacctgcctccaatctagactggttggcagcttcctaaactctctgaacctccattacctcatctgtgaacagaggaccacaatatctttctttcttttttttttttttttgagaccaagtctcctctgtcacccagactggagtgcagtggcacgacttcacctcactacaacctccacttcccaggttcaagcaattctcctgtctcagcctcccgcatagctggaactacaggcacacgtcaccacacctggctaatttttttttgtttttagtagagacagggtttcaccatgttggtcaggctggtccacaatatctttcttttcaggactgttatatccatgagtgcaacaacctcgtgtctgacctggcacacaagagttgctcaataaatgttcattcccttccttctctgacctcccagcactaacagcccacagctgaagtcacactgaacccaagcctcggggggcaaagacagacctggggtggattgagggcgggatctgacaaatgtacccaggtgtcccaggcatactgtatctttctctcccctctgcctggcatagtggttgagaccatggagtctggaatcaaactgtctatacatatcatggctctgcctcttggtagctatgtgatcctggagaaattaatccctctgtgctttggcttcctcatctgtaaaacgggataagagtacctaccttagtcggctgtcgtccgaagctagggaggatgatgatggactgctccgcacagactgggatgcgtgttgggtatgggtatgactgtatgtccactctcagtgggagctgggcaacacggaggagttggtggtcctgttgcttgctgatggaaatatgtcgggccttccttttcaactggttcctctattgggcccaagggttgggagtaggagacagtatccgaggctgacgagggcctgcctcttaccttgggcacctcgttgtttccggcctgtacccttccctacctttgccctcccagtggttgtatgtgggaagcccgtctcagttcctgtgacctattcaccttgaaccaaggaagagtgtctggcctctgctgtgacactgggatccgaggcctttccctgcccagtctggagcctgccccacacttcaccaggcactggactccaggaggaccccctcctccccctttcttgtcttcaggtcacgccaccctgtgctgtatccagcaccacagaaacctcagtgttcgtcctccactgggctcggaggcacaaggaagccttggggtgtggtgaaagactgttcttatctagagtttactcccaggccaggggactaccgtcttcttcacacacatccttgaaagagaaagcccctttggggcagagaggtgagggcttcatctcaacatatgctgatggaggaggggggatgctttttcttttcttcttgtacttttttttttttggacttgttaggagttaatgttgcaaagagtagcttacatcttcactttctgaagacacttgaattgaggaccaatgtagctgtcatggcaagggccatcggggctggccacctcacacccaccatcctcccatggggctccaagacctgagacacaaggcagcagcctgcccagatccccctgttcatcctgcatgctcccaaggttggtccatgccagcacaaactttgggcatcagacaccagaaggtgtgtgtgcctcggccctgaaaggtgcgagtctctctcaccctctcctgcatctgggagcagatgcattgccagtagaggagggccacccggccctgccccagccgggacccctgcagctcaggtagaggtgccgagcccctgtgtcaaagttgctaaacgttttacttttgttccatcctagctcttttttcctcttccctgattattgattttatgaaagatacatctcagaaggccctggaagtgagaaggaggggcaaggaagatgactagttatggagggtgagggttgttttttgtcaaaagcctgagtagagttatctgggttatgtgacaccctccgggatggaaccccagagaacctcctgtgtggaaaggtccctggattttccccagcccgcagcctctccaccttcagccatgttcattcatggcagagaagataagaatttttaagaacttattatagcccatttctcactagagaggaaaacttatctggctttgtggagaaatttccatcttacactcatagtacatgatctttactacatgctaggacatcacatttaaaaggacattaaaataaagaaatgtaaaacgcttggatgagcttgtattatgacattaatactattgagagtatccgctttctaggctaaagagattcattcattcttctattactgcgttagccctttgtaatctgtgatgattatttttctttttaatacaaaaatgtatacaaataaaaacttgaaaaggcaaaaaaaaaaaagtacttaccttataaagtttcagtgaggattaaatgtatgcatgtggccagaatagggccgggctcataagcgggtgcttactaaagcttagctattattatcctcattacccaagacagcactggtctccctttctctcccagcccccttcaccctgagcatgcagagccctactgggaccctcagccccattgtccctctgtctagtcagccctggtgtgtctggcccacccagacctgagggagcttggttccctggtaagggaagtgctgtacagggaggggaagagggaactggaagagggaaatgagacccctgagacagaggtaggatggcaagggatacccattccagttacgtctatttgggtgagcgttcgttgggctaaacatagccacttccctcactcctcagcaggtcatcttccaaacctggaggctgaggtgtttgtggagatgccagggccctggacacccagtgtgcggcgtggccatagaggccagcacatcaggccggcctaccagaaacgctgttgcttcagtcacagcaggcaacgcctccttgcctttagcagacacctcattcccctctaagtctcacttccaacctctgtgaaacaggaaaaacagcacagccggagcaaacctccgtccacaactgaggtgtgcaagaaatgacttattttttcctgtgaaccaactttccatggatcctgagcacatatccctctgggatggagagggatcactgcagctattctggtgctttcagttatcccgcctgcctggggaatgtgcccaggccctgggtctcaggcagtgtgcaggtgacagggttataggtcctctgcacccttcttaaggcaggaatcgaggctgggtcctgctttcttgggggtcccagggcctcctcccagatcctgccacaccttcaaactgtgagctctacccctgagacttcccaaagctgcagtgattctcaggctttgaaaaacaaaagcctggggccctgccacaaacccatcctgaggcaagggggcccagtccagctgtcagcttaagggaacaagaaagtgagggaatccgggaggaaagcaatcaggaatattgtaaaactgtcttctaatagtagcacctgccaagcctgtgtggagagcttcctgtaaggttcctaagagggaggggacatttgaggatgcctgtcctccaccccagcctgagctccctgcaagcaccctgggcttcctcctcctcagccaaatccaccttgcctccatgcagcacacgtgccttaaagagttaacaacgaatatgagtccattgcctccctgtcccagtgagatttatgcctgagcaggtcaccatgccttgaacctaaagaaggagattttcaggcccaggtgacaggcagtcatgtggtggcagtgcacattcccagggagcccttcaactgcagccactttgctgcctctgccagccccttcccaggccagcccagtaaggtcctttcagtgagctctgtagatcccagaaccctccagcggggcacatggggagcctgggagcctggagtcctgaccaggccactgtgctaggggtaggattgcaggggaagaaggtgtggtatctgctgcctctgtggtcccagatagggagactagagctgggcagatccctttggaggaaagcccaaccagctctcatcatcttcccacaaagccccatgcgggccaggggaggagaagtattcaggactggctgacccttggaaatagcagactcagcctgaaaatagaggcagtgggagggtgaggggatgtgcggtcccagccctgcttttttcaacccaagactctggaagtacctggctccaatgcccctgggagcaggtgcaaggcctgtgcatcaggggtcacacaccacgccaacctccagctaagtttggccccagggagcaccagttagaggcttgtctatggaaggatgagaatttccttgaaggggacatttaataataaaggcccttgttgggggctgaggtaagggagctctcacctcacgaagttggacgggctcactgtcctcctctgagctcagagatcagggggtcagggacagccactgccctcctgctctggggtcagagcctgaggtccagtgtctcttcttaggaatgcagatcccaaggctgcacctggttcgaaggtgagcagaaattgtgactttccattgttcatttattcaacaaacatagcctgagagcctcctgtgtgctgggcaggatgacgcattctatagcagagcttctcagatgatctgtagggaaagaccacagttcgtcgtttttaatttctactccatcatggcctgatacatggtcctactgcatgggtgtactgcattgatgacactgttctcttcgtgtgtgtgtgccagctgggatttgccatgtgactttgacaaacccagaatggtctatagtccacccacatgcatggaagtggctgcagattgccatagaattttccaaatgcttactcaatgcctacactgacctcatctcagagtgatagcgacggtgtgcagccgcacctgcccacagcctgcacctctagcagcagtgccccgggacactggttcatttattccatcacagactttcaggcactgttctagatgcagttgacacagcagtgaacagagctaagtccctgctctcaatgatgttatattcaggtcaggagagatgggtcaaataaattaacaaatatatagcgagtcaagttttgacaacagctaaaaacaaaaacaaatcaggctaagaagatagacagttggggggtgagagccaggaaggtctcagtgataaagtgaccttcaagttgggccctgaaagaaagaaaaaagtgagtcatgaggatatctggggaagaacattgcaggcagagagaacagcaagggcagaagccctgagcccaaaatattttcatctgtgtcgggggaccatatgtcactaagggaagggcatcagaatcaccagttggcggtgccttctcaagccataaaacctcccctcacccaccaccagcagcaactccgagagggcttctttggagagtgaccctggcccccaagcccaaatgctattactgatgggggaatgtcacctgttcttggggcagagaagccatggagaatccccacagttagaaacacatgtgaggatgacgtggcctcaaggaagctgcggtctgtcaggaggcagcaaagagaagcacagggttataggggacagtgaggacacagagctggtgctccctgtggggggtcagagggttgtaagaggcaagaggtctacttggacagtgggcctcagggacactctgggcagaggggccgggatgagcaaaggtggaggctggggcagctagagagctaggggacctgaaagtcattccacatgattgacggggtggccagcaggctggtgacgaggccagaggggtcagcaagggtcatgttatggaggatcttgcatgccacggaaacgcatttggatttttctggtaggtgttgtggagccattgcagacttgcaagcaaggcagtagccgggtctgtatggagaagggctcgggggaggagacgtgggtggcggtggaccactgcaggcaggggagagcaatcaatggcaggggcagtcgaagaggaggagctggatgcaggagacggtaggggtggaatggcccggacctgctggacactgggacccggggagagcaagagggaggaggagtccagaaagaccctggaggtttctggcttgggccactgagtgcctttggctgagacagcgacacatgaaaaagagcaggtttatcaggagaaggagttccgtttcaaacatactgagtgtgaggtgggtcgaagccaagccctggtgaccacccacagacatgacatcaaacaacagctctgtgaaaaccaatagaacataatggaaaccaatagaacacagtgtaggcagaaaacagaccttcaccaagggcccacgtgtctcataagaatagctgtgatgtattcagcatttggtgcatgccaggcaggggtagacacttacaaggtgccatttaatcctcaccatgactcttcaaggtagctctcattatttcagatttacaaatgaggaaactgaggttcacagaagcttaggaacttgcccaaagcagcagagctggtgaaaaccgtcacaccatacatcttctgcctcccacctgcccacgatggatgcttgggggtgtcacaggaaattaggatgttttaggaaggttggtgactttgatcttggggagacagccaggtcttacccagggcatccagtccagagcttaataaatatctgtggaatgactatccctcatttttccatggaagactgagcccaggctgcagaggctgtcagccaacccagtgtgacattgatgacactgttcctatgatgcaagaggggacacatcccttttccctctcctccggaacgagggctcacactgtgtgcacacacagggattgtatggtactgagttttaattccaggcactccagggttgggctggagggagtatggtggaaagaggcaggccttggagctaacaggctgaggaaactgagtgacctcatctgaagcccacagcccctgacaagctctctctgagccaggccgcagccagacaggcagtggcaggtgcaggcagttctccggtgttcatggctggccgcccagcctgtgagcactgaaactatttcaggtcctgtttttccttgcctcaaccccacttctgtctatccctctggggttgcagcaacctgaaattgtaaatgctgccttgacttcactctcctcccttacactttttccttaatggtgtgcctgactcccaggaaacctgtcctacagaggaggggagaccactcacccaattccagggagatccctccatagttgctccagcccgctcctcttgccagggagggtgccaagacctccctttgcagctctcctccttggagcggctgccccacgattccccaagagtgccaagcacagtctccatcaacaggccctttcacagaatggcatggctttgcattttaatcatcacattaccattttctggaagaaggggaaagctttgggatcacaaattaatagaaggaatgaagggcaaaattaagaaaagcaagtctagtccttgtatgttgcagtcttcccttctatctggaaggggaaaatcatgctttcaggaaaattctctgaatgacaagtttggaggtttctggagccatatccacaatagtgagccatttggggacctcttcccttgcctcccatacctactcacttggaagtaaaaataaattatcttccatatcattaatggagtgcccagttccccagtctggctccgcagttaaggaactgtgaatatgaatgacgcctccgcagtgtgctgatggggtgggcccctggtcccaggagatgcttccatgggtgtgagtgttgcagactaatggtgatgggggctgggttgtgggggtacagacccccttgtgtaactccagagagcaccaatcaggatagatctgtatgtgtgtgtatatatatacacacgtacatatgtatgtgtgtatatatatatatgtatatatatgtatacacacacacacacacacacacacacacctcctggagctgtgccgtgctgcaggctggcctagactgcaggctgggtcagcaccccctcgggaggctgtgctaatctgggaaggcctggaggccagagctcttagaagctgccaagccagggttcagatggctgcaaggagagcagtttcagcctggagtcctgacaagagagacttgcttcctcagttagaaatagctctcacctgggcccagaagagggggaaaggtgatggggccaaggatagggtaacccagaggatcaggctacggggacaggtcctggagtgtcggccgggccttctgcagggtggggctgagctgaaacctcagcttcttacctgtgttccccacacacagtgtaccccacactccactcaccctgcgtaatagtgtcacggcctttaaggggctgcctaaaggaagccaatgtgagggcaggtgggacgggcaggggaccctaaaggaaaatgaattaaagagcaacactgcccagcaagggaaggcatctggagttctgagtaatccacccccgtctcctaccatccatcccctgcatggtgagagaataaaggtgccaaagccagaaaccacctggggactttcattttgggtacctcagatccttcatttattcaacccattctaatatctggaagtcgagtaatgaaaaaaaaatggacaaaaatccccatgcttcatggagtttatattctagtggagaagatagataatgaacaagattttatatgtataatatatatatagatatggtatttaagctaaggataagtgctaagaagaccaaattaagcagaggagaggaacatgaaatgctggagatggctcgcattacacttagtggccagaaaaggcctcagtgaaggaatttggagtaaagacctgtggaaagtgagggagtggcagtgtgggggcatgtaggtgtggagtgggggggtaggcattccatcagcaagtgcaaacgtcctgaggtgggcgtgcctgagcaacagcagggaacccagcacggctgcagggaagagagcaagggtgcactcagagagcacagaggcatgctgtgaccacgtttgctcccacaggagaagctggagtatttcttcctcattgtcttctcgattgaagccgccatgaagatcattgcctacggcttcttattccaccaggacgcttacctgcgcagtggctggaatgtgctggacttcaccattgtcttcctggggtgagagctgggtgtggggagactgaaggtcagaccctcgctgaggactgtgtgcccactgccaccaccaccagcatcttagaggtggggtgggactccagcattgtgctaaccactgcatggagcagcctctgttagaggccggcccagcaagggagctgtccatgttggtggagagtggatcattgcccccgaccctgcccgcaggtcaaatctccttcccctgctagatgctataaattccattatcctcctcacatcacacaaatttggaaatgatatggatgtttccactggccagcagtttctggatgttcataagtttctcagcctctgtcatttattagtttattccacagacctgtattgagtacctgttatttgggttcacaaaaacggacatttattaacctgtattagtttgctagggctgccataataacattccacagattgggaagctgaaacaacaggaatctatttctcacagttctggagtctggaaattcaaggtcaagatgctggcaggtttgggttcacacagtctctcctctgtgcctgtgcatccttggtgtctctttgtgtgtccagagttcctcttcttataaggacaccagtcaaattggatgagggcccaccctaacaacttcgtttcatcttaaccacctctttaaagaccctgtctccaaatacaaccacattctgaggtgctaggggttagggcttcagcatatgaatttagaaggaacatatctctacccatagcattaccatgagtaactaccacgtaatgataacaatagcatttatcaagcacttaatatgtgcttacatgtaccctctcatttaattcttgccacaatcctgttttccctcattttataaataaggaggctaaagaacagaaaagtcaagcaacttgcccaaggtcacacagctagctggtggcagtgctgggattcaagccaaagcagtctcggctccagaggctgcatgctcaaccagtatgctgtccttcagttccgtaaggatggtgttggttacctgctaaccatccagtgctacttttggctcagtagagaaaatagaagaattctgtgaatctgcctctgccttttacaaactgccctggttggaagccaagacaaatgcgtacagaataatagagtgcagaaagcagtacctcacagcccattgttgtttcatacgcaatgtgtcccagggagttctgccgttagaagtatttggaggcaaaggaatttgaggtagacttcaaaggataatggaaatttgagtaaattaagagaggaagaggaggccagtaggaaagaaaataaagggcattatcaaaaagtgcagccaggaggaaaagcacagagggagaacttgctgtggagtttcttctctgggtcaccactgactatgtacaggtaacctccagcccgtgttgggggtactcagccccagggccagggactgtccctgtggcacacatacctcacccccgttcagcacccaaagtagacctcacaagtggagcaccatactcttttcactgagtatgaacttgatgtcagaatccttttaagtgaaattccccagataagcatgatcagatcatttgttagttgatgcacccgtatttgccgtctctcccctaggcctttccacaggtgctcaagcatggacaggacacagggcctcagaccactggggcagtggcttttccaacccctggaccccctctctccctcttctccattctagggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagtgggtggcagtgtccctgcagacccctttctcctctcccttcctgttcccttgtcccccagttctgggtccccttcctaccttgacatctcaggggcttcccaggatttatagggagggagggccaagagaccaagcagaggcgactcctcttttcccttccctgcctgcctctgcaggcctgcaggtggtcctgaactccatcttcaaggccatgctccccctctttcacattgccctgctggtcctctttatggtcatcatctatgccatcatcgggctggagctcttcaagggcaagatgcacaagacctgctacttcattggtacaggtgagctcccagggaaagtggggctgtggggcagggcctaggatggctcagaagggggagccaccctacctggtgaaggagcccggagctcagccattgccgcccacatctgttgaccttgagaatgggtttctcctggataagggggacttggaggaagggcagctctactggagtcagtgagccaagaaagtgagcaggggcctgggccatggctggttctgaaacaccgtcacccccctaccccacatacaatgtggtatgttccaggctctctggacctgtggtagatggagacataggcatgggataagcttgaatttctatgtgtacatttcctgtcgcatagttttagctttagtctgagctgaccctcagagcaggcacccagaatagggtctgaatgggacctcagaaaaaacacccaagagccaaatggagtcattttttgagtttccagaaataacctacattgaagcccagatatatttgagctgaagcagcagttctcaaactttttggcctcaggaccccttttctctcatataaattactgaggacctcagagagcttttgtttatataggttttgatctgttgatattcatggtatgagaaatgaaaaccgaggaacatgtcacaatattaatttattaattcacttttaaagaacagtaagaaacccatgacatgagaacataaatagtatatttctaataaaaaataactagatttttccaaaaccagtaatatttggtgagaagagtggtgacgctattttacactttttgtaaatctcttcactgcctggcttgatagaggctgctggactctcacatcaacttctgtgtgtgtgtgctgccaaatcacaactcatgtagcctctggaaaattccagtctacattgttgagagaatgagagacagatgggcaactaacgtctcagcagtattgtgaaaatcattttggtcaggccgacactctgaaagaatctcgggtcccactctgagactggctgctctaccctgccagcagctcactgggacttagcctcctccataagccctggcattgaactcaccagaataactgttctaggccttcagtgtctcagaagactctactcacctcctcatgaccgctgacaacaaagggacagtcaacaccagtcctaaacccaactcacaagagtaaactctggtccagctttcagggattatattcctagacccctcccatttcagcctcctcccatcaccaccacaatctacatgctatcataagcattatcaggatggataggaggtgacctttgatcacaccttcaacccaaatttggaggtctcactggtgttctcatgagatcttgaggaatgctgagcagcagtgctcaaaagcccctctcggatcggggcttctgacttcatggggtcagggcccctacagacccatcaatgtcctctcctttccatcttcagagcattgagcctacatggtaaatagataaatatgggtaaggcagggtgttccagttctgatgagccaatctaatctctgaacacaaaaggagactgtaaaacatcctaagataaaaggagatgcaggatgtcatcagaagtacaggattttagagacaagaaagcatcatccaggggaacaaaggagagtgcaggctcgggcctggcgggaacttcccctgagtgcagacccctgccccgtcagctgggtatcttgtaaagctcagcccagtgcttttggagcttctccaatttcacctcccagacagaactctcaagtcagaacatgtgagccctccacctccagccctgctccagccaggcagctgccttcttttttaaagttctgtggggacaaatgacactcagattactcctctttcatgggttgcactgcttaggacaattaatcctagaagccgaccctgccatgaggcccaggggcccaagacataattcccgctgcctgtagccatcctcagcccaaggcattcctcttcactgtcaccgtctgctccatgtgaagctgtcttttgcattttcagcagagtgtctttagacttactgctcaattctcttaaattgctcttatacacctttcctcctgtcgttgtccacctactactgttgtctgatgttccctttgccttctgcctccagatatcgtggccacggtggagaatgaagagccatcgccctgcgccaggacgggctcagggcgccggtgcaccatcaatggcagtgagtgccggggcggctggccagggcccaaccatggcatcacccacttcgacaacttcggcttctccatgctcaccgtgtaccagtgcattaccatggagggatggactgacgtcctttactgggtgggtctgggcccgcgcctgcagaaccatctcccttcatccacaggcttgcaagggagtggggagggagggcttgccagtccacacaggaggccagtctctgacttgcgtgaccacagctccctcttgctcctccctggggaatctatacaggatgtgtgtccctttctggttcccaggtatgtgccccagcatcctatggggaaatccccatgatacaatatgtctgtgcaggatccaaggggcgggtgaagaatggaaaccaggaaaaacctggctgtgagtgactcaattctgatggcttagaatttcacactttttgaggaacgaagggccctttgagtctttttccttgcctctgcaagactgctttcccatataactattattagatattagtttcctcacctataaaataaggataataatactgtctatatcagagttagtgggagaattacaacagtgcccggcacacagtcaacactccagtaagagtttctttgttggagtatattatttatttggtgtttgttaagagctagatttcttatttcatccttcaatgatggaaggcattgctcccattttacagataaagaaactgaggctcagagagattaaagtaacttgcccatggttaagaacttagtgagcaacagagccaagaatcgaactctgatccccctggctccaatccagaattaaccacaatatgacgccgcctattgtgggggtggggggattgtaaaactgtcaaatgctttgcaaataccaaggattagtacaaatatttattgtaagtgtgtattaggagagcaaattatttaaaatgtcaaaggactgtcacatgtatgatttcacctctgtatcaagcctgtgaggagagacagcccatgtcattatcgccattagatggttgggaataatgctcagagatgttaggtgacttgtccggggtcacagacgttgttcatttgaaaaatcttggctttaaataaatcaactggagatagagtctatgagggagatcaagtgagggaggcagataggagacactcttggttggagggaaattaggtcagtcttgcccgggccaggtaggcagtcagcaaggtctccctagggagatccttccagaccagatcctagtcctcaggctggaaaagttcttccagactagtcctcaggttaggaaaaatgtcccctcaatatcccagcgtggcttctctccttgtcccccagggttgggtggagtcttaatgagcagacttggggaagaggaaccaagccctcaactcagaggatcacacttctgtcctgaccaggtcaatgatgccatcgggaatgagtggccctggatctattttgtcaccctcattttgctgggatccttcttcatcctcaacctggtgctgggtgtcctgagtgggtaagaaattcaaaggtagccaggggagaaaagagaaagaggaggaggggagaaggaggaggaaggaaaaggaacggagggaaaagaaacaggaggggtggggggcgagtggagaggaggaggagagaagggaggaggaggaaggagtggagcagggcagggggctgtgagtcaggccctcggctcatccctgggttccctgtcatctcagttgggccaagagcgcttccttcctggtgagcaggaagagaggagaggcacacaggagcccttcaatttttaatttgcctttttcctcctcctcaagtcttcccccattctcacccctcccgtccctctgttttgacactcctcagtgaagcccctgaaactccagcctcctggccccgggggtgcctaagtggagccttagcactaagaggcggtggggctttcggttaagcacacagactctggagctagaatgcccacatttaaatccctgcactactgcttggtggctgtgtgagctttacctaattacctaacttctctgtgccttaatttccacatctgccacctaagaattatttcagtatctatctcatagggttgttgtcaggattaaataagttaatacatataaagtacttagaacagagtccagcacaaaataagcactaaatactaatggtcattattaatgagagctgttctctttgagaccagtcctgctgtcatccctccacccaccccagcacagcagagaggctagaagtcaccatcagccttcttccccattggtatcatcccattccagaagcttccttccaggcagtctatagatagaattctgggagtctgtaaacttgcataggaaacatttatctttatttttcacaattgtaactgaaatttagtgtttcctttagtaatgaacataggcaacaaaccacagtgctattagcagggcctatgacttgtcctaatagaaatcatgtcacattacagttgttgcgaatagtatttacactaactactccatactttgaaattatgatagatataaaacctgcagctagatcttgctaatgagttaatgaaaaagcaaatgtattacttgatcacaatttttttgtatggataactatattttaacatacagtcatgtgctgcatgatgacatttcagtcaatgacgggctgcatccacaacagtggtgcgctaagattgtatctttactgtaccttctctatgtttagctatgtttagatccacagatacaatcgcctacggtatgcagtatggtaacacgctgtccaggtttgtaggctaggagcaataggctatgccatgtagcctagatgtgtagtcggctctcccatctaggtttgtgcaagtacgctcttgatgtctgcacagagatgaagtcacctaacaatgcctttctcagaacgcatcccagtcattaagtgaagcctagctgtaactggcttctttgtcatgctatggttttattttgtgcatttcacattattctgaagagagatccataggcttaactggactttcaaagggtccatggcacaaactggtcaagagcccctccctggaccccacctgaccagggcaactcgacctgccctgtgggccaacccctcctggctgccaggcgcagctcctcagagactacccctgtgctgtcttcttcctcctgccctgcggggcaggtggtcatagcccagggctgccctctgctggcctgaagatccctcatggagccttgggtccttttcttccagccatgccaactggttccttggagtccaaggagaattttccccaggcctttggtctgtacaaaactaaatttctaaggtagtttgaagggttggggcagtatggccaatttgaggctccgtggctgattcagttaggcaatggactgccttgtcattaacccctaatgtgcaaggggaaccccaaaacaaggcaggagacaatgagatggatgagaagaaagaaatgaggaaggggcaaggagtactccaggatgttcctggagggtggggacgggtgagcaggaagtgagaggggctgtctctcagccaccttgaggggcacctggaccccaggcaacaccccggggccagaaaaaggagcgctccagtcacagaatgggcttgtctgtcctcaggaagctcagtctttccttgacactgttccctcttctcctcctctcctggctcccccatctcatttcagggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggtttgggcccaaaggctgtggtcagcactcaccccactctctcactcccacctctgagtcataccttgcaatcaggcccactgagcaagtccaacattagtcctttgagggtgagtgacttgcctaaagcaaaatggctcaaaatggtaagatccaggtgtgaccagagctcttcccaaaggtacttgctgcccatcctcatagcgcctcccctgcagataaagtgggctctttagctcttggaactctcagtctctggaaagcacgaagcaatccaggcctacctaggacccattgttgcagatgtctctggtcaatgggcccttgtctcgggtgcccagtccaggtgtgtccagcccagaggggccccgaaggctggctgactctttctctcctgtctccaggaaaactgtctttggatgaaggtggctctgacacagagagcctgtatgaaattgcaggcttgaacaaaatcatccagttcatgtgagtatctgcccactgccccaggaacccccaacccccagctccctgagacatgagggtagagtccagttacttcccctcagtggtttcagagtcacttgtctaatcctttagaaaggcagcctttttaagaaaatagggccagttcctgctctgagggactccgcagggaccagatcctcggggaatgtgtgatcagaggggtcctgagcagatgacctatttatatagcacataagaaggacactgggagcctccaggagcagtgagcatgcttgctgctacttcaccctgatcagggcagagctgggtgaggtcattcatgttggaaacctctgcgagggaagagggaaagtgtacacagcagaggctgcacaaaccgggagcccctcaggaaggaggctggaggcaagagcacactccacgctctctcgccattgtcttaagaggagggtttgtttatttggttggctgtttccttttacaaattcatacttaattatgattttgaaagatcaaacaatagagctatacatcaaagaaaagatgaaggtctccagtgcccttcaaagaggtaaccatggtaacagatgtgcagcctctaagatcttttctgtgctttcatccgtcttgcacacacacacacgtgccaggatttttttgtttttgttttgattttttacataatggggttgtttatgttaactactgtcaccacagggactagaagagtgcctagcacatatgaggtgttgccaaatatttgtcaaataaatgaatataatacacactaaaggataatccaataaaggattatctagttacttacctttttttacttaaaattatctattgagagcaattttcggagcagattcactttccttcttgtatctttggatgtaaaacattccacaggatgaatatgccataatgtagttaatttttcccctctttggcgatacaaacagtgctgcagggaacagttgtggatgagtatgaccacttctgccaaaggaactctagaaatagacttgctgggtcaaagggtatagctactcccagctcctcggaagtctgaggtgggagggtcacttgagcacaagagttcaagtccagtctgggcaacctagcaagacctgtctaaataaataaataataaaacattaataaacagagcatatagactttaaattttggtaagtgctgccaattcatcccaaaaagattgtactgtcaaagctcatttcccctcaccctccccagatattattaatttgttgaagagtggcctttgataaggggcaaaacgtggcatctcagagttgctttaattaaaattaaaccacacggagcgtctgctccttgccaggcacttgtgctaagcattttgcgtgcatcctctcattccattgcctcggaggtttgtgtcattatcgctcttctgtgaaagatggaggattttactcagtctggctccctagctcatgccctgagcttctctcatgtggctggaggaagtggggtggtcaggctacgcatgcctggagtttgtctgaaggtagcttggacaggtggggcgtagaacagcacagcactgtaggccatcctctgtcccctccctcagccgacattggaggcagtggaaccgcatctttcgctggaagtgccatgacatcgtgaagtccaaggtcttctattggctggtgattctcatcgttgccctcaacaccctgtctatcgcctcagagcaccacaaccagccgcactggctgacccgtttgcaaggtgaggcggaacggagtgaagccgggaggagggcacatgtggctgtggcttgatgtcaaaatcagccaatggcaccacaggttgtgcagaagaggtcaattagatattgacatcatttttctaaaaattatggaccatgagtgctggattatatgacctaatcagctcctttcacgggggtaaaacggagacctcaagtggcaaagcaacatacccaattttcctcttcatggctttgttacttaccaaggtcagtaaaagcaataggctgggacaggtgcttgcccaggtgtccgggcagattattccaatcacagatcactggacataaaattgctagtaatttggaactctaagcacccaagttcaaattctacaaaaacaacaatctttcaccaactatttattgagtgcatcctacatgtaaggcacaggaaaataactcaggatacagagaacactaatacaccactcctggcttcaaggagcttacttagccagaggggaagactgatcttaataaataattccaagtcaatagaaggagggcaatgatagaggtaaatacaaggtagcagcaagaggagaatcacagaaagagatgctgaaactctgtggatcttaaaggataggtaaacaagccctaggcagtcaaagggaggaggggatcctggagaaggaacagtgtgtgcaaagatatgaagacgtaaaacagtttagtaaattcaggaagccgtaagaactttgcatgtgactaagagagtggcaacacatgtgtttgctcatgggggccttgtgttaggccattcttgtgttgctataaaaaaaatacctgaggccgggcgcggtggctcacgcctgtaatcccagcactttgggaggctgaggtgggtggatcacaaagtcaagagatcgagaccatcctggccaacatggtgaaaccccatctctactaaaaatacaaaaattagctgggcgtggtggcatgcacccatagtcccagctactcaggaggctgaggcaggagaatcgcttgaacctggaaggtggagattgcagtgagccgagattgcaccactgcactccagcctggtgacagagcgagactctgtctcaaaaaaaaaaaaaaaaaaaatgcacctgagactgggtaatttataaagaaaagaggtttggttggctcacagttctgcagcctttacagaaaacatgggctggcatctgctcagcttctgaggaggtcttggaaagcctacaatcatgatggaaggcaaagggagggcaggcatgtcacatggcgaaagcaggagcaagagagagaaagagtgggaggggaggtgccacacacttttaaatgacaggttttgtggtgaactcagagtgagctgacttaacaccaaagaaatggcccaagccattcatgaggaatctgtccccacaatccaaacaacccccaccaggccccagctccagcattgggaattacatttccacatgagatttgggcagggctgtctatccaaacgatatcaggccttatatgtgaataaagtgttggactttacactttaggcaatggaaagccagtgagaagttaaaagcaagaatataatgtgatcagacttgagtcttggaaagatcagtcttggtggaaggtcagtgagtcggcctcgtccacatggtagatgttcacctgggtgtgaagctctggaccgtgagacgagtaggatacgagaaaagactgaccagttccaacaacacggtggacaaactcagtgccctccccactacaaacaagtaacactgctgcataaggcataagaatgatgtttcctggaatgaaaaggaagtcttttagtggcagaaacaaagaagtgacccaaagccagagcagcgagcttgtgaactgacttccaaggacattttagacctaggcctaaaccctaatgggtagcagctgggttcctaaggcctgtgcagggctggagacagggctctgggcctgcataaggtgggaactggcactgtcatacctacatagagccagggccctggaaaggctgcccccatggaagggaagccaaaatctcactgggccaggaaatgagcttggaagtttattcctgctagaggccctgggagaaaggaaaaatgtctcaagtgaaaaatcaaaatcctatcagtgccttatataggtatggggtccaatatacactacctctcatggtccaaggattctaaactaagatagtaacataaaaatcaagttgcaaacaagtaaaatccctggggtactcaacagaagcaaacataaaccattctttaaggatgcttcttaatctaaggcatatagaatttctgaagggaaaagtgtttcctgaagatgagatcacaattaaaaaaacaaacaaacaaacaacaaccaaaaaaaacctgcaaaccaaataaggaacagagccaccctgagaaagagtcatcaggtacaatcaatggaagctggcagccccaaaaacctgagatgatagaacagtacaaaggagactgtttaaaatgatgaaagaggtaaaagaaggaaaataaatagaaaacaagattatctttttctatgggaatgaaataggaaacaaagctagttttaaattactagctacaggtcagatgaattcattcattcattcatctcaaccaatcttctcgagagcaccgtgaatgtgccaatcgttgtcaaaacactgtcaatgaccaaatgtggagatgatgtgaacagtgcccaccaagaggagtcaggggtgattttgaggtttgtgacctatgcagataaatggctagtagtgccacctactgagaaaatggttaatgaccaagtatttggggtagtgggggaggatgagcagtatccctgagctttgtcttgggcatggtgagtttgatgtgcctttgagacatcccaatggatatgtcaaggtagcagacggaaaaataggtctggaactcagcagagcagtctcagctgaagaactaaatctgggacgcattggaggggatggtctgaagctgtggtcttagataacaccagatctccaggggagagtgtatactcaagggtatcactcaaatcaagcattcaatgactcgctgtttcatcctgctgaaccttcagctggaattgccccaaaagctgtggtaggggaattctcacaaaggactaccccaaacagtcttgagatagggttggttgcgattccaaagaaagaagcactaaatgccagggtgatcagtccaaagcttttgttggggaaacttactatacagaatgttgcagcaattctcatgatggacagcaagagaaaaggggtgttctacccagacttatccgcagcaatggggtcagggcatggactttagataagggtttaaggaatctggctcagggctgtggccagttcctttcaatgtttggggcaacacctattacctttattagtgcctaggaatgttcaaggccccagtttgaggtcaagcctgctgaggaaaacctgtagctgcgggtcccagagcggtcaaagcgctctgcgattttcagtcaggacacagaaagaaagtggaggggtgggggtggggagaactggaagaccctatacttgctgatgtaaagaatgcatctgcagaggaggcttaggaaaatacagagaagtagaggaaacccagaaggatgtggcaccacagaaaccaaggacagaatgcttgaaaaagcaagagaatggtcaacagtgcccagtgctgctgggaggtcaggagcaggagggttagattagcattggatgtggcagatcgatgcccctggagagagtagtgttggtgaagtagtgagggtgcatccaggtagggatgaggtgaagagcaaatgtggcagggcagggggtgaagaagtgaagagagcaatatagacaactttcgggagtttgacggtgacagggaggagagagctaggatagaagatagagggaacatgggagagtcttgggttttttttttttttttttttttgagatggagtctcactctgtcaccaggccagagtgcagtggcttgatctcggctcactgcaacctccgcctcccaggttcaagcgattctcttgcctcagcctcccgagtagctgggactacaggctcatgccaccacacccagctactttttgtatttttagtagagagggggttttaccatgttggtcaggctggtctcgatctcttgaccttgtgatccacccgcctcgacctcccaaagtgctgggattacaggtgtgagtcactgcgctcggcctagactttggctttaagaatggcaaagggagggtccatttgaaagaaagaagttaaatatataggaaagaaaaagaatcacggacagggagcttcccgaaaagggggagggggcaaagcgtgggaggatggattggcttcaggtaggtggcaggacccttctctaccaggagggaggtgtataggaatgagagagtagcagacttaatgaacttcagtagaattaagagtaataaaatcctcttcctgttaaatatgatatgagttagcttgcaagaaatcaatgggcaaaatttaccgggttttttttttttttttttttttgaagctaatttaaaaattcgctgggcatagtggctcacacctgtaatcccagcattttgggaggctgaggccagtggattgcttgagcccaggagttcaagaccagcctgggcaacatgacgaaaccctgtctctattaaaaatacaaaaaactagctggatgtggtggtgcatgccggtagtggggaggatcacttgatcctgggaagtcgaggctgcagtgtgccataattgtgccacttcactccagtctgggcagagtgaggccctgccccctgcacccccaaaaaacatccatggtgccttggaaacaagggaaggggcgtcctgggttgaggcccagccacagccaaggctgggagtcaggagaagggaaggagagtgatgccggggctgtgccaccaaccctacagacattgccaaccgggtgctgctgtccctcttcaccactgagatgctgatgaagatgtacgggctgggcctgcgccagtacttcatgtctatcttcaaccgcttcgactgcttcgtggtgtgcagcggtatcctggagatcctgctggtggagtcgggcgccatgacacccctgggcatctccgtgctccgctgcatccgcctcctgaggatcttcaagatcaccaagtgagtgccggggtcggctggcactcccgggtccccggcaggcaccacgggctggtctggtctacacccatctcatttcctgaggtctgggatctgtgcaggttcaccactggtcccttgcccagacttccctccctccttgaaataacctccttctgtgaaaaaagaatcacttccccactttgaactcatttctctgttttttttcttaccatagtctatggcagggcagggagtgggggtggtggaaaagagaaaggaagaaaagaaaaggaaagatgggaagagggaaggaggacaggaagagctgtagggaaaggggtggaaataagaaagaaggaggaacacagactatcagggcctttgtgaggtggtgagggaagtggagagaggttcatctgcttgcactatttatccgtcacttgcatgagctgggtactgtgctaagcacagggcatcgagggtgcacaggagaaaagctgtccttattctcacggggtttctcgtccagtgatgggacctaaagttaatcaatagtcatattaaccagcgtgaaattacaaacagacaagtgctctgcaggaaggagagagtgggcatgcagccatgaatccagggccttccagccgtgaggcagccccctccctctgtgtcacatcagtcctgagtctttcccccaagcctgtccacacctcgtgggccccagtgagagggtctgtctcctcccaccttgtgcctcctcttccttcagatattggacgtcgctgagcaacctggtggcatccctgctcaactccatccgctccatcgcctccctgctgctgctgctcttcctcttcatcgtcatcttcgccctcctgggcatgcagctctttggggggaggtatgactttgaagacacagaagtacggcgcagcaactttgacaactttccccaagccctcatcagcgtcttccaggtaggctctccctctgcgtgtccctccttctgaacggttgctgaatcctgcttcttgtccttcaagatcaaggtgggcatcaccttctccaggaagccttgtctgatctgctggttgagtgcaatgtccttctctgggctcccctatcacctgtgcttctctccattgtaacacttgcttatgggtctccttcactgcagctgcacctactttgtctgattagtctttgtttctggtgcccagcacagtgctggcctactgcaggataatatgactgggttagggatggcctgggagtccggatgcgtgctttcatgtgccactcaggtctcagggcaaagtcagataaggggagctttttctcccgaaggctgagaaagccccagagaaacgcaaaccatttctcactctgcaggggcggcacagccgattcactatcagccacccaagggagcatggctgtggcccagtgagaagctttcagggtccctggcctcctggaggagttttcttagtgtagacatggaaacattcctctctggagtggcccatatttcatgagtgacacctcccttttgtaccagtgagaaaggcagtgtgtgatcgtccgtcgatcctctctttcttccattagccccactggctggtcaggcctccggcctttcaagagactcgacatttcacaggacttctaaggccagaataacaggaggcctgggtgggtgaagcacagtgaagcccgggggttaggaagagaacagggaaatggtgagcccacagtccaatttcttgtccatagagagcagcaataagcttctagatcactgggataggggttttgttttgtttttcgagatggagtctcgctctgtcacccagactggagtgtagtggcacaatctcagctcactgcaacctccacctcctgggttcaagcaattctcctacctcagcctcccaaatagctgggattacaggtgcccaccaccatgcctggctaatttttgcatttttagtagtgatggggtctcaccatgttggccaagctggtctcgaattcctgacctcgaatgatccacccatctcggcctcccaaagtgataagtaacaggcgtgagccactattccccagctggaataggggttttggggatagcaggggctggccacccagactgtggaatgaaaagagggaaggtctgagagaaccacagagttggaggagaacttcggtcaatgcggtcccaatagaagactctcaggcccctctgtgttcccgagccctctatcctccctccacacaggtactgacaggggaagactggacctcaatgatgtacaatgggatcatggcctacggcgggccgtcctaccctggcatgcttgtgtgcatttacttcatcatccttttcgtctgtggcaactgtatcctctcgggagcagggtgcagaaaagagcttagggagggggtgggggaaagggcttaaaatgggggtcaagggtgtccagtttctaggtagccaggccctctggctggaggggagctcccaggcccatgcggtagggggtaggacatagcaaatgcaggtacagctgtaggataattctttgtgccaaaaagattagagactcacagggttgtttggctacagctgggaggaattaaaagcccagtaaggtcagtgagcctagagcagtggggaggaaggacagagctttgctgaggaacatgaagatggtgggacagccttctccaaaggttcagaggcaggcagggagccaccaggaccctgtggccgggatgatcagtctgagcgctgggaccagaaggacggagccagaacaggctgagagatgagaggagcagatatgagggtaaggtggatggggccggagagttactggcagtgcctgagccgtcctggtgcctgcaccttggaatgtgatactgtggggagtggggaggaagggcaccgttgttccccaactcatgtgtgcctcgcatgggtctcacttgttttgcctcactggctctccacgcagctcagtgtgggagctgggaccagtctggacaggaaacggatgggattcaaggccacaggattcaggctccttcctgggtactctcagcaggcaggcttccctgagggccttccactatgtccctggatccacaccttcccatgggtagctctgggagtggggttaggtcctgcccacatgcaggcagacagaactcctgccctgcaggctcccttccacctacaaccaaaggctccttagctaaacccgctcagacatcctgctcaatgtcttcctggccattgccgtggacaacctggccgaggcggagagcctgacttctgcccagaaggccaaggctgaggagaaaaaacgcaggaagatgtccaagtgagtgcttccttagcaggaagggacctggagtgctcagtcgtggccatggccttccagctctggacagggcctccctgtaacccaatgatcagggtccctgacatggtgacacccacctcagtgggcaaacttctgtaacctgcacatgggggtggctgagatccttccctgggggcaagaacagagacaagttggccttctggacagacaggcctcaggatgtagaatgccagagcctcagagcctggccagttgggcagggctcccctgcggagggatcctgggaattcccctcccaaccctgtcactgagtcgctatgcctctggcggggttggagttctacatcgaacaggctccccggtggtgcccatgctgctggttggaggattatgcttcaagtacctaggttctagacagagttctgcttcttccaatgcccatgcctacaggaatgggacacccattcctgtggaggcaagatggaaaaagagggaccagcaatggagttcagacatttctaaagagttggagccatcttgggcaaaccatgcttccactctatgaatctcgtataaacccagtacaaagccacactccacccattcactatcaaccaacgttaaacatggctgaccagtgagccaccggtagccatgggcccatgctgtgtgtcgggccctctcaccacagagaagggacttgcctgagcccactgcccttcccatttgggggctgatgccactcctcctacagatcccctggagcccttggtgtgggatcctcctgaaggtgttgtcaggttcagcagatccctgagaactttctggtttggcttccactttgggttttctaactcaggggtctcccagacaagtcagaagaggagaagtcaacgatggccaagaagctggagcagaaacccaagggtgagggcatccccaccactgccaaggtgagcacctcaggtggggatgttagaggcagtctaggggctcttccaatccatggttcccttcataccacagggtacaggtggggtagggtggggaggtaggagagttatcagccaggtgagggcatctccctgcgtacgactggagggagagccagcgaatccatctccagggactcctgcactgagaggcacagacctcccaatctgggaaccagacttctccagcgtagcagcttcccactccagaccaaggaggtatttcctctccctgacacccgctgttccactgagaggcccagaccggcttccaccattgctagccctgccctgctcattcccatctggctctgctcaccattcctgaaaactgaggaagtggagttcaaaaagtcagggaactgggcccagagaggctcgaggtcctggcctggggaagctcaactcccttctggagaaccaagcagtgggtatgtgaagatagagtcagacaggctagggcgggctcaggccttgccccgtgggagcttttgcaagttgtctggccttgctgggcctggcctctcatttgtaaaatggggatgatcataatattccctgttccttaggctgtagggatgattaagtgagctgaacgctaacaggctctccagtatatgctcattgaggggaaaccgcaacttctttttcattgttatagtcattgtgttccttcctacagctgaaaatcgatgagtttgaatctaatgtcaatgaggtgaaggatccctacccctcagccgacttcccaggtgaggatgctggagactggactggagcagggtgctggggtgaagtaggggtgtgccggtcctgaattctccccatgggcagtctcttgtgtgtccctacctgtacccctccatgtggagatcagaacaccggagacatcccttctgtgcaaataagccatctgccagcttgtctctctcaacaatgcacacaacagaaaaacccatacattttactttcatgtaactcagcaagtatttattgagtgccagctatgtgcctcactgccaaggactcagttttcaagaagcacagggacacgtgggtatacaagtcttccctgccagtcatgcagaatggatcataaatgaggacacgcccatatatgtcgtgatgaggcagattactcactatccagtgtccggtagggctgggggccggaaggatacagggatggatagaaccatggcaggcaatgtgggaaagtccaagaggaggaaacaatggtggggtagggggagcatggataagaaacaactgtggataaaccacaaacatctcataaatgcaaatagccagtgactgctgcagaaatcccatttatctggaccaagaagaggacaagcagaaccaggctgaattaatcttaccaggccacctggcagagccctggggcccaagaactctctgggtcctgggtcctttggatcaccgggtcagtggggcaattttagatctacttgtcccatcagctgatcagctacttgtatgtctacttatggaatcagctgattagcatctgtttgccccagtgactctaagctccagggggacttttgtgttccacacagcacagtgtttggctcagaggaggcactcaataaattgaatgaatgaatgcatgaaagaattttgcaaagtgaagtatggggagaatggagctggtacaaataagaataatgaaatttcttcaaatatctaccagcaatgaatatttgtgttttagaataactcattttgagttgtttcatctaacagttatcacctcttagatggcagtgacttgtgtgcaggtgagatggtggctgacaggaaatctgaggtcagggacaaggaaggggctggaaagaagtaaggagaggaggggtagagggggtgtgggctggacagcaggaagagagtcttaccaaggggactgaatgtgtttatatcctgcttctttctaaaaatagtttgaaatggcttacagcaaaagatatgtgcaatgaaattaacaaactgggcataggtggaggaagtaagaaggcgggggaaagatgcaaatatgctaactcgaagaattaatggtctctgcgattaagcgtgaaatgtgtctctggggtctgtggcaggctgggcaagacagaaagtgtcacgttaggacactcattccaaggaataagagttctagcttctcgggggaacagaaaaattggaatgtgacttggtggatttgagaacccctacaggtggccatgatggagacagtagaatccagtagctcttggcttccctcaaggcctctgccaggggccaggagggttagggaggaggtagctgtcaggggagggaaccaagagaaaccccagctttgaatagtgcccccaccgtctgatcacgggattctcccaccctgggagctgaggatttcgggtactcagcttcctcttgaggtcatgagacccagtgaatgtgcttggaatgtccgtctcttcatcccctatcccctgcctgcatcctggggactgggtgaagctcaagaaattctgattgcttttttccatgctggaagaagcttctctgtgaagttactatttttaaaatcctagcccaggagaggatcacagggtccttttatttcaacaaccctcctgccccttgtcggtttcacaaattggaaactgacgctaaggaagggcacagaccttcccagcactgcacagcaagttagacgcagacctgggactaggacccaggtctcttcttctgaagcagcgtttcccactccatcccccagcctatggatatttgaggctgtgtggatcgagccttgagacacaacatgcagccacaaagttacttgggcttgctccttgccccacttctggaaggttgtgggcttcccttacctacccttgacgctcaaatctgctcactgtgaagagaaggagatgcccgggctggactctgccaaagccctagggtcccaagtcagcctggtggtcccttgcttactggctgcaggggctcctaggagggctctgagcacagaagccatgggcatagcaaagcatgggaagacacccctaattcctctctctctccccacaggggatgacgaggaagatgagcctgagatcccgctgagcccccgaccacgtcccctggctgagctgcagctgaaagagaaggccgtgcccattccagaagccagctccttcttcatcttcagccccaccaataagtgggtgccccttggctgctgtgggggtgattgatgcggctctcatctgcttccctgccctagaaaaaaccctgtctgactctccatgcctacagttatactatgagaaactcagtgttttagcttaagatcttgtgccctgtttaaaatgctagtatatctgggaaaagtaatgctttaaaccttatcagttatttacacctaagagggacctgtttattggttcctttctgagagaagagctttagacaggtcaagggggagagagcaagggaagctatagtttttatcggcttcataattttacacctttaaactatacacaggccatagtctctgtggagtttcatctgtctgcctcatggatagagaccagcctgtcccattttcatttgatgggaaacctcagggtggtgccataattgcaggaaggggcaggtggtgggaggggcttggctgggaggaggaactaaggctttagaaacagagtgagaggtcagggccccctgtgtgtccagccagaggaccctgcaggtgcagggctgcacttctctcctggccagggaggagcaggaggtgtattccatgttcgtccgcaggatggaggctgatgaggcctgagcctccagcagctcacagctcccctgccctccctacctcgccccaccaggatccgtgtcctgtgtcaccgcatcgtcaatgccacctggttcaccaacttcatcctgctcttcatcctgctcagcagcgctgcactggctgcggaagaccccatccgggctgattccatgagaaatcaggtgacgggcttcaccctctctgccactcagcacccctgccccctccagcctcagtctggtgcccagggttcagctgtatcctctatgtggctacaagcatcagagtttcttagagttcagttcctcagggataggactgcccactccactccttctgaacggcacaggctggggcacagaatggctctgactgcctgctttatgctgctgctgctgctgatactgttgccccctcctcctctcactggctgctcccgcccctgccctgtccccagatccttaaacactttgacatcgggttcacctctgtcttcactgtggagattgtcctcaaggtgagtgaaggctgtggggcagccctggggagggagtttccctgatgtggctccagtttacacacactgaactcaggggctggagagaagcagaaaagaggtggagactggcaggaaagactcatgggacccagcacaccggcaggcccacaagtatctggatggagggctggaaagtaaagcccagccagcctgtggctcccccatccacagagtacagcccatgtcttgaagcctcaggcatttttctttttattttttctttttagatgtcgtctcactctgtcaccaggctggagtgcgatggcactatctcagctcactgcaacctccacctcccaggttcaagcgattctcctgcctcagcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgctttttcttccatacagttagcttaagagcagacctggtggccgggcgcagtggctcacgcctgtaatcccagcactttgggaggccgaggcgggcggatcacctgaggtcaagagtttcagaccagcctggccaacatgatgaaaccctgtctctactaaaagtacaaaaattaggcaggcatggcggcaggcacctgtaatcccaactactcaggaggctgaggcaggagaattgcttgaacctgggaggcagaggttgcagtgagctgagatcatgccactgcactccagcctgggtgacgagagagactccatctcaaaaaaaaaaaaaaaaaaaaaaaaaaaaagagcagagccggggagctgtgtgatttgtcatccctagacctctgttaacagtgactggaaaggccttttcctccaagagtccccagagaagtgactgctgccctgagctgggttcctggcagctctgccctatcacgccttttccacaccttatccacagcacgtcactgctcacccattcccaacacagatgcacggggttccagccatcctgggggtggtgggctctgggggcagaaggagaacccatctataactgaaacccagtagcccccgcgtgcacattcacaaactaagagaggagaagctagccgagccccaggaacaggctcagagcaggctgtggtgtgaaatcaggacagtaccttatttcggggcctcaactattgaaggaattgagtagagggagatggtggcttcctcgaggtcaagaagtttgtggagtttggggcacgagagccagaacttgaagttggacaggccttcactgggtagagatagctagggcggcctaggacagacagtagcaagtgcattataaggagatctggggacattgccagagaggataaagtggcccctttgggctgggatatattgcacatacaggaggcctgggtgccgagtctgggaaggcaaattaagacaaaatcatataggtccctgaatgctgggaaaggtttcaaccctgttcgattttaagggcaaaatgcatttgtgcaaaggcatgggagattattagagaatatatcaaagaagctgagaggggagcaagaaggcaggtgatgggaaggaggtggagagggaggagagagggcctaggacccctagagtcctggagggcttgttcagcctgacttagcaaaccacaaggcagaggggattgcccaagaagctttccaggaaggagaagttttatgtcccacaggagacagtagggccagggctcccccactctgtggccccatgggaaaggagacccagggttccctatggcatgtaaagaaagagacttctggcccagctgcccgtgagaagtcctcacatttcaacaactgcgagcagagataggaaatgcatttaggccactgcaaggagttgagtgaaatatagagatttctggaaggctattgcctcagtaagtgctctcctgagcagaggcgagaagcccttgtctgtgggagacaggcctgttctccaagctcctccatccaggctgctgcctctttctccccagatgacgacctacggagccttcctgcacaagggttccttctgccgcaattacttcaacatgctggacctgctggtggtggccgtgtccctcatctccatgggacttgagtgagcagcggcaagggccagccctgggcacagaccaccctctgctctgtgccagggctttgtagtgggagtcccacccatgttggtgggcccctgccacaagaggagggtctctcggggcctccgatggaggcagggggtcctgtgggttgtcaccagctggaatgtgggttgccaccagtgaagtgggcagcgctctgttctagagactggcaggagatgcagagaggaggaagtggtccctccctccccgaccctgtggggagcacagcccctgcctttggggtgctcaccgtctgacgggagggacggagcttctagccacccacaggggaaggctgtcttctgcttcatgacacacccatgagagcatggtccagatagcaggggtggctgtgccctggagtcgggcacactctcacggctggaggaaagggaaggggaaggtgggagtgttttcaggcagaaaggcagctggtgtggagggcaggatatggctggaggctccaccgcagactgggctggctggagcaggctgccctcagccccctcaccattgccgccccccaggtccagtgccatctccgtggtgaagatcctgagggtgctgagggtgctccgaccactcagagccatcaacagagccaaggggttgaaggtgagagagggcccgggcaggagccccagagaggaatgggaggggttacaggggcctcctcgctccagaaacctcagcccagccatggctgggacccctgtcccatctccctgggcagataggggtaaggatgaggctggggtagctatgcttccccaccagcctttccccacctccaactcatcaggaggcagcaagtcttgcactcctggggtttcctcaactgggctagcagggttactgtgggtgcacccccagtccccattggcccctctgtccccagcacgtggtgcagtgcatgttcgtggccatcagcaccatcgggaacatcgtgctggtcactaccctcctacagttcatgtttgcctgcatcggcgtccagctcttcaaggtgagccccagcctgcgcgagcagctccccctcccgctcccagccctggtgcccactctcaagcacaaggagccccacattgtgaaaacagatgtcttcgaatgcacagatttccatatgagaatattttattttgaaaaataggtcttcaccacaccaaacacataagtttgcagaaagccagtaagacatcgttacatttaaatagcaccttgagttccacaaaagcagcccaatgataatctcagaaacagtcaatgggcttctaacactactgaaatggtagcagagggtcatgtgtctactgagttgaaatttaaatacaattcaagccccatctcttaaagctattgtcatgcacttagaattctatcaaacaaaacaagaaaacggttagtttgatgtccatcttttaaatatgactatgaaacttcaatctataaatacaactctcctaaatcaaacttttaagagacagccatctttcaatgatggttaatagctttaagagatctaataagctaaaatgaaaacctgacagcaactatcttaagctcttttaaaaattaaatacacaagcaacacaacacattattgagactcaaagtgaatttgcttcaactgaatgcacagagttttaaggctaatatgtggcaagtccagatccagtttcctcagtgacatccatcccgggcctcttggttgactgctgaccactgttgccattgtatctgctctctccctaccccacgtggcttttccttggggagggaggcccctcctcccagggccccacagccattcttctcccttcccacccttgcccgcttcctcccatcctgccaggcctgtgccaagcatacgccctatcccagccccacactccgcctccgtcagtgcagctgggctgcggcagcccatcttcctggctggtatgtctggcatcatccacatctaccaggagcctctaaggctgggagttcatcatctcacatccggagccaaccttatacttttctcattttcctaggagaacacagctattcagttcctctctaggaattagccctacaaagatgtccctcacacaaaccctgatttccagatgtctctggctctcagatcatttgcaggacagagaaattgattcctaagtatacaccaacacccttgatacttcctgcatgacccagctgctcctcctatcaccaaagcacgatctttcaaagtcataattacataaccccagtcagtcttagacatgaaatggcatcatcttacaatcattcattcattcaacaaacatgtatggagtatgttttccatacttgagccagggcctctgctagagctgagggccttacaagccaaatcctcgctgagggcagggaacaggctctgagagaagcagcagcgtggagcccctagagaatcttcgcggggaataggtcttgttggtccctgtcctggagggacgggagggatgggagtgtttattgtgtctggccactctgccagctgcgtgcagccttctccccctggcccaactgagggctgtccacctcctgctccccagccccctcctctgccaagcttgggtccccagaatcccctgagggcagtgtctgtgtctgcctcatccctttgcctggccccctgcccagggcctggtgcagaggaggcccaccagacacgctccctgaaggaatgaatgagccgctgccctccctttggcttccacgtcccttccagacaagcaagagcaattgcttgtcaacacccaactctcgccatgcttttgtctctcattaaaagacccccagctcctgccttccaggaggttctagaagcataacagttccagttggcatttgatgtcgcttttgactctgtggaaacaccacgtgcattccacattatagcagagtcaagctttgctttccatagtaaactgggcatttggtgttaagtgcccagaccctgcccagtggcagctctatccactctctgcttacccccagtaccacccgcctcaccttcaccttctgctccagcaaccataaaaagggcatgtgataggaacagcacagatctgtgtggcaggggcagcggggggcaagggccagctgtgtcttcaactagtgctgtgtccttggccgaggcagtttccctatctgggtctttgaaggaactgcaccagaatccgtggatctcaagcctgatttagcctctttaagacctagccatcctgctggacgcggtggctcatgcctgtaatcccggcaatttgggaagccgaggcgggcggatcacttgaggttgggagttcaaaaccagcctgaccaacatggtgaaaccccttctcactaaaaatacaaaaattagctgggcatgatggcacatacctgtaatcctaggtactcaggaggctgaggccagagagttgcttgaaccggggaggcggagattgcagtgagccgagatcacaccactgtactcttgcctaagcgacagagtgagcaaacaaaaaaaaaaaagacctagccatccactactttccttcaaacatgttgctcagggacccaatctgagacacagataaaaggagtaactgccacaatgtgcacatgtaccctaaaacttaaagtataatttaaaaaaaattctataataaataatctgcaaagccttgaaaaaaaaaaaaaaggattaactgctctggccaaagtcagtgcagaggagcacagagcccccctacctgggccttgggctgggacatgggaccccgcttgactctgagacaagttgagtcatcagagcccagctgggctccaactctgctgctcccgccccactggcaggaggatggaggtgggaggtgggcagcccctcctccttgttccataatgggagaccacagaaggcctcctgcagcagtgcgggaggtaaggggctcagaggctcagctccccgagggaggggcaggggccaagctgcactcatgtccatcccctcagcccatcagggggcactcagtaaatgcccctctgaggcactgccttctcggtcttggcagcatctaggctgggtggggaagccctgggggagctgtgggaatgaacgatggtgaagaaaggaggctgctctggggccctgccccaagggcgagttcacgcctctgagaggaagagatgggcttgggctccttttttcagatgcctgccttccctccccccttccactgttcactcccagagcccacttttctatcctgtttccatgacaacatgcctccctccctccctccctcttcctggctgcaggggaagttcttcaggtgcaccgacttgtccaagatgacagaggaggagtgcaggtacatggggcagggagcacagtgggacggtcacggggcagggagcatggtgggacagtcacggggcagggagcactgtgggagggttacggtcacggggcagggagtgtggcaggacgatcacagggcaggggactgtgtgttggtggatgacggcccttcaagctggaaactggggaagctcagcctttaggcttaggagggacactcacagaggcccctttcctcggactcgcccagcggtgtccccttgggtcccagatctggaacttcatttctccttcacactccccacccagggcccagaggatgtgggtggggcaaggcagcccagccatgccctgtggagtgactgggcctccctgccacaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagtgagtgatggctggggcctaggtccctcatggacatggtcaggtaggaccaggcagccagcctgcccttctgcagcccccacggtgctactgctacctgtggcaggcgtccaacaaacccaccaactctctgatggtttgatggtatgttgactggtcactccaaagtaggcctgaccaggggtctctgacaaaatgcacgcagtcccccataggtgtatgcctctctgcccacagggcagattgttaatactgattgattagggatagatggggcaacctcttgaaaggcagggccattccaggattgggtctggtctttcctggcgccgacctaactcctgtcccgtaacttgattgttgagaaggctctcttggctctccacagccagtgggataaagcccatccttcccagcctgactctctgccttgtcaccccacccagtctgtcctctcttctctgcccacccccaggctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccaggtgcctgggctgcctgccagaggtggagggcagagctccagcaggcctcctgctggcccaagccctaggttcagccagggaagagaggcctaagggtgaccccagaacctgcatttgatgccaagccctagcctccatgcaccctaccctatctccaaactgaagcaatacaagttggtagagtgggtcttcttgtggaacctcatgatgcccagagaaaggaagcccttcagacccacagtctagtctatagcacccatgggaatgggctgtgataactcaaggggaacccaaagcccaacaggattattcccctaaacagttcacagtcctcagccacagcccctggccacagctgctcctgacttgcccgtcaatcccatggatgtgggtgtggagagggagggaggggcctcttggtgctgacctgtcctgttgtatgtgtcacagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcaggtaagggctccccaggagaaaaatgtctgatcagactgggacctgggccttgggtagggcaggatgagtagggcaggatagccaggattccccccagtagacatttcttgtgcactgtgtgctgaggtgctacatggaatacagaagtgaactgcgcacaggccttgtcaccaggcacttatggtttattaaggaggtaattcaagcataaaaatagtacggtaattctgcaaacaggagatagctaccacagaaggaggagaaagtgtgggaagtagaaagtgctttctctgtttttcttctgctgttgcaaatctggatggttgagttggctggaatcttggctctggtcccaagaaaaatgggtttagtatttgcaaaacagatgtctctcttgggagttgagcaccctttatagacaatatcataattagcagcatcgttatcaagcctcgattaagcatctgattccttaagccctgtataaataggatggtgtaactaggctccctgctcctagaagcccaagacacacccaatgataagaacacacactgctaggtcatggtgatatggaaagacaatcactgagccaggaggcccaggtcgcagaggatcatcagcactggcttgtgtttggggctgagtcaggcagcagaattgggcagtcctgccaaggcagggcagggtggaggcagccatcagatcctcccaaactacctggaaggttttgtggaagaggtagaatttcatccactttctaataaaagggtaagagatccctgggaaaacttacaaggaagtagatttaaggagggtcatagtggtaggtgacaggggcctcaccatcatgcctcataatcactgggggtggtgtgcagacacagtaagcttggtgagctctcagtttcccactagtagccagtgataacatggactatggaatccaggggtcttctttcccagtcctgtacccaaatgactaaacagaacctgttacagagccctgcctggacgacctgccatcctggtcctcccaaagcagatatgtaaatgagctttggccttgcagccctgcatgtaaatgaacgcactcagcaggacttggaattggagcccctccccttctgtgttatctcttttgtggtggtggggtagggggagggtgttcataaaatttggcggaactcaggggattgctaaagcagcttctagttttctgagctaaaacaaagtgagcagggggcccaagaaagggttgggggcttcccaggaagaggcaggggctctgggaatgcaatctacagggtgggcaaacccggcccccctgacccactgctcctgtgtcccctccacagcactacaaccagtcggagcagatgaaccacatctcagacatcctcaatgtggccttcactatcatcttcaccctggagatgatcctcaagctcatggccttcaaggccagggtgagtgtgggggccaccgggccagatgagaagctggggctggtgggtgggaccttccagtggaacatccacccccatccctcatcctatcagggctcctttgcccagcacttctgctcccaacttgctcacccctttgcccacttccaccttcagacacagggcaggcagatcttcatgcagccagaattgacaatgacagaaagactctgggcgcctcttccttggagcttctcttacattctcgcctgctctgaagtttctgaagaacagtcccagggctgggggaaaatcttgccttgtctctttcgttctcaagtccattgccatggttcccagcacagccctgtcagttccgcactgtcaagccccagataggatgttcagtggggttcaggggatgaaagagatctctatctggaccaggaccccaaatcctgagttcccaacaattctcccctcccccccaccactactttctgctctggaggaagggaactaaagagcaaaggggagaggagtgttggagttgggggagcccactggagcaccagtgggaggtggagtcatgggcaccccaccttggcctaacccgcagctccgcattagctcgggtgggacactgtcctctgccagcagccagagctccttcctcccaaagctcaccccctcgctttcccatccttttccttcccagggctactttggagacccctggaatgtgtttgacttcctgattgtcattggcagcatcattgatgtcatcctcagtgagatcgacgtgagtatcaggcaggcagagccatcactagggtgggcccaagagcatgtgttcaatccacagatatttgtggggtgcccactgtgtgtacaacatggaaccccaggggttaaaaagatggaatgacaagtcacggcttctgccctcaaggaactatcatcctgctgggcagagaggtaactcagataccagggggacacaatgggtgtacctactacactatcaaaggcaagagctgtaacggaaaggaaagtcgtctctgggtggggtggtcagagaaggcttcatggaggtggtgccatctgcctgaaggaaagggaggtggtgactggagctggagaggagagcaagcacctcaggcagggctactgtaggagaggcacagcgcaggaaatgcaaagaaggttcagggcatgctgagtggtccagtttattggaagcataagaacatgcagagaagagaacagagagggcaaggctggagagctaagcggtgagagtgggcttcagctttatggagcaggcagtgggaagtcactaaaggtttttaaacagggcagtgggaggattagagtcctacttcttttttaaaaaatatgtttttgaaatatagagatggagtctcctcgtgttgcccaggctggtctccaagtcctgggctcaagtgatccacctgcctcagcctcccaaagtgctgggattacaggtgtgagccaccgcgctgagcccttagagccctgcttctaaaaagctaacctggagatgagcaacaggaagtgaggatgactaaaattaagagacccagttagaagactcactcatttatttctcaaatatgtactgagtacctcccatgtgccaggcatgattcttgctgcctgagatacagcagtgaacaaaattgtggaacaaactggcaataaataaatcaatctctaatatgacaggtatgacaagtacatagtattatacagaaacataaagggagttagaggcttagagtggaagagaatgggagggtggtgtccatatgacactggagcagaggcctgaagaaagcaagggcatgagccatgccagaacgggggccagagtgttggcagaacacgacagcagtgcaaaggccctgcagcaggatggtgcttgctgagtttgaggaagagcaggaggcccttgtagctggaggagagagtggtggagatgaggtaagagagagaaggcaggggccagatcatctaggcccttgaaggccatggttatgatcttggattttattctgagggagatgagaaccctttggagggtttaagtgtgaacagactttagttctaaaacaatcactgtggctgctgtgttgcgaacaaactaaactgtaggggacaagagggctgacccagcgagagcagtcagggggttcccgcagtgatccaggtgagaggcgatgggggccggggctggctgtggaggctgtgagaagggatcagtgtctggatctattttgaaggttgagctgacaggaaggctcccagaatctggaccaaggggatgagggtttggaggtggaatgagaaacagcagcaggacctgccttatgaaggggatgaaaggagcagggaggcagttccagccagagaggtccacattcaagaccttagaagccgatccctccagaggctgccttgccaggggtctgtagctgaaggttgctgcaacgaaggagggtggagaagatccgagagtcagaggccaaaatcaaaaaacagttgcccaagtggcatcctgggagggacacagtggaaaagagagaaagatgagcattcttctttctgagccatggtgggatgtcacccaagggctggctgatctgaccacgagggatcccagcaggggactggtcccaaagctaggggctcacccatgcatagggctttcttctgaactgcccactgctcaacagaaagcccttaggctgtgccagcctgtggggtgaaccttagggtgagttgggtataggggtggaaggatcagcactggggatgcctgaggtggggtgtgggtgagaggaatggctgaggaaaagtctggagtctctgaggaaggagccctcagctgaggctgagctctggcagggagtagggacttggctgtcacatcgtctgtctgatgtgctaggggagggccagggtgggaaccctgttcaccctccatgcacagaacagacggtgacagacaaccccatctgctcagatcccctgggggcgctgagctagcgaggggcagggtgggctctgagcaaaaccagtgtgtgtgtgtgtgtgtgtgtgtgtgtgtgtgtgtgtctgtctgtctgtctgtctgtgtgtgtgtgttgtgtatttccatccacactcagtttttgctgggaaatagtatcccaaaagcctccatggtttgacagcagcacttctcaccagcacagccagaacagagaaatctaaacagccaaaataaacagcccaaactaaaaatagttacttcttaaaatctgaggtctgtgtagcggaagcctggatatatcaaaacagtgtctttggtggtggaggccaggagggtgtcactggtttttatttgatttttagcagatgtcccttaccagtagtgtttgcttaaagtcacgtgaagattgatttacatacctgatgtacaaaccagggaaaggactaggggagcacattggttagaactttctgcaaggacagaaatggtctgccctgtccaatagagtagccactagccacacatgtctacttgtcactggaaaggtggctagaggaactgaggaaccaaatttctggttttattcaattttcattgtaattcaaatagtcacatgtggctaatggctaccatattggatagcacaggtatagaacactggtcgtcatccttgcttgcatatgagaatcacctggggtgcatttaaacttctgaagccaggccccatcccctagaagctgacttaattgacctaagtgcagacccagcaaaggtatatgtgtttttcgagttcttcaggtgattctgacatacagccagggtggagaaccagtggtccagggaaaatctgccccagggaaaatctgttgtttaatgagaagaccagtatgccagggatcagtctacctgtggataattggaagataaaacaatgacttcttttgacccagggctgcagaacaagggcttctcatgaagtgtggcccaagggagtaaacaggaagaaattgctcccacacacctacccacctgctcttcaagagcccgaatactgagatagaagccttggtcccaggtccagtcctggacagagaaacatctgctgtggggatttcagactcccccagaggagctgtgcccctgggagatgggacttccacaggggcccggaccctggcctcagggcactatggatgtgaatccatttacaatgagcaggcatcttccaatgcgccttcattagggacgtccccagcatcacataacccaaacacataagaaaaacccaaacccttgccacccgtagctgcatctccaaaatgagaagggatctgtctgtgtccagccttccctccccttcttatttccttgtcccccacctcttgcctcacagttcccacagagcttcagtcctcactcccacccaccccgcccctgattggcagccatgtggggtctttagcccctgcctctttttctctttaactcttctgtgtgtctgtcctttctgacacgtctcttcacctccctcccacatgtccctcctcctctctctcctctccttcccctcccttcgtctcttttctccacagactttcctggcctccagcgggggactgtattgcctgggtggaggctgcgggaacgttgtaatttcaggctgcacgagcctgcctggcacgctcaccagctcctgccctgccacttgcatgcatgggcctggctgcgtggattgcatggggtggatcagcactcagggctccctccccagggcaggccctgctgaggacccaggctaggctcgggtgggggcagaggctctgcagtcaagtgtgcatggatatagcggcttcctcagagccctgggagatggagtgcgggttctctctggcaccctctatgcagatggaaacacagtccagagagaactgtgatcgctggcaaaggaccttagtgacagttcattgggcacaaggcctttgaggacacaggaagcagagcaggggcagctctccccttccagagtatttcgtgtatctaaggctggcacaagattagaggcttgcctggcttagaacagccgtgtgcagggtgggagtgatggggagtagccacattgagtttgtggcaatagagcagccaagctttgggaaatctttgcactgggaggacgccaggggaggagccctaggagggccaccagggtcctcgactcagtggcagcttgaggagattgtgagatgtgcagcaggtcccagagggcaggcagtgggcctgggtgcagccacaccccagggcaaatccctgccactgctcccaagtgtgggcttcaccacgctgcctggtgccccacgtcctcttccctgcctcccagctgaacagccccagagccctgtgcccaaggatggtcccgaactagtggacagcaggggccagaggcggggctggagttcctccatgccacaaacatctccccaaaacacacagtgcacctccctccccgccctgccccttacccctctgaggttctgcccccagactgacctctggggctgctgccccgcaggacccagatgagagtgcccgcatctccagcgccttcttccgcctgttccgtgtcatgaggctgatcaagctgctgagccgggcagaaggagtgcgaaccctcctgtggacgttcatcaagtccttccaggtgcaacagggaccctggaaactgcacgtacctggggaggccactagggacatctgcctcagcccagggtgggccccaggggagccctgggcaaggcagagccctggggagctaacagagggcagggctgcagacacacagtggagccctaagacactgactggcgctcccgcccgccctgcaggccctaccctacgtggctctgctcatcgtcatgctcttcttcatctacgctgtcatcggcatgcaggtgagaggcaggcgggcccaggccaaagcatggatcttggccaagttagagggggcatcagtggaccctgaggagcctgagcagcacacgggctggaccctccgccctccctgccttgctcgtgagaaagaaggagggacaacctccctgatcgtggatggctggagtgtcagatgcttggatgccagccaggagaaacctgggcatgtgggtggacagcaggggccaggctgtctctctaaggcctgactggagccctgggtggcctctgtctaccctcccctgagagcacttcccccacacattgacttaccgggtctgcttgctgctgggaaaacgggtctaccctccctcttttctttggcttgctaagaagaactttacctgatctagaaaataatcccgttttttttggcttcaggtctgatgtggcccgcaatgaagggaattttggggaagtaggggcgaaggtaggggtcaggcaggagaaggcagtgggggataagctgaggggacactttaatctaggttccacagtcagggccctttgtgacttgcagatgtttgggaagatcgccttggtggatgggacccaaataaaccggaacaacaacttccagaccttcccacaagctgtgctactgctcttcaggcacgcgtctcccgccacccccacccctaccccgctgaccagtccagcctttgctctgttctaatgtgcactggagccagggctggcttcatgggtgtgtgacctgtgcagccacacagggtcctatactcagaagggtcccctgcttggttgcatgctctgccgtcactgccttgaagatattcatcattttgaacaagtggtcccacagctttattttgcactgggctcctccactgagtgaagtgctgcattttcctcccatctcatccccatgaagcaagagacagaggtcagatatcttctcccggacatttgccctcgtcgctcccagagcatgagcaggaatgcagggaaaggcagagcaaagctccagatggggtggggggcgctgccacaggtagggcgcaggggcctatgcttggccagggcacaggagctagagcttggattgcaaccgaggatcctgggctgcaggcctgctgggcgtgcaggagccaggtgggagaggtgagcttcctggcccacagtggaatgctctactgagaccagacaaggcctagggacacccacacccagggccccttcttggcacagcgtgtcaaaggctccatgaggtcacagcagcctgcagcccttatggcctgtgaaaaggagaccggcacctcaccgtgtgcaggcagagattcccacctcgccccagctctgcacctcaactccaaacccgaggccaccctgcactgcctgctctaggaaggaagggagctagctgaaatgagacagttattagacacaaaggagtgggaagttatgtagtctggctgaatgtgactagaggagacacttcttcccagctggagaggtggagggaggttatctacagagcaggttgtagcagttactggaaaaatgcaaacatgtcatgcatatgcacctcggatgcattgagattcttcattcaacagcgacacatccacaaggtgtgaaatctaagggctgcttttgtgactcagccagagtgggtggcagttgaattcagccagttgggttcaactgtggggttacctcagagagtggagtcagttaatctctttgaggcctctgtgacatctgaccctgccttgctttggtcagaacagtgcatccctctagtaacttgaatcagattgattttgccctcttctctaaagtttagctcctgcttgtaacaccccatgagggctgcagcacagaggggaaactgaggcccagctcacactgagctacacagtgaacatgaagatctgacctccttaccattggacaacagccccagtttgctcatctgtccacaccctgctgccacctgactgccagccttctgaggggccaggcaggagcagataggtgacaggagcctcttctgtcctctaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtgagatgctgagggcctgcggggcagggagagggctttgataagctgaggcatgggggagcctgcctgccccttcctggccagtttccacctctcctgggattcatctcggggacgcaggaggctctagttaggttgtcccccattctggtcatcctgagtgtggctttgtttcctgggtgctttttcatactccagagaggctgccaaaagttcttactttttttttttgttttggttagcactcatcaaaaggaatttagcaaggccagagagcactgtctgtgcaagagcacagagacatgacagagcattgctgtgtgtgtgatgtgggtggttcagaagggctagaatcaagggcacaggaagcgagaagttgtgggccagtggacacctcccagctcccccaccctaaccctgtaccacctgcctttctgtgttgggaccccttggttcttctcttgcaggtcatcaacctctttgtggctgtcatcatggacaattttgactacctcacccgggactggtccatcctgggccctcatcacctggatgagttcaaggccatctgggcagagtatgacccagaggctaagtgagtccaatctgtaggctctgtgctgggccctccatcctagacccttcctaccgtctcacagggagtcactctccagtttattcagtatgagtgggcttctccttcccccttcatttatctgaggtctcagatcagagaatcagagtatctccaggttggagggaatcctacagctttccggggtggaaacacccttgactttattgagaaattgtcatccagctcctgcttgaacactcctaggagtaggaagctatatacctcaccagacactctagaccccaaatcaaagtgcggtcctctgaccagcagaagctgagcttgattaaaatgcagagtcgcaggcccctcccaggctgactgaatctaactcttgcattgctctgaacctgagccttgggacattcgtatgcatttaaagcttggagagcacggctctcttactttccttcccgataggaaataggcatctcccgatggtctcagtctcagatgaggaaactgaggttcagagaggttaagtaagttgccccagtccatgtaactggtaagagatggtgccaagatacagtgcaggtctgtttggtgcctatagcaaccgtgctttaaagtgcctccatcagcaggagccaaacctacttgcctctaccagccacccacaggtcctcattcagccctctggagacaggcggggaatgtttcatctctttttcgcagcctgcccatcaaagaaaagaggaagccagtaggactttccaaaatgatttttctcaggcaacactcacaagctgctcttgccatgcttgtcttttgatctgacctccctggttgttctgttttatgtctattctgggagtcacggtgccaatgaaaatgtggtttccagctctggaccagcctctggaagtgggcttccacctcctttgatctacacccactacttctattaatatagcccaagggcccctattaacttgaccaaaacctaagaaagatactgatagggaaaatgaggtctggattccagacctggttatcccatatctgagggaatgcgccaaaggagagagcctattttggggtacccattttgtagacaacagttaatcctaacattgtctcttcttttaaaagggagctgggctcccacttcctaaacacagttggaaaataaggaaatgctcccctgtttcctggctttctttcccattgcccatcctctgagcagaaaggttctggcagcggaggagggtagcaggtacacaagtctgtgtgtcctcccgcagggggagaatcaaacacctggacgtggtgaccctgctgagaaggattcagccccctctgggctttgggaagttctgcccacatcgggtagcttgtaaggtaaccagagctgccagggatgggtggccccagggaggggaagagtcactgaggcagagggaaactggtgaggacctgatggagtgaagcattgtagagccgggatctcctgggtccccaagttcctcccaaagggcctgaagtctcagcaatgtcacccaactcatcattctgtcccctcacaaaggatgtcctggtcagctgacacccccagccctcgtgtcccgtcccctcccggtccacagaccgggtgaggatgacttgccaagcttggcctggtcccagctcagcggcaggccactgcgtctccctgtacagcggctggtgggcatgaacatgcccctgaacagcgacggcacagtcaccttcaatgccacactctttgccctggtccgcacggcactcaagatcaagacggaaggtgagagtgccttccaatgtgagccccctcctttctcccagaggctgtttctggcacagattctgccagattctcagagctcaagattgctcttaagaactgtgggaagaagtagagggaggaccccaggccatgggcacaaagtcctcatgcccctcagggctcagagggagcctgagggttttctgcagggcaaagatcatcaagggtctgttcccacactcctcagctgtgtctgggggccagagaagggccagtgctggcacaggggtcaggggtgccctgcagtttggctgtgagcaggagcagaggaggttctcaggcagcactgggcaggctgacgggagtccacattcgactccactaaatctgcaggtcctcacctactgggaagacaagcatggtgggagcaggggaaggagtcagggtggggtctcagtattgtctctgagcccttgctcagggctcacactgtatcaagctcaagtctccagctgtatcaggtccatccccacatggggaccactccaggagtctgagacaacctcagggtgagcttcattagcagggcaagatgaggaagaccagaagtcaggaaggagcaggttagagctgcagcaagtctgcctgggggtatttgggccagaccacagtgcctggggaattgaaagattttggaagaagagcaggagatgacagcctgtaaaaccaaccactctgggcactggaagccaaggcctgtggggagaaagtacatgacccaagagttgggctgccccagggggacagtgatgccctcccaccattgccagtacccagcaaggcagctgccacaaaactcagccaatgtttcttagtaaatgactggctgtctgaaaggttcagaaagaactgggtggccttgtcaagtgcagttggtgtgatctgggtaacttttgcctttctcctgctccaggtaactttgagcaggccaacgaggagctgagggccatcatcaagaagatctggaagagaaccagcatgaagctcttggaccaggtcatccctccaataggaggtaggtgctactttgggggaccagagtccagaagcagccaaggaatgggagtggggagcttctccaaggagccccatgggaatctgagaacggaccagatcctccataaatgccttaggtagatcccacgggcatccaacctcaggatggaaagtgcccagtgaccaagtcagcaagacaaaggattgcttgcatgcccgggcctggctacagctggctcccactctgaatccagtgtcagattcccactagccttcagggcatctcttgttggctcctctgcagatgatgaggtgacagtggggaagttctacgccacattcctcatccaggagcacttccggaagttcatgaaacgccaagaggagtattatggctatcggcccaagaaggacattgtacagatccaggtaagcccaatccaggtatgttccaaggggctcccccactgagccaggtctccagactctagttatccttccatgtccttgaggggccaatgatggagacatagagggaaaaaggaagcccagaagagtgaaaaaatgtcaagacagttctgggtagtccatgattgaagatgtttcaacctcaaaaaaagaaccagggcgcttcatctctggatgataggaccaaagaaaataggatttgttcaagggagagacaagttagataagaacagtggtctctaggccaggcgcagtggctcacacctataatcccagcactatgggaggccaaggttggcaggttacttgaggtcaggagttcaagaccagcctggccaacacggcgaaaccccatctctaccaaaaatacaaaaattagtcaggtgtggcggcatgtgcccagctactcaggaggctgaggcgtgagaatcacttgaccctggaagcggaggttgcagtgaaccgagattgagacactgaacctcagcctgggcgacagagtgagactgtgtctcaaaagaaaaaaaaaaaagaacagttctctctaaagaaaggtgatccatgaagggctcttaaaatgttccactgggtatgggtccaggtgcggtggctcacacctgtaatcccagcgctttgggaggccaagaagggcggatcacttgaggtcaggagtttgagaccagcctgggcaagatggtagaaccccatctctactaaaattacaaaattagctgggcatggtggcatacgcttgtaatcccagctatttgggaggttgaggcgggagcatcactggaacctgggaggcagaggttgcagtgaggtgagattgcaccactgcactctagcaagggtgacagagtaagactccatctcaaaagatagataaataaataaataataaataaataaataaataaatatgtcccattgggtgtgaaaagaaaactttagaactttttgttttatcttatctggttttatttctatttttgggttcactgtaatgcacataatttataaaacccccaaatacacatgcatttgagctgtgctcaaaaatttatttcaatggctatttttattttgaaataatctcatacttttaaaaagttgcaagtataatataaaacctttttttctgaaccatttgagagtaactccaaaatgatgttccatcatccaaaaacactttaatgcatatttcaaggcattgtgtgtattcaaggcaaaatgtgtattacaagggcgttatcctgcataattcttctatgtaaccacaacataaccacaaaatcaggaaattaacactgatgctttttttttttttttttttttttggagacaagagtctcgctgtcgcccaggctggagtgcagaggcatgatcttggctcactgcgacctctgcctcccgggttcaagccattctcatgcctcagcttcctgagtagctgggatcacaggcacacaccaccatgccaggctactttttgtatttttagtagagatggggtttcgctatgctggccagactggtctcaaactcctgacctcaagtgatctgcctgcctcagcttctcaaagtgctgggattacagacgtgagtcaccatgccaggctaatacattactacattctaatcctcagaccccattcaaatttcatttgctgtcccagtaaatgtcctttatagcaaaaggatccaatccagaatcagacagtgcattgagttgccttatctctttcatctcttccatctggaagagttcatcagtctttccttgacacgatcttgacacttgaagactgcaggtcagtatgtccctcagttggggtttgtctgattactaggatatgcatcttggataagaatgccacagaaatgattctgtgttctcattacaagctattaggtgacaccagtcttgacttgtcccattactggtgatattaactttgctcaactatatatatatgacatatccaatcaataaagatcaccaatctagaagactgtactgagtaagaacacttctcaacctggaagcctgggaagggcatgaaatttccacccatggggtcaagagatgactcaattggaacaattaaggtgtgggctatcccagaggccagagcaggacctggtggcctctcaggtacctgagatattcaataacccaagagggagagtggggcctaggctggggctttgggagagccctgggtacagtgataagaaacaagtaagccatacgaagcggttctagccaggcacggtggctcatgcctgtaatcccagcactttgggaggccaagtgggtggatcacaaggtcaggagtttgagaccagcctagccaacatggtgaaaccccatctctactaaaaatacaagcattagcagggagtggtggcacatgcctataatcccagctactcaggaggctgaggcaggagaatcacttgaacccgggaagcagaggttacagtgagctcagattgtgccactgcactccagcctgggcaacagagtgagactctgtctcaaaaaaagaaaaagtggttctggtctcctctcctgggctggagagataactgagtcccttcgtcatccccaggcagggctgcggaccattgaggaagaggcagcccccgagatctgtcgcacggtctcaggagacctggctgctgaggaggagctggagagagccatggtggaggctgcgatggaggagggaatattccgggtgagggagagccaggagcacccctagtggtctagacaccatgagtggcagtgtctcacagagaggagggctgggagcccagccacacgagagggggacatgggagctgaagataccccactccgtctctccacttcaccacccacctctcctgggactcagaatcaatgacctgatctactagaggtgtcaaatgcaacacactctttcccacatttccctaccaaatctcaccccttccctttcctccccacaaaccctaggcaacgacccatctcccagaggccctccaggatcaaatgccctgcctgcctccactgaggccagtcctccatccttagctctgtctcatgtttcttataacactttattgctggaaggtctttaatgacacctagttaggtctttttgggttattcatgaggaaatagtggcccacagagatcatgtgagatgtccaatatcacctagtaaatcagtttcagagcggggactagaacccagtgctgcagactcccgattcagccctctctcccctacaccacacttctcttctgtgtgcctgtgtcccctatatacctccttaggtgtgtgctgtctaccccatcaaacaaagaactttctaagggtgggaattttcttcttttgatctcaccactcagtccatcctcctttggccttataagatttgtctcccaatactattgcttgttcccaataccactgtcccagagtgacagccccccatgccctccctgccctcacccccagtcactgctcttctccttgcccctagaggactggaggcctgtttggccaggtggacaacttcctggaaaggaccaactccctgccccccgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatggcaacagcaaccatagcaacagccatgtgttttccaggtagtggcggccactgccatccctgggtgtagaggtactgggaggacaatgtcagcaggttccaggttggattggaagagggtaccccaaatttgtagggtgtcttttgcttgcctttgtgccccaatccatcctgaaccttaatgtaagaggccgacctcgatggcagaggcttctttggccagcagggggaagcctcacatcatgtcagtattggccccagtgttgagaggttcttttattccgtcggcttcagcaagtctaggagctgagacgtattgaacacatgataggttaggagaggatcttcggtggtagcacataccacaaaagactgtggacaataagattccatcactggatttaggttccaaggagatcccgctgtgctgggtggttcccatctcaccaaccttgggctgtagactaaatataatctgtgattacgtaagtgtcataaaaaacagcaggatgagggggagaacttctcagcaatcataacttaggggctaggctcaggcaaagcttctgttctagacaggaggtcagctgattggaggcctcttcggcctggaaaggcttagccccaggcctcaggaataagcagaacaaggcagcagccagccccttttcatggccagggctgcctgcaccccttccagtcacagagaccccttaaattcagcccacaagccttgaagggtgcatgtacctttttgggtcaccatggtgcaaggtaacgtggaaatacagaagcatcagccctgggccctgccctgaagggggttgtcgtcttgttgggtgatatgttatgtgatatgattgggaccaaataatcacagaggccaggagtggtggctcatgcctgtaatcccagcactttgggaggcctaggcaggtggatcacttgaggtcaggagttcgagacctgcctggccaacatggagaaaccgtgtctctactaaaaacacacaaaaaattagtcaggtgtggtggcgcatgcctgaaatctcagctactcgggaggctgaggcagaagaatctcttgaactcaagaagtggaggttgcagtgagctgattgtgccactgcactccagcctgggtgagagaacaagactccgtctcaaaaaaacaaaacaaaacaaaacaaataaacaaaaaacaccaaataataacagatatttagtgtcctgagagtgcagagggggtatggatcaccatgggctggaaagacctagaatggttctcagccttggctgtgcattagataatccagggagcttctgcaaatcccaatgcctgggcctcaccacagatgctgggtgtgggactcagccaccactcacctttgagctcctcaggtgatcctatgtgtggccaagatggagaagcagggttccaaaggctgggaggctgcagctgggccttggaagatgaacagaatgtagaaagggtagagggagcaactgagcaaaggagtggagtcaggaatgctctggactccttcctcctagagagtcagggctggctggggcacagtggtggaaacgtcagccctagagtcacggctgctacactaggttggccttgtacaggctctgagggaaaaggatgtttggggccagagaggcagggatgccgagagagctagcagccttctctggttcacccagccttgcttccatttcagtgtccactatgaaagggagttcccagaagagacagagacgcctgctaccagaggacgagcccttggccaaccctgcagggtcctgggtcagtcccttctgtgcatctaagaagcttgagtcttctcccagaggagtccgggaagccccactcttttcttagagtctgggaacttggctgggagggctggcttgggagcctgttacaatggcagtcatctgggccctggaatgggaaaaccatcaggaccagctacttgtccaggggggaagcagggcaccatctaggtggctgagtgaggtggaagggggaaagcccattcatgctaaagggccctctgcaggcctcccaggaaactcacacagccccctacaccatccccagcacaggagtccccacaccgccccaggtccctggaagggcagcccctggacacactgacgtcttgactctggggcccttctgcaaatgatcttgtagtctagtatgtcctagactgctgtgtgacagtaggagccccaaggatgctgggggctagtggcaataaggatactgctgtgttccccaacacactttcactttaatgtgcacacacccagggaccacagaggaccagcttggccagagactctggcccttatcccctctcccaaaccttcaagaacagcgaccagggccagtaaagttggggcagccctgcctggcctggagttgattgggcctcatcatgtgtccaccctctaagacaccttctgcagccctgagaatctcagagctctcacagagtgtggctagccagccaagcgagcctctgttgactcagggctcctggcaggagtcagcagcccctcttatccttgccccttcttgcatacaggaccccacagcaaaccctgtgtggagatgctgaagggactgctgacccagagggcaatgcccagaggccaggcacctcctgccccctgccaggtaacagtggcagaggcctgggagcaaactccatacagagaccctgcctggcctgatacttggagtgggatcatggcaggggaaggctgtggcagcaatgtgtccaacagtacagaagggacgggatccctccatcctcccctttctgtggatcttggttgagttgccctcagatgatctggaattttgctcattggtgggctccagcacccctgtcggggtctttgcttttgtacctttggaacagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggtgagccaggggctgggtcacagcagtggctgcattgagtggtggccctgtgatggcctggcgtggagagagggtagggccaacagaggcaggtccccaaatgtggctccccaggaagaccccactcagcctactctcctccctgcaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggcaactggcctctgcttgtccagttttttggactcttctacacctgtgtttccccctccccagtcccttccccaggaaccctgcccatgggcttgggagactgggctgtggagaaagacagaggggccatctggattatttttctgcatgaggcagagagggacctgttgtgggttctcctgaagtccacagccaagtccactgactgggaccaagcagccccagaaaggactggtggtctcagaagcagctgcacaccccaggtcacaccatggccaaacatcttcgaagctacgaccatgttgcattggccagagtccactgccaacacaggctctcagagccctcaactgccccctgtttattgccttgaatatcaaagatctacattctccagggctcctcttagccacaccaagtaactatgagtaacagtagctactatttaccaagtgcctcctgcgtgccacctacacacctgctctcatgccaggggctgcaatacgttgtttacaaagcaccttcatgtacaatattcattttattgccaccacaaccatgcaaagtacatgtgaattccacgttaaaaatgaaggaatggaggcatgcagaggtgatgggacagccctggggtgcacagccagaggcaaggtcaggactctgcaccgggccctccatgtccccacagcatccttcccccttcactggactctttgctcttctcgccattccatcattaagcctgtgccaagcgcctgctctgtggctgttgctatggaaaccaagctggcctccccatgcagcctcctagcgaacccccagtcggcttctgggcttctcagctgggcctagggtatcagtcatgcagggcagggacgctcgcactcttaatgcactatacgtcccttcccccagtctcaacagggccccaatgcttcctagtccctgtcagtgcagcaatctcaacgcccttctctcctgaaaccccaacaccagcagctagctttgctcccttcacacacacaaaaaaatatatagaagctaccagaaggttcctccctcagctcctgtctccacactgatgaacccacctgtttctgctgtctcattctcctccttcccttctgacccagtggaagccagttctctcctgccagctgctcggattctaccccagcccttatcccctctctctgcctctccacaggccccttctagctgcatggaacacattccaggtgcctccctcctagcagcctgaccctgcagccatcctatttccctatttctgtctccctctctgtttttccattcatccatccacccatccatccatcatccatccatccatcatctatgatctatcttttttttttttttttagacagagtctcactctggtacccaggctagagtgcagtggcatgaactcagctcactgcaaccttcatctcctgggttcaagtgattctcctccctcagcctcccgagtagctgggactacaggtgtgtgccaccatgcccagctaatttttgtatttttagtagaaactgtgttttgccatgttggccaggctagtcttgaactcctgacctcaagtgatccacccacctcagcctcccaaagtgctgggattacaggcgtgagccaccactgctgactgaggaccaaacttcttacctgggtggtctccttgtccacatttctatttctccttccattctcatttctcctctctaggcaatcctcctctgccccatcgcttctctggaaacacgctcaccaatgtcaccaactatctggttgctaacccagtggactctcacatctttacattacttgacttctaggcagcatgagatacaatttagcccgctccctgcctgaaaatcccccgagtgtcagatctcctgaatttcctcttacccctcgagtgttccaacttgaagcttccttgggagttcccccttggcctgcctacttctcaggtagactctgtct

SEQ ID NO: 17483 - DNA, 27825 bp, Human
atccaaaaagctctgtaaaccaaaagtttgggggtaaactcatttggtagcaaattttgacctgaggctatttatagtctatattctgtattctttctacttagtatgaataagcatgtaagttttactgcatgtttgatttcagcatgttcccccagactctctgggggtgtttacgtatgccggtgggggaaagagaccaactctcaaatattatctcaaacagttggtttcactgtgcttgcttgggtagcacatataccaaaattggaatgacccctgcacagggatgacatgcaaattcgtgaagcatactgtatttttcttagcacataccacctttggcaatattctttttttttttttgagagggagtcttgctctgtcgcccaggctggagtgcagaggcgcgatctcggctcactgcaagctccgcctcccgggttcacaccattctcctacctcagcctccccagtagctgggactacaggcgtgtgctaccacgccaggctaattttttgtatttttagtagaggcggggtttcactgtgttagccaggatggtctcgatctcctgacctcgtgatccgcccacctccgccccccccccgaagtgccgagtgctgggactacaggcgtgagccactgcgcccggcccccgccttttttttttagattgattttattacttgcctagcaaaggagaaccttctggcagaacagtctccaagaacaaggcaaacaactaattttacataggtttttaccaatgtacagctgttgattgtgactggtttccggcaatctggatttcacaatctggataaggggacaaacaattgtctgtcttccactatctttcttgaatttgaatagaacctttttattctcatagcctcttagctttctttcttttttttttgagacggagtttcgctcttgtcgcccaggctggagtgcagtggcgcgaccttggctcactgcaaacgctgcctcccaggttcaagttattctcctgcctcagcctcccaagtagctgggattacaggcgcatgccaccacgcccggctaatttttggatttttagtagagacgggggtttcaccatgttgactaggctggtcttcaacgcctgacctcaggtgatccgcccgcctcggcatcccaaagtgctgggattacaggcgtgagccactgcgcccggcctctcatagtctcttagctttctaaaatttgaaaaatcctgtaaagacacacctgggtcaaagggctcagataacggactgtggcccttaagtacttacgtcacaggttattgagaggatcgatttagttaccagatgtaaaatgctgggatcagtgcctggcaaaggaaaactttgtacagctgcaggctttcaccatacacaacagcatcgctaacgaatgctattacaatattcatttagcgtttaccaagtgcctactctatacaaatcttgagaatacaacgtgaaggtgaactgctgactaaagtttggtccctttcgctccgtctccttgcgaaaatgctctaacggcaggaggtcacgcgagcgctggacgcgtttctccccgcgagcccctttccgaggcctttcgggtccccccggttatccccgcccgggcggtgcgcgcccccgctgttcccgcttccgctccagagaggcagggctttccgagcctgctagccccgcggccgcaactaaccccgggtcggagtgttccggcccggccagccccgcggcgtgagggaaggggagctcagcagttccccgcgcggggcccaggcgtcggcggcagggcgggcccctcaccgccagcgtgccagccccgcccctacccaccagtgtgccagccccgcccttccccacgtcgccgcgcgcccgggggcggggcctggcgcgcaccgcccgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacggggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgacttttaaaaagagatcagtaaggccaggcgtggtggctcacgcctgtaatcccagcactttgggagactgaggtaggcggatcacctgaggtcaggagttggagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaacttggttttattttagtagccctttggccttttttcaggtttttttttttttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaccatttttccattttctttctaggaaattaaacccttttaattcttatctaccttctacataatggttattgaatactccacaatatattaagtctagatgttatggtacatgcatacactttcaggctgttttatacccactgtcaccaatacacataaatgggggaggaaaagctatgaaactgtatagggctgtatatatacttgtctcagcttaatgcaggaaattggtttaatttccagcagttttgtctaaactgttcaaaaaaaaactatgaacagagttcaaatacaggactgtttgttttgaagagactttctaaagtgtacttaaaacatagtagttttttacctttcacaaaactgagttacaagaatacttttgttttacagtgcatcccttcctaggaagtctcattaaaacactcactttttctaggggtgattttgaatgctgcacagggaagggaaggaaataatagtcttaacttttcttaaaggataccagaaacattgctggatataatttaagattagtgttttctctttcatagaaagaacgtacatactgggacatgagtacagttacagcaagtctaggtgtgctaacaaaacagggcacattcaagtacagtaagattttgcttgaaattaaaaacaaactacatgagattaaagcattaaaatcatatttctcaatctgaatacatgttaaaaaaaaaaaatcaaaaggaacgcagaagtgctagctcacatttttaccatattacaaaagcaattggtacccatgtccataaaggcagcaacaaagctgcttgtctattgaagattactactgcaaattggactgcattcaatgctagttgtaaaaacaccagcttttcagaagttggtatctgtacaaaattgcagcttattttcttcacttctgtcccttcaagtctttacacagtaatgctaaaacacccagctttgagatcctgagtcaatatattgccactttctttttggtagcttgagcttcatagtgtcaactgaccttgtgtatccatttttaatacagtctcttcctgtagcatgggcaaatattttaaatcttcttccaaaaaagtgttttaagttatgatgttacaatggcaggactttttctttagggaaggaattcagttgtgctgcaatgtattagattctataggtggagcagagtcatatagtgtatctgtatcatgtgtaggctcaccagctaatgtacaaggattagacagtgttccagcaccacagtcacagaaaaacctaaagcaaaatgaaacccaaatattagaaaagtgagggggaaagtaattgggtaatatatcaagcaagtgtgctacatacctatcatgtctaataaactctacatcatgtccctgatggcacttcttaatgcagttcacacatatggcatttcgatctgtggtgttacaagtatgacatctaaaaagcaaaagcttaaattacttttctcaaacatgtcattaatgcaaaacattccattctgtttatatattactatgacctttggctttaagaggaccaaaacaaaattctttgtggctccagcccagattaattctgaaaaggaactttaatggagtaagtgattttcctgtcatctgtgtcttcggagggaagagaaatgatttgtaaattgtataaaggcagttctttccactttaaaagcctctcaaatgtttctgggctgaaaacaatttttggaggcgtgaagagtcaaaactgtcacagtgactgggatatatcaaacacttaaccccgacatctttaccttgaaatttctaggaaaacattacacaacatgagttacatgaatgacatcagttactgtagcattaggtttttccatagttatggtctttgttttgttttgtagagacagggtctccctatgttgcccaggctggtttagaactcctgggctccagtgatcctcccacttcagcct

SEQ ID NO: 17484 - DNA, 92155 bp, Human
gcaagtgattcttactccttgggcttgtttcttcatctgtaaaatgaggtggttagattatataattagtaaggattcttgtaattctaacagtttaggaaccagttctttagtactgtgccgtaagcctatctcctatctacctgcatttatagacagtacagatgtctccagatttgttccttttgggtattatttcaaacccagtggactgtatctggaagggagcacttacacttatttctgcatgtcaaaggaggcttatttacccaattagggaagttcttcccagccttagtctgcctaccttccctggacccttcccagtttcaccacaattgtttgcctgggccctgatctcaattatcagtatcgtactaccaaaacacacatctctcatgttgactggaagatctttgattttcttgaggttgaatatattaattcatattacattttgtgatgcctccagaactgccattgcaggacttgagtgtgacaaaacagttaagatagaacttaattatacctgtgatcccagcagtttgggaggctaaggaagaaggatcgcttgaagccaggagtttgagaccagcttgggcaacaaagcaatacctagtctctacaaaagttaaaaaaattagccaggcatggtagcacacaactgtattcctagcttactcaggaggctgaggcaagatgatctcctttgaacccaggaggttgaggctgcagtgagtcatgattaagccactgcactctagcctaggcaacagagcgagaccctgccttaaaaaaaatagaaaatttatcctaggaatatctgaatcatttccacacttgctccattcttagatggtggatatgattgaaagacttcattgaagagatgacttttccaaagaaattagggactggggcattgaggtgatgggagagcagaaaaggcactattgattggaagaccattccaggcacaggacagggagtctagagaatggaaagagcacatccaggctccatagttgcagaaacataagacagggataggaggagaacatcaaagatcaaaatgcaaaaccatgattatatggctttttgaatcaattaagagagaattatattatttggacacattttgtttcatcagttccctttccatgcatttctttttttgctggcatcagcatgaacagaagtaatcatcctacattctttgctttactgtcactagagtttaaaatgtagaggaatagttcctccctaacatttctagttaaatccttattccagaacttaatcctggacttaagtttagactgctatggttcaaattctgtttgtgccacttcttggctatatgatatctgatgaggaattcacttctcagagctttgtttttttttcattcctgaaataggatgattacacgtcaaatggctcttcttaaatagctaatggtcatggactactttgtttatgataaggcacaatacctgctattaataattatcttaattagtaatttgatataagaaaaaaaattcctgttttcctctgtaacaattattctgattgtgaactctatcacagcatgctaaaagtcatctattctgagctgatctaccaaaattgtcccacaaacttggtaatctcgtatccttaaggagagagaagttttctaacactgcagtctgcttcttgttgctttaccactattatgctttagttctatttgagagaaccccagttgtgtcttacaaagaatggttgtaggctgtagatgtagcctacagatctggtcatgctgttaccattacggagagtcaggaatactgatagtgatagagatattgcacatctgtatgtttacgctggttcttttatgtttttcagattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccaggtagttatgatagtatttttatctaaaaccattttaatatttttccaaaatggcataatggaaagatcagggctatggagtcagaggagggtttggatctgggctgtaccacttattagctccattatatttgggcaagttatataacctctgaactcattttctttacctgtaaaagtaaggagagtaaaagctcttcaaggggattgttttgagccttgaataccttcatgtattagtatatagtagatgtttaatagatattttcttctctctccttccctcctttaaagtatcaacttgtgaatgttttctcagttcaggaaggaagactgctttggaagaaaatttgtttcctgctgtcctgcagactttttgtttggcccacgatttccacccctacttttaattccaactagaagactaaggcagttcatcaaagtcctcattaatgtaggacttaatgcttcctccagcatcaccctttcattccccagcccccacccctaggcaattaaccagcttcctctgattttagtctttgattttaatcatgctcttacattttctctcccatttttccccttttccctcagagtaattcctcaatatttgctgatttttattgataaagttacctgctggatggcctagcattttacaagtctctgataggctccattaatctctggagaagttgttgccatataaattggtcaaatgagttatttgattggatgctgtatctcgtgaagggaggaagcaggactgacagagaaaagagaggaaggggccatttataagtcagaagttgctgttggtctgacaagtacaatgcaaaaacattgttaaagatgtgcaacatgttacaataagcagtactattaggacatgggagcccagttaaaaacttttggtaaggactcttttcttaacatgtgaaaccctgaagcctcagttcagtcaattatccagcattctttttttataggaagccaggcagaaagatcccacttcgtattgataacacaaaaaattaaaacattttttcaaagaacccaaacaatattccagtttttattccttacataaaggcaaacttgcacacaccacagtccttttctggggctgtttgacaaacattcccttaggaaaaggaaatctagcctttatttgcattgtttgatgatttttaggtttcattcatcattttgttttccatgcctatctctcttctccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgaggtaattttgtccttgttgtttgccttttggtgcatttaattaagatggtagaatatcaggaaacaagattttgaaaaaagagagaaatgactcataatctctctctcctttccattcaacattcagccattcaacagacatttattgagtacctacagtgcaataggcactgagtaagagatctcatggcctaaagcatagggtgttatgggagcataggtgcagggcatgaaaatcagcctaaggaagccagaaacaacctgatgctttgcagagtagccttgtgaaggctaatttattttaacattttttatttttaattattatggatatataatagttgtacatatttatagggtacatgtgatatttttatacaggcatacaatatgtaatgatcagatcagggtaattggggtatccatcaccacaagtatttatcatttatttgtgttaggaacattccaattccattttcagttattttattattgttatctgtagtcgtcctgttttgctactgaatactagatcttattccttctatctaactgtatttttgtacccgttgaggatcctctttttatcccccccactccactacccttaccaacctttggtaaccatcattctactctctgtctccatgagttcattttttttttttttttgctcctacaacatgtgaatgagattatgcaatatttgtctttctatgctttgttcatttcacttaatataatgtcccccagttccatccatgttgttgcaaatgacaggattacatttttttgtgactgagttatattctattgtgcatatgtaccacagttttcttttctttctttttgagacaaggcctcactctgttgcccaaggtagagtgtagtggcatgaccatagctcagtgtagcctcaatctcttgggctcaagtggtcctcccatctcagcctcccatgtagctgggaccataagcacccacacccatgcctggcgaatttgtttcattttttgtagagatgggattcttgaactcctgggctcaagcgatcctccctccttggcctctcaaagtgctgggattataggtgtgaaccaccacccctggccaatagtggctgtactaatttacattcctaccaattgtgtatgaagatttcattttctccatatcctcaccagtatccattattgcctttttgataaaagccattttaacaggtgaaatgatatctcattgtggttttggtttgcatctttctgatgattattgatgttgagcattttttcatatacttgttggtcatttgtgtgtcctcttttgagaaatgtctattcagatactttctccatatttaattggattatttgttttcattctattgagtttcttgggctccttatattttctggttattaatcccttgtcagatgggtaatctgcaaatattttctcctattctgtgggttgtcttttcactttgttggttgtttcctttgccatggagatttttggctcagtgttaacccatttgcctatttttgctttagttggctgcatatgcttttgaggtcttactcgagaagtctttgcccagaccaatatcctaaagtgtttctttgcatatggacatccagttttcccagaaccatttattgaagagacttatttcccccaaatatgtgtccttggtgcctttgttgaaaatgactgaactgtaaatgtctggattatttctcctaatttatgcagggggagaaggaaggaggtcaggaagtgaagccatatcataaagcgcttcgtgaccaaattaaggaatttgaactttatcatgaagacagttgtgagccacaagagtatttacgcttgaaaggaacatatatatatatatttgtgttttagaaggataactgttattagtgtggagaattcgtttgctggagctaagaatgcagaagaatgatatgtgaagttatgagaacctgaactaaggcaatggctgtagatggaaaggagatggttttaaaagatatttaggtggtagaattgaaagcaactggtgacagatcaaatgtggctagaaaagtgaaggaatttaatatgcatcccagctttcctggttttggctttgatgaccaatgagtagtggtgatgttaacaaagataaggaccacaagaagaggggcagatggtgtcttcaattttacacttgacttcaaggtgattaaacagatatcaagtatttgatttcaagcatttgggtttggatctcaagaaagagctctgggccaaatatggacatctgggaatgtgttgaaggtcccaaagaccgttcctcaggttttgtgatttactaggaaaattcataggactcggtgtatagtcatacttatgactgtgatttattaccgtgaaaggatccaaagcaaaaatcagcaaagggaaaaggttcaggggacaaagtcaacaaaaccaggaacaagcttccagagtcctctctcagcagagtgacgtaggacacactgaattcctccagcagaaattgtgacaacacttatgaaatgttgtctgccaggatgctcattagaggcaaagtgctcagggattctattggagcctgcccacataggcacgttctgcttagtgtatgccagaattccagaagtccagaaggaaggcaggtgttcaggataagccacattgtttgtacaaacagttttaagcacaatgcaagtaggcctttctaagggtagtctgatggttaatattgtcaatttgattggattgaagtatgcaaagtattgtttctgggtgtgtctgtgaggctgttactagaggggagattaacctttgagtcagtggactgggagaggcagacccacccttaatctgggtgggcaccattccctcagctgccagtgcagctagaaaaagcaggcagaagaaggtggaatgagcagacttgctgaatcttccagtcttcatctttctcccatgctaaatgcttcctgccctcgaacatcagacttcaagtacttcagcttttggattcttggacttacactagtggtttgccaggggctctcgggccttcagccacaaactgaaggctgctctgttggcttccctactttagaggttttgggactcggaatgatccactactggctttcttgctcctcaacttgcagacggcctactgtgggactttaccttttgattgtatgagtcaattctccttaataaactccctttcctatatacatatatcctattagttctgtccctctagagaactctaacacaggtagcaatcaggcctgctaggataatttttctgcagagagagtcattggtgtttaagtgatattcctgaatcgttcatctttaacagtgtttttactatcataataagactgttattgcattgactttctggtaacatagctttgaatgtctactaggtatggggattgatgagctgtgacttcgcagggtcatctgtgaggtggcttgttagggtcatgcttgagaggaataagtagagattgggggtgaaatctgtccacctcaaatgtgtgtctgagtctcccaaagaaggtctgaaatactcttgttggtctttttgatgtgtataaccttctaagctgaatggggagctccatttatttttctttgtatgactgtcttctccaaagtttaagtccaggtaagggggtgggtagaaaacattttcaaatggtctgcattctggggacattgactttaatgagttacatagagcattcttaatcttatctacctttaactttttttatttttgcctgttcagtttatatttgtttcatctgttgttaaatgtttgggggtgttctttagttaggggagtgattagaattaattttgcaatgtcaggtctgtggtgttataatattttgtcactgtctctttggaaatatgtattttggtaaccactaaaagctgataaacttgagaaaatatgtcagtcttttcatagagtaagtcacacctaaaatgtcaacacctccaacccccagactagtggtttaaaggccgtccagatatgaacactaggaacctagtatgcagtttatatatatacatttttcacttgctagcaacaggctggaattagcaatcactcaagcattagctagctggtatttaatcatctattcctcagaaatagaaatgaaaatatccttggtataaaagcttttccaagtgtgctattattttctagaaaggaagggattgagacatataagaacaaaatgtacttttagaattagaaaaacaaaaatcatagacagaaacacacataaaaccccatgttgaaattcctacgtgtgcatatcagagcaaaaacaataactgtaaacaagtgaattaatatgaacggacacaaatatgaagcagacaggtagaggaggaggaaatatgatgtactctttcataaactacatactaggttcctagtattcatatctggacggcctttaaaacactagtcttggggtggaggtgttgacattttaggtgtgacttactctatgaaaagactgacatattttctcaagtttatcagcttttagtggttaccaaaatacgtatttccaaagagacagttatatataaatgtataaatatatatttatatatattgtgcttattttcttttagatatgcagcacctaccctcctgaaatagtggttcctaaatctgttaccttgggaacggtggttggaagttcaaagttcagaagtaaagaacgtgtccctgtgctctcctacctctacaaagagaacaatgtaagttaagcagatttctctaatgataattaaacatggctctggaagacctgttttaagtttcatgctgccacttagtagctgtgtgacctcaggcaagttacttaacttctctggactttcatacttctgaaggtttttgagaggatctcagtaggaataatatgtacaatgtactttgtaaattgtaaaatgttatgcagatgttaagtgtcattttagtatgtttatttctttttctttttttccttttctgtgggatccagctttgtggaaagttgtgaaatgacagaaaattagttgtatacaggattttttgggggctgtggcctcccagtagaatacagatatccttgatactttcttagtgcttttcatataatttcaggtagtagtaagaaagcacttgactcctctgtgtttcaatccccttacttatgtaggaagtgataatatttatcacctcttgtaatcactctgagatctggggttagacaaataggcaagttgtcaggtgggcaaccgttcaagtgctaaggagtatagtaatgcaattgggtgtcatattattgaagtgagttgaccccttaaaagccacatcaaagtgtaacgaatttcatgaactaatcattaccagacattcatgttaaatagttacgttgtttttgtgttaaagtggcttgaaacaaaccacccttctgatttggcattaacttctgaaactagtgaaccctgttttcttaagacgctgtagatctttgctctatcttgaattctgctgcctccgcaagcttatggtttatgtgggcaatattactgggactgtaaaaagtgaggcggtttcagaaaaatagcccattatatatcgagaatagaatttcactaaggaaatactcatgatgtgattttttttgtagtctgatttaccaagactgggttggaaattagagccacatgcccagggtaggcaggaggttaagcccaatgtcagtggagaatgactttagagtcacatttctctttgctttggacactatcttaagttggctcatcctctccctctactcatggaacctggcaagggtcaagaaagatttttgaccatttgtgaatataatcactcaactgacacaccttttccttacaggctgccatttgccgctgtagccagcctctctctggattttacactcgctgtgtagatgatgagctcttgttggaggccattagccaaacaaacccagggagccagtttatgtatgttgtagacacaagaccaaaggtatctatttctcagtgatttctttgatatttctgcctcttgcattctacctcctcatatattgagacatgcagtgttattgggaaagttaggtttgtgtatgtgtgtttattatgtcagacattgtgtaaaatcatttcaggaagccatttggggctccttttataaggttgccactgtcaagtgaggttatgagagggtatttcaagcaacctgtctttcccacctcagtgtgacgtcctgcatagaaggctccttaacatccctcatcttttttaccaagtctgttccttaaccagaattttcagtattcccattctgtggtctagatttactgttagagaaagagcttcaacttagacattggaaacttactacaaccaacatgttttttttttttctataaatgtgttaggccacagtaatttaataatactttggttctcccaaagcaccagggttcacaaattttactgctatgcaattaacaaaaaatctttagctcatatggcagtaattcttttttagcatctagtactgttagctgattaaatttttgccggtttagtacagtgcagtttaaatcttcgtcccagagaattaaaaagaccaagttcataaatttgccgtggattttggcagtggacatggatagacctagtcaaatcctttgatctttccaataatctaatgctgcatgatttgttgcaatgtgttttctcaggctttgtctctttcaaatatgaacattgctgaacagagtgtcctcatgttaacctaagtatcagcttaaactcctctctgcattaattccttaaccttcaaagttttgtgtggctctatatgggctgtagaagaactcattgtgtcccacaaaagaagtaaaggatagattccatattcttaaatgttgtcctttttacaaacagccccagaaagaaataattttgcttataatttggtatgtaaagtgtgactgactaagaggtttcattgctgattctagtcattactaaattggtgattttcatctaagcctaagccagatggttgtgacttaagagttgagcagttggatgtacatgaaaccagatagttgccttagacagctttctgccccatctttgtgatccctcagtggctattctccagagctacctaggactgactgagctcaggagagaaaataatttccctttctgttcaggcccatccttcagtttctcagaagcttgctgtcttgtttcagccataactgcatctgaaattctgcaattgaaaagagtttaatcgagtctgtatctttaaaaattaaataatcttaaaatagtaaagagaaatacaccaagcttttgaagaaacaaaagagttggtgccttttgttcaaatctaacaccaaaaagcccccttttttttaacaggttccattttcctctctccaatttgagcaaattaagacaggcctagaaatatctggcattccctctcttctggatggctagatccgtacttttagtaggaactatattatactgacaaaattttgttctaggagtcagtcaaacctgaggtcaaatcctgctttcagcctttatccatatcatcttgggcaaattggttcatctctctgagcctgttttcttatggggataatatagcacccattttgagaggctgtaatgaggattaagtgagataatgtacataaaggatttagcacagtgtcaggcatataataggagctcaataaatattacattacaataaatattacatctgacattctgcaattggaaagagtttaatcgcgtctgtatctttaaagattaaataatcttaaaatagtaaagagaactacaccaagcttttgaagaaacaaaagggttggtgcattttgttcaaatccaacaccaaaaagccccttttaacaggttccatttttgtctctccattttcctctcagtttgccacctgaacattaaataggtatctgttactcagatctgccagacatatttttaaagagtgaatactggtatgaggtagctagttatctgcattaggtggcctacccaggcctgggtagtgactactgtaattattattattattattatttttgctgaagcatcactcataacaaacatccttgctactaggtgactattgcttatgcttccacgggtgttcctttgacatttgtcattaatttaatgaaagctcagtaacactatcaatgtgataaaagatcaaaattaccatcacatttccccttttaacagatgtcttgcattgtaaacagaatatgtttagcacactgacttttttccctctgcatgttctaacttgaatagtttgtgtcttgaggtttttgtattcttttaatacaaaaattataccctgtccacatacatgctcctcctgccttctgaaatgcacaatattgggagatgagaaaataggcccagaaaacagaaaatcacttaattagtaagatggtcattatcgtagacagtatcttggctgccttctggttattatattcatatttccacaagtctcatttactccctaccccacccagcattcttcatatgacctagagattttctgattaccacaaactgaacatagtgttaaaacagttggtgatgtctccatttcaattttgtcagtgagtaaaagtcatttatctcatgcagtcacattttagacatttttctagaatagctatttaattgggctgtatgtggtggcttatgcctgtaatcccagcactttgggaagccaaggcaagaggattacatgagtccaagagttcaaggccagtgtggggaacagcgagactgtctttacaaaaaacattttttgtaaaaaaaattagccaggcatggtggtacgtgcctgtagtcttagctgttcaggaggctgaggcagaaggattgcctgagcccaggagttcaaggctgcattgaaccttgtgattgtgctgctgcactccagccttaatgacagagtgagacactgtctcttaaataaataaataaaattaattcatcctgaagttcttaggcttctttctagagcttctcagttgtaaatatttttgaacttttgcatgtttctcagtataaaaccctttcagctgagaaaacatttgtggtaggcagctcaaaattattatttcagttttttagatcagatatcctcatagctgccataacttttctctcttaagaaaggttttcataatgaaacaaaacactgtatctccctatttttcccctatatgagtctgttactaaaagtacctgatgtaaaaactagtgaaattctctccattccagaatgtatctcatctgatttaacttctttttaattgggtaggattttaaacggttcagaatgaggcattgagattgatgaactccattctttcatcatctggcctatctgctctattatgtcctctgctattgcagttgaatgccatggccaaccgagcagctgggaaggggtatgaaaatgaagacaactatgccaacattcgcttcagattcatgggcattgagaacatccatgtaatgcggagcagtctgcagaaactcttggaaggtacagggatttcaccttggctaggcaagcggccatagctttgcgttatcatgtaagcagaaagcatgcctgatttggggtggaatataaaagcaagcaggtgagcagagtcaataagtggttaggtgtttaactattgtacaaatctagcttaaatagtactgaattatagcagtgttgatctggaaaagggactaagatgtgcagtttcataattcaataaagttcatctgggtctagttggtatgaaaattatttctctctgtggaaatacagaggttgattttcagggataggcaaaccagcataagtattaaataaatttgggattcattttatcatccttaaggtaagaaattatcttctttaatttggtataaggattcagtctgatttcatcactgtgctgatgaagttgaatttagacctcaaaagaataaagttgatatcagacagttttggtgatctgttatcgactacaaaatgattagggtcagaaagggggcaaggtgggattggggccttacaagactcttgggtgtagagcatttctcctaaaaccactacccaggattccatgatgttctatgtcaactcaggcagagatagtgaaaacctgccttctttagtgaactccccattcttcctcttctttcttcaactttgtacttgcgtagtctgccatgacctctcctttacatcacccttgccagatctcatctgctcagtctgcatcccttttaaaatattaatatccctcttccttaggtctcttactcctttcttttttgccccagaatattttatggaagaggactttgttttacagatttttaaggcaaaagatttccctctgctggataattattgcaaagtgcataaaaattaactggtattttttttttcaacctgttgacagaacagggctacagggagtagatgggggtgtgggagtagagacagatgctgagggccttcagagttagcataagtgggtgggattaggatagggatcaaatatgttttctaatcagaggaggtgtgttttcctgtagatgctaattcagtcttctggctctcttcttgagagatttctaagggcttgagagtgggttctacagcatgataaagcagaggcccaggcgaggagatctggtaggctttagacctagttctgtccctgactcactgtgtggtttctaactaatcatttaacctttctgcctcagcttcctcacttacgatatggagatccactttctccccttaatgaataaactgagttgattgtgaatttcaatctctgcttccttttctaccttagtttgtgaattgaaaactccaacaatgagtgaatttcttagcggcctggagagctcagggtggttaagacacattaaagctattatggatgctggaattttcattacaaaggtaataatcaggacttttaaaatttgcactgactttaattatgggatatattgaagtagtagtgtgccatggtggaaagaatattgaaaagaaatctagtttctagattcagctctgccactaattcactgtgtgcccttgggcaagtctcttttcttctctgggtctcagtgtctccatctttaaacaaggtggttgaactataatctaatgatgtaacttttaggtggccacagaattctttgggaatatgattaaccctctcccccactggaaaaatgaacatatgatgatacatacagaaaatgaacctcaatttcagggggtccacagacccctggacttcacattaaaaactcttaggtgatctctaattgataattgataataattgatctctagctcagttattctgtgatatatttttgtgttgattctaaggtattaagtacaagggtgggtgtgaaataaatgcagagcttatgtatctatgagttttcagaactctgagtacaaagacctatttttttaaacttctttgtatagatctgcctccaaatgcagtctaggcaggctttgtcaccctgtatttatgctgactcatttattttctgatctctaggaccctaggctctgtagcctttgttaagtggtttgttttcttacaaaaacaaaaacaaaattcagtgtatattttctcattttgacgttttgtttttatgtatttctacatgagtactctacctcttcatcccacccccattatttggtaaaagcaaaggagataatgacttttcatacatctgctataattttctcagttgaaggcaatgttatatataacttctggcttaaaaggtttgaagattgtatataatgaactgccttaaatatccaagccctaatgctttttgctttcctaatcctgttgcctgcacttttcattgttattgatgttcactatgtgaccctgtcagttgtttcaagcccactattctaactattctttgttctgttcctttttcatagattctacatccatatatctatagtccctttctgaaaccaaatttattagaccaaagagagtgaggatggataagagggagatttgatagacagtacagccttataaatattggttgaattaaaatgaatgaaccaaaaagataggcttggattgcacagtgtttctgtgttccctatctctgttaccacctatccaatatcccaagcttgagaacttcagtcagccttgaactctacctcttctcctccatctggctattgccaagtcccatgtgttctgcttcaaaagtgtttctcaaatctgtcctttcttcccagtctccactgctatttctctagttaagatagccacaatccattgttcacagtgtaataacctcttaactgctttacttgtctctagtagttactctttagttcgggaaccaaattgctactaaagttatttttcttgaacatgtctgatcatgtcactttaaactcaaaatcctccattggttatcaattctattgccaataagaccccataagcttgacattcagagtctttcacaatgtcgccccagcttggctgtagtggacctcttgctgttctctaacatactatgttacttctttttctctctcttttttaaatgtttattttatttacctattttctcattacaaaagcaatacatgtacattatcaaagaagtaaacatttcagaaatatataacataaaatgtaaacattccccatagtttgtaccacagtgcatacacatcactgatagtagtttaatgtttatgtccttcagtcagcactgtccatttgaactttttgtgatgatggaaatattctgtatctgtactgtctaatacagtaccactacatgtggaaattgagcacttgaaatgtggctagtgagactgaggaactgaatttatgattttatttagttttaacaaattcaaatttaagtagctataggtggctggttactaccatattggacagtgctgctgtagaatttttcaacatatagagttacacatattaatactttgtgaaaatgagctcatactgtgcatactcttttttttttttttttttttttttgagacagagttttgctcttgttgcccaggctggagtgcagtggcacgatctcggttcactgcaacctccgcctaccggattcaagggattcttctgcctcagcctcctgagtagctgagattataggagcatgccaccacgcctgactaatttttgtatttttagcagagacggggttttgccatgttggccaggctggtctcgaactcctgacctcaggtgatccaccagccttggcctcccaaagtgctgggattacaggcgtaagctaccacgcccggcccatactgttctttaattgaccttttatacttatactatttaatgagcatttcttaagacagttcagtcagtactacgtcattcttttcagcaactatgttatattcaattgtggtaacttagttgtttctaatttttcgctaatgcagatattgctgcaccaaatattcttaaacatatatctttatagaagtggattttctgtgtcaaagagtatgaatatttcagattttaatagatgtggccaaattgccctccaagtaggtaataccagtttccattcctaccaacagtgcctatttctccattttggcagcaatggttatcatcaatctttttgatctttgccaatgtgataggtgatagattttgtatcatgttttaatttgtatttctttaatcattagtgaaatccagtatcattttctgtccaccagtgacttttgactctgtttggagccctaaacaaagaacatggttgctgccgtcatgttctgctactacctgaggtgtctgcttaattgagaagtcaaaaaggttgaaaaacttttttccagatctctttaactccttttttacctgaaacctgactacctttctaggaatacgattttttcttgtacccctattacaaagattactcattgtcccacatcatatgaaccacatggcccagggcagtttcactattctccttgctccttacaaaagcctccccctcctttcagatctatttcatttagctataccatcctctataccttctagttactcttccccctccattaaggatgttgggaacagccttgccgtcttcttttccatcctggttcttcccgtcatctgaagagatttgagtgtcaatgtacaacttatcaaacattctacacttacagttctttggactttttataattccagctttcacatccttaatccagctagcatagttcttctatctcatggaaacctctgtacttttaactcctctttttccaaacttcttttttcttccctatataccaagaccgggtggtgtagcacttcatccattccaccttgtctcttatccttccactctacctgccctgctagccacggtcattctctgctcttacaccctgacctctaagcattgctgcaaatagatgtatcccatagatatgttagttggtaccatcacaggtttatgccttatagtcttagctgagctgaacagttattttatgtgtttttggttggctcccagtcctgtttcaccaagcagatattccttgtaccttgctttcaaactggctacaccatggtaactcccctctctgtaagctcatattgaaacatgtccttcatggaaaaatgtatataatacctcttctcactattatccttaccgacttctttgctatctcggtggacatagtgccccatcttctgtgtaaggatactcactctacctatatttgaaattccatctcttcctactttaaggaaccaactctgtcagttaaaccctctttgtcttacattttcaacctattcttttcaactggcttcttctctcagtagtatgctcaaatattttctcattcctaaagaaaaagtactttttcaatcttctagttattgccctctttcctcttggttggcgccttctgaaaagtagttagtctttcctattagtacttcatctcccttcacctttcagcccactgtgatccaattttcatataattactattgctcttccagaggtcttatgacctttgacttgtcatatctaagagtcacttgttagtcttcactctattttgacctctctgttgtgtttggcacagttcactccttttcactttgaaccctttttgtagtcctgacttttatccaactattccctcctggctctctttttaccttttgggcttttttgaacaggctgactcctataataatcctccttcctctgcttgccctttaagggtcactgctttttaaggtcttttcttttgtcacatttggtctctgcctgggcagcatcaactatgcacacagtgtatactactatctctattcagatagtggtgaaatctatactctggttcagatctttccctctcctgaacttcaaacccacatatccagttgtctcactggactttccattagatgttcccgaactacctcaaactcaccatggccaaaacataaatcttcttacataccaccactactacctaaaacttgcttttgtgttcattatttagtctaatggcactaccatccacctggttgctaaaccacacatttcagagttatctttaacttttccttttctttcatcccatgactagtctctcactctgtcctgttaaaatgttcataattaaaatccttcttctgtttttcagctccactgctactaccttacctcaggcctatatggacttccacgattttagtagcttcctaactggtcttcctgtatccaaactcatgtcttctcaatccattctccttactgccaccacagtgatctttcaaagatgtacatctgatcatggcactcctctgcttccaactccctattgccatcagataaaatgtatacttgattggtctgacccttgtcctcctagctggctctatctctccttattctctcacttccagcttagcctgagtcattaattgttcttcctctatgtcatgcctccttgcaatgtacacgctgttacatcattccccagcctggaatgtcctttcctcctggtccatctggtaaattcttattcatctttccagacccaccttagttgtctcctccttgctggttatcttttgtgcctttgttatacctggcatggattttccccttttatttttcattggtttgcagtcatgcatttaagtgtttgtctcttttgtattcccaatgcacatcatagtgcctcttgtacagtcactcagtaattattggctaggtgtgtggatgaatgaatgggtgaattaatgtccttcttcacctaaggaaacccagctctttcttcaagggtcaagcttccctggctcctgcaaaagaatattgttactacacattactgtatattaccagtagtttttccattgtattttaattatttatttattttcggtcaccctgactagtttgtgggttccttgaaagcagaaactgagtctttgtatttctaatacctggcacatagaggcacaaaattgttagaatgaataaatgagtggtcaatatgtaccattgccaaaatttcccaggttaaataactgcccagatctttacatcattctgattgtgtttatacaatcacttgttaaagcgacctaagacaggcaagcacctccatcttaagttgaaagcatttgtgttagtaacactaaaacagctagaggagattgttgtcagatctgggactagaatgcagagctgtctgtgtttttgagtgtgaattcttcctccagttcacctattcctctgagaattgatccttggtttcttcagaagtttagtgaatttagaactcccctcatctttctttttgccctgcattatgggttagttttgatattcttttcctatgtggtaagctctccttctcttgaactccattgttttccttttcattccccatagaggatgttaatgttatgagaaaaaattaatgtagcccataagaccaggttctctgtgctttagggacagtatttggcaactctttaatccaacaagctgtgcaaaggttgcttgtggtacttttttgcctcttgtcttcacaggcagtgaaggtagaaaaggccagtgtcttagtccattgttctgatggatgggaccgcacagcacaagtctgctcagtggctagcatcctcctagatccattttataggacattcaaaggactcatggtaagagagcacgctactatattttactttgtgtaagagacagattgcgacaaaataaaaaataactgtcaaacaatattttttttgccagagttagctctaagtctacaaaaatagcttttccaatttagcttcttttcattaaatttaggtgtgtactatctgtatactttcttttgtatgttcaacatacttcttacctatcagaaggtaagttatatgtagcagactactgtacagagtaggaaaagctcaaaaagtttgcagagcttaatggatgactgtcaaatagactgtccaaggggctcatcatctttaacatgtcagctgtttgaatgtcagacttatgattgttttctaatgctgaatctaaagcctcttagttgatctttctaagaaacagaactcaccatagtggtttattctcatttctttggaaagcttttttttgttttgttttgtttttttgttttgaagtagtcttactctgtcacccaggctggagtgcagtggtgcgatattggctcactgcaacctccacctcctgggttcaagtgattcttgtgccatagcctcccaagtagctgggattacagatgtgcaccaccatgcttggctaatttttgtatttttagtagtgactgggtttaccacattggccagtctggtctcaaactcctggcctcatgtgatctgccctcctcggcctcccaaaatgctgggattacaggtgtaagccaccatgcctggctagaattttttttttttttttaatggttaaaaatggttttgttactggtataaagctaagagctgcctttggatttctgtttttcaaagtgtgaatttaatatcgtgcttatcaggattgcatttagttatggctcagtggcttgtcacacatgtgaaagccaaaggaaatttgactctggatatgtctgagagcatctgaaatttgaaggcaccctgtataggcttatgaatgaaatctaagttacttacttatttatcatttaggaaattaactattttatgatcagttcaactatttcagcaaagtgttttgacattcttgtgtgtatggttaattcattttatgattttcctaatgcaaacactttcttttctataaaatgaagatcttgatagagaaggaatggatatccatgggccacaagttttcccaaaggtaaaaatatactcattttgaaggaaggggctgaggatagttcattagggtgaagtatatcaaaacctcagtatgtacatgtaaaggaaggaagaggaagttgaacatggcataaatctcttttcatcaagaaacaagtattctagatactatgctagggcactaaggtgacaaaagtaaccagaatattatccctgttttcaaggagtacaagtaattatatcaaattgttaaatatttcaaggaagaacaaggcatcacaggctacagaaggaaaagtgcttaacattgcacgaagaggtcagggtaggcttccaggagtacacagcatttgaggatgaatttttggaaatgaatagaaatttaacaggaagaacaagggaatgatgaggtcattcagagggactaatatcaagacaatgcaccttttaaccttttgtaagataaaaggggcagatttgttcttttttaagggatgaggacaagggcttatatttatctgttgtctgctataaaccaaactgcctcactaaggctttacctgtgttatcagaacaatcgataaatatttgtcaaatgcctaacaatgtgctgtatattatatcagacactaagctgattccaaaggcaaataaaatttgagatttggccgggtgcagtggctcatacctgtgatcctagcactttgggaggccaaggcgggcaaatcgcctgaggtcaggagttcgagaccagcctggccaatatggtgaaaccccttctctactaaaaatacagaaattagccagacatggtggcgggtgcctataatcctgactccttgggaggcagaggtaggagaatcacttgaacccgggaggcggaggttgcagtgagctgaggccatgccattgcactccagcctgggtgacaagactgaaactccatctcaaaaaaaaaaaaaattgagttttaccccaaggagattataattcaggtcttattttcccccattgatatgcattaatttaatttcatttggttgccactctctagccatttgggtccatttatttattcttccttcacccacaaacattggaccagtcattatgttaggtattgagaagacagagctgaatcagatatagttcctatctcatctttgaaagaaaagaaaaatcagtgatgacggtgtagtatgataagtgcttaagacagaggaaaacataaacaaaggacgtttatccattctggggcaaagaaggcttcctgtaataggtgacattttaactgagatttaaagtatgagtagatgttatttagaaagggagaaagcattctagccctgatgtgtttgaaaccataaaggcattaaacaggattacgtgtttgaggagctgcaagcaattcagtgtggctgggtcaaagggtgtgtagggagaatagaggaaatgaggccagggaagccgagccagtgaggagaagatcattcagagccctgtttttttttttttttttttttttttaagctgaaagatttgagtgttttgtgtacatagtaaagctatattggaggactttgaacaaggcagtgacatgatgttcagatctatattttacaaatatccctctgacagcatgtagaagattgaaattggtggcaaggggctgaattagtaggctaccagaattgatgagggcctgaaaaaaagacagaagcaatgatatagatacaagggtattcaggaagtagaactcaccaggagatgggagaaaaagtccaataaaactcaaaggtttctgcctgaggtagctgggtttattgagatagaggatataggataatacagggcaggtttggtggggaagatggcttcagtttgggacttatttggcatagggcatccaggagaagatatctagtagggagactattcagtagtaatctggagctcactagttctgggttggatagagaggtggtgtagaggtttaagagttatctgcatataattggtagtttaaaccatggattcagataaggtaactcaaaaaattgtataaagaggaagaagagccaaggggtgggacagagccttggataatactgacacctgaaagtctagtgaagaatgaagtccatgaagttgactgtgaaagagtgattagtgagataagaataaatctaaggataggaaagaagaaacataagagaggagaatctcaagggagtagtcagcagtgtcatatgcctcagaataacccaagaatcgactttggcaatatgcaggttttaatgatctttagtgataactggttgagcaaagtggtgaaagcagaagccaaatgtttgtgaatggaggcatgagtgagggatgaagaagtggaatgtgagtatataaatctctttccaagaaccttggctctcaagggggtagaagagaaggggtcgggtttgggtctgaggaagtgtatttcaagacaggagatatttgagcagtttcttatgctgagaagaaagaaacattaaagaagataaggtggaagatatgccaaaacagtgagtttttggtagagtaagacttctgggcaaatcggtgaaagttccagtccaaacgaaagattagcttgagctataatgaagaacaccttttccatggagattaggtggaaagacaggcagaaaaggtgctatatgtgaatattagaggcagaagttagaaatttttttttctacttaatggccttgatatttttcagtggcactggagtgaaggaagatatgaaatggattaggggtttgacaaggtagttgaaaatttgtatgagctgtaaaggtaatgagaaaatgttgttaaggacctacacaaagattatttgagagcagttaaaacacagctgaatgtggagactcaatttgaatggtgtgaatttgtatgattttataattttcttgagcattattaatcagtcaggatgtggaagcagagaacatagcttttcaggctgatctgtggttggatttagaaggaaaataattacaagaaagaccagaaagctgaacaaaatggggagagagtagttaatagggcagatcatggaatttaggcttgataagaaaaaagagaagccaacaggaatctagcatgtggagatgtcctgagatgaggtctgcaggagttaagaagatgagcagcctttggaaatataatatatggtgttcagagtgggatatcgtgattaagatttcaaagatggagtaagaactactagccagcctgtggccagtggattcaaaaggctggagtagaggtaaagatcagtgaaggtaatttgatttgcgttagttaaggaatctgttgagctagtgtaagtcatctacatcaacacaaaagcttaagaccatcagattattcagagaatgtagggaagtgacacagagattctagaagacagcattgtggaaggagaaggtaaataagctaaatagcatgacccataaaggaagtgttcttaagggcatgaaaagaatagtagcttggaagcagcagaagcagcagtaggtgcaaggagaaagctaaacccacctctgctttgttttagaattatggtatgtggaaagtggaatgatcagcattctccatttttatttgaccccaaggaaaggtggtatcgttgtgagccaggttgtaattatatcagaaggtagagaacattcagtgtagaaactgagagtgccgtgttcatttccagtggaatagtgtttcagtcgatgatagggttggtaaagaaaacattgtggggaggaaatattaaacagttctgggatgaggtttcattcatgtacttaataaatgtttctttaatacctattttgtgccaggcactatgcagtaaacaatatagatgtggtcgttgctcacatagagctaaatgtagctatttaaattaaattaattaaaattaaatacaattaaaaattcagttcctcagtcacagtatccacatttcaagtgcttaacagttagtggctgctatattggacaacacaactgtagaaattttccatcattgcagaaagttctattggaaagagggtgtataaaaaaatagactagatgaccaaagggtttacagtatggatgacagtgaaggacaccagcagctaagaggtctgctgggattgactagctttgagattctggctggcattttggtatgaggtgtttccttgccactaccaacagagacaaaagatgaccctcttacagcctattcccaacagtgtaatccttaatgctaactagtgtctttctttacctttattttcatctctcaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaaggtgaatttactttgtgagaagacactgaacagggagaaggtggtcagtgcaaaaagaatgtacctaccaccctgaatttggcatagcagtcaagaaaggggaggagataacaataataaaaagaacttttgaagcataaagcactcaatgtttgcacagagatctctcagaaccctaagatatctcatctgtaaaatagggataataatgcctactttttagagcagtcatgaggatccagtaaaataatggatgtacaaggcctttgcaaataattaattgctgtgcaggtatgagtagtcattatctacagtcctttctcactcatatcagagattacaaactagcagctcataggccgaacccaacccaacaggcgtggtttgtttaatctgtggagtattttttaaaactcctaattcgttgccgacatttttgtttatttccgtaggtttttgaggaacaggtggtatttggttacatgaatgagttctttagtggtgatttgtgagactttggttcacccatctcctgagcagtatacactgaacccaatttgtagtcttttatccctcacccgcttcctaccctttccctctgagttcccaaagtccattgtgtcattcttatgcctagttgctaacatttaaatatcagtagatttcacattaaaatccagttattttaggatgttttttctaaatattctgaaaaatcaggagctctggcaatactagactattttctcatgataataaacagctagagctgaatagtagctgttccatttggatgaggcaaactcactcttgttgactgcagttcttaccattctctatagtttattcttagcccatttctaatgttatctgcctagttctagtaggcagttgagtttgcacccctcacttaaactaacagcttggcaatatatgagacataagtacttttcaaaattgacaaggtagagctcctgtgaacagtattttcattatgttagagacagagaaaaagaaataggatagtagctgtttcacaactcactcctatttcacagctgttggctgagttagtagttagcccaaccctcaggcccctttatagcatagcaagatgaagttacttctctgtgatttggttttcctgtcaacatagagaacaataatgagtctttctgtttcaacatttgtacttacttggtagtttctctcttgatgccatgcatgtttctctctctctgtctttacaactagacctttgtcactttctccccaaattcttttaagatattcattctgtctttgtttacctacgcgttaaaacacagaatcttttccataatctttttccttctcttaaaattggtcaatatatgtggtatttttcacacaaatctgaatatccatttaaaaaacataacagttgaacattttaacatattttaaaatagtgattacttaaaataagcagaagtgtcattcattcatgaacagaaaaggatgggctttagaatcaggcagacttgggttcaaactttggctctctcacctactagctatgtgaccttgagcaaattaatatttagtctcattttctcattagtaattttgggctaaaatatctcacaaggttttattgggaaaatttaaggaggtattttaggtaaagagtctggaatagtgtttgaacacatagtaaatactcaacaaattagttaccttaccaacgcaatatttttttttttctgttataaaccaacagcaaatgagaaagatggatgtacaaagcctttggcctcactgaaatgctctgacaattgcaaaagttacaagaccacaattttaggtcttaccacttatatcactcttcagttctcctttagcttcctttgacatggtgtgtgtgcaaatgaccttctcatgggtggttatacagtaactctctttgggaaccagtggatctcatgtattttgaggtgttaactaagggacttgcttactggttaagcagcctccccatggtctgaactaaagtataagaatcaattttgtaatataaatgccataatctttagttgcccacctgggataactcatgacattttctagtataaatttccaattgtctttcactgtcttaaaccttctgaagggagaagtagctggctttaagtaaaatgaaatatagaagagccagaaattcaccccatagaacctatcacttaacttaccagacttgtaaaagcaattccagaatttttaaaaccagaaaagtcattagttcataaaatccttgatttggaagataacttagaggtcacatttaacggtgaggaaataggcccagaaaaaaactcgggattttcttaagatcacacagctattccacacagagactggacttagaatctcctgttctccaatatggaactctttctaacctctcatttattttaaagatggataaattgaagcccagataatttgttactccatcaacactttttatccacttatttttcttctgtcatatcctgtcgtcctttcttgagctgggttacttattagtaaaatttgctgcttatcagttcaacaggactattgagattacttgcttcctgcttttaattttttggcttgtttttcttttctaacagagtctatgagaaaacacattctgtgtggcctttcttggttcagaggaaaccagacttcaggaaccctctctataaaggcttcactatgtatggggtactcaatcctagtactgtgccctacaacattcagtaagttcttaagtttttccctcctttcttatagcaggtcccagggtctcagcttccttgcttctccttggatagctgccaccatctgtacaagcctggctatggagtaggatactctgtcctcatatcacccatacattgctgcttctgaaaacaagagcccaattccttttggttttcagggctttgctgttacctgcttagggaaataaataagaaattatagttgatttgtaggaatacaaccagtcaagataacgtttgtttgattcatttactcttcctctgtatcttctacttgtctttcccttccccaacaaagaaaagaaaaatgagacaaatcaggagtgtgctggtaatgtttgctatatttttccaaagcttctgcaggctgaggcactcacaaagaatacaaaacagagattaatatatttattagctctaatagctcattttgtggattctttaggattttgtaaatattagatcatgtcatctctgaaaagagaattctatttcttcattttcaatttggatgtcttttatttccttgcctaattgctctggctagaacttccagtacagtgttgagtaaaagtagtgaaaagaggcactggtgtcctgttcctgattttagggggaaagctttcagtctttcactattgagtattgatgttagctgtaggtttttcacaaatttcctttttcatgtttaggatgttctcttctgttttcagttgagtatttattgtatttttttgctattacattttaaattttaattgacacaataattgtactacatatgaggtatagagtgattatgctgtatttgcctttgtgtggctggcttatttcgcttaacataatgttctccaacctcatctgtgttgctgtgaatgacagcatttctttcttttttattgctaaaatagtatttcctcgtgtatgtataccacattctccttctcaattcatccatatggacacttaggttgacttcatatcttggctattgtgaatagtgctgcaataaacatgggagtgcacatatctgttcgacacaatgacttcattttctttggatatatacccagtaatgggattgccagatagatcatagggcagttctctttttatatttttaggaagtccatactgtttttcataatgaatgtacgaatttacatttccactgatagtatgtgagtgttcccctttttccacatccttgtcagcacttgatatgttttgtctttttgtgaatagccattcaaacttggtgaaatgatatctcattgtggttttgatttgcattttcgtgatgattggtgatgttgcatttttttcatatacctattggccatttgtatatcttcttttgaaaagtatctattcagatcttttgcccgttctaaaatcagattgtttgctttgctatttagttgagtttcttatatattctggttattaatcctttttagaagggtagtttgcaaatattttcttccattctgtgggttatctcttcactttgttgattgtttcctttactgtgcagcagaagctttttagtttgatgtaatctcatttgtctacttttgcttttgttacctgtgcttttagagtcatagccaaaaaattgttgcctagtccaatattatgaagtgttttccctatgttttcttccagtagtttcatagctttcggtctttcatttaagtttttaatccattttgagttgatttttatatgtgatgagagatatgtacctagttccattcttctgcatatgggcatccatttttttttcagcaccatttactgaagattgtattttccccaatgtttgttcttcacacctttgcctgtatatgcattttttttctgggctctctattccattggtctgtgtgtctatttttagatcagtatcattctattttggttgctatagctttgtagtacattttgaagtcagatagagtgatatcttcagctttctttcttcttttttttttccccacaagtttgcctcagctattcgggatcttttgtggttccttacaaattttaggattcttttttctatttctgtgaagaatgccattggtattttgttagagattacgttgaatctgtagatcactttgggtagtgtagacactttaacaatattaattcttccagtccatgaagatgggctatccttctgtttatctgtgtcctcttcaatttcctccatcaatgttttatagttttcagtgtgaagatctttcacctccttggttaaacttatccctaagtatatgttttttgtaactattgtaagtgggattgttttcttgatttctttttcagatagtttactattgatgtataaaaatactgctgatttttgtatcttgcaactttactgaatttgtttattagctctagcagttttttggtggagtcttttgggttttctgtatatggtggacccttaaacaacacagatttgaaatgtgtgagtccatttatatgtggattttcttccacctctgcaaccactgagtcagcaagaccaacttttcttcttcctcttcctccgcctactcaacacaaagatgataaagatgtagatgtttatgatgatccatgtccccttaattaatagtagatgtattttcttaataataattttttctttagcttaacttataagaatacagtgtataatacatataatatacaaaataggtgttaatcaatgatttatgttattgatcaggcttctggtcaacagtgggctactggtagttaagtttttggtaagtaagaacttatatattgattttccagtgtgcaagggtctgacacttctaacactggtattgtttgagggccaactgtatacactcatgtcatctgcaaccagggatagtttaacttcctcctttccaatttggatagctttcatttctttctcttgcctaattgctgtggctaggaattcaaatactaagtagaatagaagtggtaaaagtaggcattgttgtcttgttccctatcttaaggaagagcttccaacttttccctgttcaatatggtgttagctgtgggtttgtcatatgtggcttttatttgtagtgaggtacatactttctatacataatgtattgtttttatcatgaagggatatttaattttgtcaaatgccttttcttcatctattgaaatgatcatacggtttttgtccttcattccattagtgttctgtgtcacatttattgattggcatatgttgagccattcttgcatccctgggatgagttccacttgatcatagtgaataatctttttaatgtgctattgaattctgtttgctagtattttgttgatgatttttgcatttgtgttcatcagggatattcttttttaattgtgtccttgcctggctttgctatcagggtaatgctatccttataaaatgagtttagaaatattgtctcctcttcagttgtgccgactagtttgaggaaaattggcattcattctttaaatgtttggtagaattcagcagtgaagccatcaagtcctgggcttttctttgatgcgagatttttattactgctttgatttcattactcactattggtctgttcagattttctatttcttcattctttaatcttggaaggttgtatatgaccaggaatttatccattttttataggttatctgggttttctggcatagaattgttcctgatactgtcttgtgatgctttttatttctgtagcatcagttgtagtgtctctttttttggtatctaattttacttgaatcttctctgttttttcttaggccagctaaaggcatctcaattttgtttatcttttcaaaaaaacaactctttgtttcattgatctattttattttaaacctctcttttttttttttttttttttttttggtgagcaacaaggctgtttatttcacctgggtgcaggcgggctgagtccgaaaagagagtcagcgaagggagataggggtagggccattttataagatttgggtttcttttctttccttttctttttttgagacagggtcctgctctgtcacccaggctgcagtgcaatgccacaatcatggttgactgcagccttgacctcctgtgctcaggtgatcctcctgcctcagctccctgagtatctgggactacaggtgcatgccaccacatctggctagttgtttaatttctttgtagagatgggggtctcactatgttgcccaggctggtcttgaactcctggcctcaagcagtcctccctcttggcctcccaaagtgctgggattacaagtgtgagccaccaagtccgtcctctttcttctcttctcttttctttattttctttctttcttgagatatgatctcactctgtttaccaagctgcagtacagtaatgcaatcatagctcattgtagcctcaaactcctgagctcacatgatcctcctgtttcagcctcccaagtggctaggactactggtacatgcaaccacacctggctaatcttaattttttgtagagatgaggtcttgctttgttgcccaggctggtggaaactcctggcttcaagtgatcctcccactttggcccccccaaaagtgctgggattataggcataagctactgtgcctgggcactttcatttatttctactctttattatttctttccttttactagttttaggtttacttgggttttaaaatgtttaattcctttggtgcattgttaggtttttatttgtgatctttcttctttttcaatgtagacatttattgctataagatttccttttagaactgcattagctgtgtcccaaggattttggtatgctgtatttccattttcatttctctcaagaaatttttagacttccttttaatttcttcattgacctgttggtcatataagagcatgttgtttaatttccatgtgtatttgtgaattttcagaagttcctgttgttactgatttctagttttataccattgtggtaaaaaaaaatatactggaaatgattttggttttcttaaatttgttaaggcttgttctacaggctaccatatgatctgtcctagagaaagtttcatgttctgttgagaagactgtttattctgcagctgtttggtcgaatatgctgtaaatgtttgcttggtccatttgatttagtgtgtcctttaaatgtgatgtttctttattttctgtctggatgatctgtccattgctgagagtggcatgctgaagtctccttatattattttattgcagtctattcccttagatctataataattgcttcatttacttgggtactctggtgttaggtgtatacatattaaaatttttcgtatcatcttgtggaaatgactccttttcattatataatgaacttcttttctctttttatagtttttgccttaaagcctattttatctgttatgattatagctactcctgctctctcttggtttccatttgcatggaatatcattttccatctcttcactttcagtgtacctgtcactctgagcaggtaccccctggaattggtatgcctggttggtaagtatgtaggcagcagaagtctgccagtttggggcagggctccatggaagcaacatgtctggctggtatgccattgtcacacgggggccaaatcaccaacttggggcaggggcacctggaagcaacatgcctggctagtgagcgcacagggttgcacatggacagtgaacctggctggtgagtgtgctgactgtgcacatcactgggcagtactcagtttctttacttggcaagattacctattcctctagggacagagtaccacttgcctttgtgctggagcagtggacttaggctctgagaggctagggttggttgctgcagtcacctgaatgtgcaagacagagcccttcctaggcagcttattctcagaggatagagtgctgtaacagcttggctggggaatggtgcaccaccactaaggtggtgtaatggcagtgcagcttcagcaatgaaaagatgcagttattgctggctcttggagcaggatacatgctagctgtggctctgttttcaagatggcactgtatagctgcagcttgggttttggtgagggaaaggtgtacagtgagtaattaaattgaaaccataatagaaagtctccaatcaaagaaaagcccaggacttaatggcctcactgctgaattctaccaaacatttaaagaacaaataccaattcttctcaaactagtcaacaaaattgaagggagacaatacatccaaactcattctataaaaacagcatactctaatacaaaaaccagagaaggacataacagtaaaaggaatatccctggccaatacccctgatgaacatgaatgcaaaaatcctcaacaaaatacaagcaaacagggccttgtcatggtggctcacacctgtaatcccatcactttgggaggctaacgtggaggatcacttgatcccaggagtttgagaccagtctgggcaacatagtgagacctcgtctctacaaaaaaaaatcaaaaaatgaggcaggagaatgactgaagcctaggagatcaaggttgcagtgaggcatggttgcaccactgcactcccacctgggtcacagagcaagaccctgcctcaaaaaaaaaaaaacaaaaatactaacaaacagaattcgacagcacgttaaaaacataattcatcccaaggatacaagaatggctcaacatatgcaaatcaataaatgtgatacagaatgctagtggaatgaaggactaaaccctatgatcatttcaacagatgaagaaaaagtatttgacaaaatttaacatctcttcatgataaaaacttaacgaattatgtatggaaagtatgtacctcaatacaataaagaccacatatgacaaacccacaggtaatactatattcatcagggaaaagtttaaagctttcctacttggagtttattgagctttgtagatatgtagattaatgtctttcatcaaatttgtgacatactctgtcattatgtcttggaatattctttccgctcctttctatcactcctatccttttaggactctctctgtgcacttattggtctgcttactaatcttctacaggaccctgaggctcttttcatcatttttctttctttttgtctcacagacagggtaaccccaatggacctatcttcaagttcattaattcattcttttacctgctgaaatctgttgtttaactgttctagtgagtttttcatttcaattattgtacttttcatatccaaaatttctgttttgttttgtttttattatttctgtctctttattgatgctatctatttggtgagatactattctccaggtttcccttagttatttttctatggtttcctttagctgtttgagcatatttaaaacagttgatttaaatttgttgactagcaagtctaatatctgggtttcctcataaacagtttctattaattgtttttcctatgaatggggcatacgtttttgttttttttctgaatgcctcataattttttgttgttgttgttgaaaactgggtagtttcaatattataatgtggtagaaatcagatttttacctctctctaggattttttgttgctacttgttgtgggttgtaattgttagtttagtagcttttctaaattatgtttgtaaaggttgtgttatttgccacatgtagtcagtgaattctctgtcagttagcttagttctcagatagtgatttcgcagagatttccttaaattccagaaaaataacaatagttctcctagtctttgcagattggctttttgttggtgtattatcttcaatgcttagctgggccacttatattttagccatgtcctgcttctgtagagcttaaaagtaagccacaggtgaaagcttagggtcttttcacatattttctgagaataggtctgaccctcagcatgtatctgacctcctacattccctgatatttgcaggagctttccagagcattttttttctcatgtatctgcttccccagccttttccttcccaggctttttattctgtctgctgcttgctccatctattatcccttgcctcagttggctgtggctagtacatttgcctttaagtgctttcaacaaatattatgaaaaaggccactctagctctgagaaagttccaaggtgggcaaaataaagtcaaggtcctgagcccataccttagggagctaccaggcaggccaaaatatataaccatagttttctgagatgaagatgtatattgcttcccttgcagcagcgagccacatcagtaatgtagactaccatctccaaggccgccactaagctggggaataggggatggcagagagggaagtcagcatgttgtatcactctcttaccaaaatttagtagtctcttaagtctcaggatacaaaatcaatgtgcaaaaatcacaagcattcttgtacaccaatagcagataaacagagagccaaatcatgaatgaactctcattcacagttgcttcaaagagaataaaatacctaggaatccaacttacaagggatgtgaaggacctcttcaaggagaactacaaaccactgctcaacgaaataaaagaggatacaaacaaatggaagaacattccatgctcatggatagcaagaatcaatatcgtgaaaatggccatactgcccaaggtaatttatagattcaatgccatccccatcaagctaccaataagttacttcacagaattggaaaaaactactttaaagttcatatggaaccaaaaaagagcccgcatcaccgagtcaatccccaagccaaaagaacaaagctggaggcatcacgctacctgacttcaaactatattacaaggctacagtaaccaaaacagcatggtactggtaccaaaacagagatatagaccaatggaacagaacagagccctcagaaataatgccacatatctacaactatctgatttttgacaaacctgacaaaaaaaagcaatggggaaaggattccctatttaataaatggtgctgggaaaactggctagccatatgtagaaagctgaaactggatcccttccttacaccttatacaaaaattaattcaaaatggattaaagacttaaatgttagacctaaaaccataaaaaccctagaagaaaacctaggcaataccattcaggacataggcatgggcaaggacttcatatctaaaacaccaagtgcaatgtccacaaaagccaaaattgacaaatgggatctaattaaactaaagagtttctgcacagcagaagaaactaccatcagagtgaacaggcaacatacagaatgggagaaaatttttgcaatctactcatctgacaaagtagtctctttttttaactaagcatttccctggtttttgtagttggtgtaagtttatttaaattagattctagaatttgaaaatgtttattcttatagtttcttcctgcttagttattgctttcatggaggtacggagttccctactccaccatttttggtgatatcaccaatgataggtatttttcattgccaccaattattctttttagctttgagtatttcaaatgggaacttctcagtgaagcgaaggtagtttacatgtacttattgacaactgtagtgccagaaattctgcatttccttaagatataaaaaccagatttaggctgagcgtggtggctaatgcctgtaatcccagcactttggaaggccaaggcgggtggatcacctgaggttgggagttcgagaccagcctgaccagtatggtgaaatcccgtctctactaaaaatacaaaaataaccccagctacttgggaggctgagactggagaattgcttgaaccctggaggtggaggttgcagtaagccaagattgcaccactgtactccagcctgggcgacagagggagactccatctcaaaaaaaaaaaaaaaaacaaaaaaccaaaccaaaccaaacaaactagttttaggggaagatggagtcaacatatttttcctactccccccactaagtaaaactaaagcccatggacattatgaaacaaatattaacccatcatgaaaaattcagagtagaaggcagattgactagggtccacaggacctaaggaacaacacgattgtgagtttcatgggttttctttttgcctcatataacccagacttggagctgaagaagctggcaacccatacataacacgggaacagaaaaaaaagccacaaatagaagccatctctttctagccaaaggaccagaaaagagcctagtaacacagaaaacttgagaaaataactgctctatgtcaaatactacagaaaacactatggctctacttagccagaaaaggccatgtcaggagtctagatttctggcctcatcaagctatcacaaaatacccaaatggccccctgccagggtggtgtcagaaaaagccaagtggggagttggaatttaaatccctaaaagacacttctgttcctgaggtgtcagtggagaccatatggaaagtctggacttccactaagtggtaataaggtaactcttcccctccccacttggatatgatcagaggaaggctagtggagagtctggactttcacctagcattaatgtgtccatgccctgtgttgtcattggaggtcacatggggaaaagcaatgagccacttttatccaatgcagctagggtgttattaacatagactgagtggggggcctgaatccccacttctacccagtagtactatggggcacctccccaactcaagtgtcagtggaaactaaatggagaaccttgacttacattcccacctggcaataatgaggaggcactcctccttctttattatcccctgccaaaacagttttatagtaagcctgctaaaacagcagatctaaatgcaatccagagtctcttcacaaaattacctaaatatttaggttttagttgaaaatcagccatcagaccaagaacaaggaaactaacaactgaaaaaaggcagtcaatggatgccatcattacgatgcctcaagaaacaattgcaaacctgattgaaacaaatgaaaaaagtctcagcaaagaaattcaagatataaaggagaaccaaatgaaaattattcaaatgaataatatagaaatgaagaaaactaaatggatcagctcaacagcagagtggaagggaaagaggaaagaatacatgagcttgagatataaaaatagaaagtacccagtctgggagaaaactgacgaaaaaaataaataaacagagtcacaggggtctgtgggacaataatgaaagttctaacacttgtataattggaaacttggaaggaaagaggaaagatggaaaacctcaaaaagcactcaaataaataatggctgataatattccagtatggcaaaaggcttatacgtatagattcgagaagctgagtgaacatcaaacaggataaaccccaaataaagttacatgaaaatacatcatagcaaaatttgtgaaaactaaaatattcttttttttttttttttttgagacacagtctcgctctgtcatccagtctggagtgcagtggcatgatctcggctcactgcaacctctgtctcccaagttcaagtgatcctcccacctcagcctcccgagtagctgggactacaggcacacatcaccacgcctggctaactttttgtctttttagtagagacgggattttgctatgttggccaggctggtctcgaactcctcacctcaagtgatccaccttccttgacctcccaaagtgctatgattacagccgtgagccactgcacctggcctaacaaactattgaaagcagcaggagagaaattacaccttacttataggggaaaaacagtttaaatgacagtggatttctcatcagaaatcatggaagccagaaggaagttgcacatttttaagtgccaaaaaaaatatatcaatgcgaaatcttataaatggtgaaaatagtctttttttgagactgggccttgctctgtcacccaggctggtgtgcattggtgcaatcatggctcactgcagccttgacctcccaggctcaaatgatcctcctgcctcagcctcctgagtagctgggacaacaggcatgcaccaatcatgcccacctaatttttgtattttctgcagagttggggttttgccacattctccaggctggtcttgaactcctgagcttaagtgatttgcccaccttgggctcccaaagtactggtattacaggtgtgagccactgcatctggcccaaaaatattctttaggaatgaaggagaaatgatgatattctcagatgaaataaaacgtgtttgtcaccagcagacctaccttaaaaggaagacttaaggaagttctctaaagagaatggcaatgataaaagaaggaatcttggaacatcagaaaagaagaaagaagaatggaaagaatagaaatatgtataaatacaatagacttttcatctcctcttgaattgtctcaaatgtatgacagtggaagcaaaaattataacgctatctgatatgattctaaatgtatagagaggaaatgtttaagataattatattataaataggggagggaaaagggatgtaaaaggaaggaggatttgtagacttcattcaaacttataaaatgctgacaccactacacgatgatacacggacacacagagagagtatgtataggcacacatataatatactgcctagagaaaccactgaaagacctatacaaggagatacactcaaaaacactttagattaatcaaaatgaaattgtaaaaaagtaacccacaggaaggcatgacaagaaaacagaaatgacagattgaacaaacaaaaacaataacatggggaattaagctctaacatatataattatcttaaatgtaaatgatcttaatacaccaattaaatgaaaaaaattagcagagtggataaaaaatatatgctgtctacaataattgcacttcaattataatgaaatagacaagttgaaagtaaaaaaaaaaggatggaaagagaagcattatgaaaacataaatggaagcagcagaggccatatcacatagtatcagattaaatagacttcagaagaaatttatttgggcaagatggctgatgacacagccaggtggaacagctgccaccaagggaactgggacaactagtgcactcctagaagatcttcagagggaaggcactgagagtgggcagagggaaggcactgagagtaggcagagggaagacacagaagctgggctgaagttggaggaagctggggaccctgcacggggccaccatgcctgggacttgttactggctcctaacaacaatgggggaatgggtgagttgaactggcaaggagcaaccctctcttgccatgggcctctggaatcctggcaggagaagacccccagaccatgatggacacttgagttggcagggagagaagtttagagaagtgttaggggcagcatgccagccagttgtggagcacagagggcttggtgcaggaacatctgtattggagcagagccagggatgcccatccccctaactcgacttgctgtcatagtagactttagtcttaggggaactagtgggcctgaactctgcagggtggtcttgtccatcactcaggccagtctgatctgtgcaccccttggtcttctggcctctcttagggccccagcctggccacattggtttgcagtgcagtcttggtaccctgggggtctgcatcatagcttctgagctggtggactgcacctgactgctgatgagctatagcagggtggcccccgaggtcacgtaccatcccacccactcgatacccacaatacagcttcctgtgggcccagggccacttcccacattgccttgaccgcacatgtgtacgtggggccaatcttgccttcttccctgcctggccagcacatatatgcactgaaccatgctgtgccactgctgccagcagcagttcactacaactctctaccctccaccgctgctgtaccgccattgcagttggagccttggcaggcacaaagccaggcagttccgcccctgcaagtgaaactaggcacagagactagcagaccctcccctgccctgagcctgcataaacatgcacagagggtggacacagtcctgcacccaccagtgccctacccccatgctaacaccactagcaggaccacacacacagtcaccagtcaggcctctgccctcctgagcctccaccgccactactgtgaatgcctgcatggaggcaggcatgctggcacctcctagcaccctgctgcagcaaacaagcatgcaccccgctgtgctgccactgccaccactgctgacacatgcaaacaaagatgaatcccactaccatcaccctatgaaacactttagctgttaccactcattagagtgtagtgaccagcggtctgtgagcacctcggcccttctagcacagcaggttcataatttcaaggagccaaagaacaaagcagaggcttgatagcagtcatccagagttagcacatggagttccggagtcctgagctgaggcttggcctcctaaaatcttccagaaatgaacccagtcaactgaacccaccttttgccacaatcaaaccccaaggtcctcaaatagaataaaatttaaaaacatccaaaggacagtgacttcaaagattgaagaaacatcagctgataaaaatgagtgcaagaactatgacagcttgaaaagccagagtgtcttctttcctccaaatgacagtactagttcttcaacaagggttcttaaccaggctaagatggctgaaatcacagaactagaatgcagaatatggaaagaaatgaagataattgctccatcttttcagtcttctggattcaagacacaacaatattgaaattaggccaactaataaccatgcaatggcctttaagtgttcaagtgaaacgaagagtcacatgtttctcactttaaatcaaaagcttgaaatcattaagcttagcaaggaagacacgtcaaaagctgagaaaggacaaaagctagggctcttgcaccaaacagcccaagttgtgaatgtgaaggaaaagttcttgaaggaaattaaaagtgctactctagtgaaaacacaaacgataagaaagcaaaacagtcctattgttgataaaagttcctaactgtcttcaattctttgaaggctgagaaaagtgaggaagctgcaggagaaaagttggaagctacctgagcttggttcatgagttttatggaaaggagtcatctccataacacaaaagtgcaaggtgaagcaacaagtactgatgtagaagctgcacaagttatctagaagatctagctaagataattggtgaagatggccacactgaaggacagatttttcaatatagatgaagcagctttctattggaagaagctgctacctagtactttcataattagaaagaagaagtcagtgtctggcttcaaatttccaaaggacagcctaacttttgttagggtttaatgcagctggtgacattcagatgaagccagtgctcatttatcattccaaaaatcctagggcccttaacaattataataaatctattctgcctgtgctctataaatagaacaaaaaagcctagatgatagcatgtctgctcacagcatggtttactaaatattttaaggtcactgttgaggtgcactgtgcagaagaaaaggtttctttcagagtattactgctcaataacagtacaccaagtaatctaggagctcttatggagatctgcatgcagatgaatgttttcatggccgctaacataatatccattctgcagcccatggatcaagtagtaactttgactttcaggtcttattatttaggaaatacactttgtatggccatagctgccatagattgtaattgctccaatgtacatgggccaagtaaataaatttctgggaacaattcactattctagatgccattaagaatattcatgattttgggcggagacaatggggttttctaaatatacaatcatgtcatgtgcaaacagggacaatttgacttcctcttttcctaattgaatatcctttatttctttctcttgcctgattgccctggccagaacttccaacactatgttgaatgggagtggtgagagagggcatccgtgtcttgtgctggttttcaaagggaatgctccttaagctgataagcaacttcagcaaagtctcaggatgcaaaatcaatgtgcagaaatcacacggattcctatacaccaataacaaacaaacagagagccaaatcatgagtgaattcccattcaaaattgctacaaagagaataaaatacctaggaatccagcttacaagggatgtgaaggacctcttcaagaacaactaaaaaccactgctcaacgaaataaaagaggaacaaacaaatggaataacattccatgctcatgggtaggaagaatcaatatagtgaaaatggccatactgcccaaggtaatttatagattcaatgccatccccatcagactaccaatgacttccttcacagaattggaaaaaactgctttaaagttcatatggaaccaaaaaagagcctgcattgccaagacaatcctaagcaaaaagaacaaagctggaggcatcacgctacctgacttcaaactattctacaaggctacagtaaccaaaacagcatcgtgctggtaccaaagcagatatataaaccaatggaaccgaactgagccctcagaaataacaccacacatctagaaccatctgatctttgacaaacctgccaaaaaaaaaaaaaaaaagcaatggggaaaggattccctatttaataaatggtgctgggaaaactggctagccatatgtagaaagctgaaactggatcccttccttacaccttatacaaaaattaattccagatggattaaagacttaaatgttagaactaaaaccataaaaaccctagaagaaaacctaggcagtactattcaggacataggcataggcaaggacttcatgactaaaacaccaaaagcaatggcaacaaaagccaaaatagacaaatgggatctaattaaactaaagggcttctgcatggcaaaagaaactatcatcagagtgaacaggcaacctacagaatgggagaaaatttttgcaatctacccatctgacaaagggctaatatccagaatctacaaataatttaaacaaatttacaagaaaaaaaaaccccatcaaaaagtgggcaaagcatgtgaacagacacgtctcaaaagaagacatttatgcagccaacagacatgaaaaaatgctcgtcatcactggtcatcagagaaatgcaaatcaaaaccacagtgagataccatctcacaccaattagaatggcgaacattaaaaagtcaggatacaacagatgctggggaggatgtggagaaataggaatgcttttacactgttggtgggagtgtaaattagttcaaccattgtggaagacagtgtggtgattcctcaaggatctagaactagaaataccatttgacccagcaatcccattactgggtatataccgaaaggattataaatcatgctactataaagacacatgcacacgtatgtatattgtggcactattcacaatagcaaagacttggaaccagcccaaatgtttatcaatgatagactggattaaggaaatgtggcacatatacaccatggaatactatgcagccataataaaggatgagtttatgtcctttgcagggacatggatgaagctggaaaccgtcgttctcagcaaactatcacaaaaacagaaaaccaaataccgcatgttgtcactcataggtgggaattgaacaatgagaacacttggacacagggtaaggaacatcacacactggggcctgttggggggtgaggggctaggggacggatagcattaggagaaataccttatgtaaatgacgagttgatgggtgcagcaaaccaacatgacacatgtatacctatgtgtcaaacctgcacattgtgcacttgtaccctaaaacttaaagtataatttttctaaaaaaaagaatattcatgatttatgggaggaggtcagaatatcaacattaacagaagtttggaaagagttgatgccaactctcatggatgattttgatgagttcaagacttcagtggaggatataacggcagatatggtgaaataccaagagaaatataaatagaagtggttcctgaagatgtgactgaattgctgcaatctcatgataaaacttgaatggatgaggagttgcttcttatggatgagcaaagaaagtgatttatttgatggaatttactcctagtaaagatgctgtgaacattgtcgaaatgatagcaaaggatttataatattatataaacttagttgaaaaagcagtgtcacggtttcagaggatcgtctccagttttgaaggaagttctgctgtgggtaaaatgcctgaaatagcatcacatgctacagaggaatctttcatgaaaggatgagtacatcgatgtggcacacttcattgttgtcatattttaagacattaccacagccactccaaccttcaaccaccagtaccctgagcagtcagcagccatcaacgtcgaggcaagacttcccaccagcaaaaagattactacctgctgaaagctcaaacgattgctggcattttttagtaataaagtatttttaattaagatatatacagtttttagatataatgttgttgcatacttaatagactacagtatattgtaaacataattacatgccaaaaaattgtgtgactggctttattgtgatactcactttactgtgacaattgctttattgcagtggcctggaactgaacctacattatctccaaggtttgacagtaatttaattcataatttgtgacttcaaaatcttaactagtattggaagtcctagccatagaattaaggcaagaaaaataaatgaaagacctacagattggaaagggagaaataaaactgtctctatttgcagatgacatgattgtttatgtagaaaaaatcccaacgaatctagaaaaccagagaacaactgtttttttttgcatttacaagtttaatataatatacacaaatcaattgctttccaacatactagcaatgaacaagtggaatttcagattaaaaacacaataccatttacattagcacacaaaaaatggcatacttagctataaatctaacgaaatatatgcaagatcaacacaaggaaaactataaaaatctgatgaaatcaaagaactaaataaatgaagagatattctatgctcatggatagaaagattcaatattgccaatctgtcagttcttcccaactttatagatccaataaaatctcaatcaaaatcttagtaagttactttgtgaatactgacaggctgattgtaaagtttatatagagacaccaaagactcagaatagccaacacaatattgaatcagaataacaaagttggagaactgaaactacctgactttaacacttactgcaaagctacaataattaagacagggtgttattggaaacaaacaaacaacaagtacaaatagatcaatggaacagaatggagagcccagaaattgacccacagaaatataatcaactcagctttgacaaaggaacaaagacaattcaacagagaaaggaaagtctttttaaccaatggtgccagaacaactcaacatccacatattaaaaaagaaaaaaattgaatctagacacagagcttacacactccacaaaatttaactcaatataggttatataacaaaacataaaacacaaaactatctgtatacgccatgccacgtatacagcacatgacatttatagaaatggtattattaatcgttatgtagaaatagtttatagactggaatcaaatgaaaatattgtttataaaattggaaaataaaaaattaggaaatattgtcagaaaaatataggtataactataatagatgatactatattctgaattataaataggaaagccaaaaaactaaaaaataaatcataaaaagtattatgccctgtcagctgggcacagtggctcatgcctgtaatcccagcactttgggaggccgagtccagtggatcacgaggtcaggagatcgagaccctcctggctaacacagtgaaaccccgtctctactaaaaatacaaaaaaaaaaaaaaaaaaaaaatagccagccgtgatggcaggcacctgtagtcccagctgctctggaggctgagacaggagaatggcgtgagactctgtctcaaaaaataataataaaaaaaaaagtattatgcttcgtcaaaagtttttttgaattcttagctaattctctttttatttttattattattattatactttaagttttagggcacatgtgcacaatgtgcaggtttgttacatatgtatacatgtgccatgttggtgtgctgcacccatcaacataggtgacttcaacgcaatcataggacacaatatcaacatacataaatcacttgtgcttcatatactagcaatgaacatacagacattgaaataaaaaatatatcattcataatcattcaaataaatacgtaaatgcaaatgtagcaaaacatgtataagatctgctgacaattagaaaatgctgataaagaaattaaagatctaaatgaatggagaggcacattgcatgttcgtggattgtcaaaatcaacacagtaaaaatgtcagcccttcccaaattggtatgcaattacaatacatttcctatgaaaatcgcaggcagattttttttggagatgtagtcaacattattctaaaatgtgtatgtaaagtcagcggaggtagaatagctaagacaatttgacaaagaagtataaggtgggaggaaccattatactcaatttcaagacatttatatggctatggtaatcaagtctgtgcggcagtggtagagggatagatacgaaactcaatagaagagaatagagaacccaaaagccgacctgcacagatacgcctaaattattacagaagtaattaaatgggggaaggatagtcttttcaacaaatgatgctgaacaatccattgccctctccgctcaaaattaaccttcacctacacctcatactttatacaaaatggatcataaatttaaatgtaaaatgctcaaactataaatcttttagaagaaaacttagaaaaatttcaggtaagtcacttgatactaaaagtatgattcataacaggaaaagttgatatattagacctcaataaaattaaaaacttttcctctacagaagctacagagctacagactgggagaaaatactacaaataacgtatccagtaacaaactagtatctagaatatatcaagaactcttaacacgtaatagtaaaagcaagcctagttaaaaataggcaaaagacataaacatttcactgaagaaaatataacagatggaaaataagcacatgaaaaggtgtgcagagattgaggccatctcactctcagcatgcattacattccgccaccgttgctgccattccgctcccgtagttgtctccacctgatctgctctcatgctggggttgaggaagggagttgtacagggagaggagaaggcctcagctgaggcagttgaggaggaggaaggaagcagtggcacagccggcatagcagcacaggcagcctggttcctgggagtgtcggtgtggcatggtggttggggcagatcctgtggggcctgggtaggggaaggagtcatcagctcgttcatagtggacaatgaaaaactagacagccaatggctcaagaattttgagaacaaagtccacaacttggggattatgagaagacagcaaaatgaagttgtagttgaattaaggaagaataaaagagatgaacatctcttaaagagaaggaacgtactgaatgaagatacctgtgaagactgatacaaatgatgattatggagtgtaaaatacctctctagtagctattattcaaaatgcttcaagtgataactaagaaattcaattaaatgcagttcgggctgctaggaagctttgtccagtgatcgaagtctaccaatttataaaaataaaatctggaatactacctgttctagtctattgtcttgaaagagatgacaatgctttacagttagaagctgcatgggctttgacaaacactgcatctagaacctctgaacaagctcaaacagtagttcagtccaatgctgtgccacatttcctgaggctcctccattcacttcatcagaatgtttgtgagcaagcagtgtgggcattgagaactatcataagtgatggtcctcccgatgtagagattatgtcataagtcttggagttgtgaaacctttattttacttcaaaacattttttttttctgtgataggggctcacccaggctggaatgcagtggcgcaaacacagctaactgcaccctcaacctctggagctcaagaaatcatcctgccttagcctcccgagtagctggaaccacaagtgcgtgccaccacacccagctaaatgtttaaattgtttgtagagacagggtctcaccatgttgcctaggctggtctctaactcctggactcaagaatcctcctgcctcagcctcccaaagtgctagcattccaagtgtgagccaccatgcccagcctgggttatggccaatttatgtcaccacaaagagccaccaccaccaatggaaaccatacaggaaatgctttcagctctttgtgttctaattcatcatacatttgtaaatatattagtagatacagactgggccctctcttaccttactggtgctggcaatgaacaaatacagatggtagtagactctggaatagttcctcatttggttcctcttctcagccgccgggtggttcagactgctgcacctcaagctgtgagcaacatggctactggaattgaagagcaaacagaagtagttgtgaattatgatgctctttcatacttgtgggcaatcctgacacatcccaaagagaaaattaataaagaggcagtatggtttctctgtaacatcactgcaggtaatcagctgcagatacaggcagtaatagatgccaatattgtaccaagaataataaaccttttggataagggggatattggcactcagaagctgactgtaaaagatgcacaagttgtacaagtagtactggatgaattaatatattaaaaatggctaaaaatgaggcagaatccatagccaatcttatagaaaaatgtggaggactggagaaaattgaacaacttcaaaatcataaaaatggagacatctacaaattagcctatgagatgattgctcagttctcttcaaatgatattgatgaagatcttagccttgatccagaggcaattcaaggtggaacatttggtttcaatttatctgccagtataccaatagaacagttccagttttagaacagtattgtggaagttaggtacaatttatatacatacatacatacgtatatatgtatatacatatatatgtatatacatatatatatgtttatacatatatgtgtgtatatgtgtatatatatatgtatgtgtatatatatatatatatatatatatatatatatatatatatatatataaatgtttgatccatcaagcttagctcatgggatctgcttctgcattaaattgggaaagaaaatgtgaagatttcatttggaatcacagaaaatgcccaaatgtggtcaagatggtgaatgggtatgagtgagaatgagtggcaaaatgtaatgaaaactttacatgaatgcttatttaggctgttcatagtaaaaagggctacaggtcacagatcttcagtgcctgagaaagaacattgacttactctatataaactgaggggaaagtgtagtactattatcttcaaggcttgtaaccgtaaaagagaattggatgcccacataagtaaaaggaaaatgagcctaggccttgctatgaagcagtgtccaaatggaaaatgttgaatgaatgtctggctcagtgatggacagtcagtatcatctttaaaatctagggctctcattcatgaattagactcctagtcctggagtgactatgtacaggagtgtggtagtggtgctgtatgtgaacacatgcaagcttgatttgccttcaggtggctgatagcctagtaaatcatcaaaatgagatcctgagtgttaatgtacactggacataaaaacaaatactggatcagcagcagacatttgtttactctgcaacttatgttttctatttccccttaccccttttcctccccgcccctgtaagtttttatttacctagtatggctttctttttagttgactctcaagtcagaaaacatttcaggaaggtttccctgtgcatttgcactgaatgaatgtttgatgctatgaatgtctttccttatcaaagctaatttgtgtagatttttgcatgaaaaaaatcataactttttctcaaaacagactgtgctgcagtacacaagttgccataatagtataaaacagtaaaatgtgcttaaaaggccatgcttttcactttcagagagaacataaagatctttgcatgaggtaaatttacagcatagttcattttcagattttgttgggtcctgtagagaagaagaagaaaaaagtttcagttgtgttagaataccatgctgtatttaaatgttacttgttttcaaactttgttttatatgaaaatgatgtggaaacttctaaaatggaatttggcacatatgtactgcttcataaagactgataaagtagtttttgtaaattgaataatacctcagttttgaggttatgtacagtaaatgtgatgtaatttatacagtaagaactctttataaggtggctcattttaggaaatcatgtgccttcccctttgagcacaagtattgtgtgaaccacagtttgctataagaaatatatcacgttaaccaccaatagcctctatatctactttgtgtttaaaaatcaactagtaattctgaaacactgtagaatggataaaaattgttttgtgaacataactctgttgaactagagtatttttgcagtgtgtcttgtcatcagaaatataaagtttaaaactagtaacagcagaaaactagcttatgaaatttatccaaatagagtacaagctaggctgtcttggagaaataaacattaaaacttaaaagaaaaaaaagataaatgttcaacatcattagccaatttggtaaatgcaaatgctcaatcagatactactacacatttatcagaatggctaaaataaaaaaaaatggttacaatacaaagtgctgtcaaagatactgaaaagctgaatttttcctgccttcctggtggggattatagtgactttgaaggattttacatctgataagaatcacgagatggcattaacgcacagcaaactttaagtgatcctttgacagatttgcacctgggaaaatccttcacagcacgaggccatccagactctctggtataggcctgagggcacaacccataaggggaggagggctaaggaactcatgaaggagacggagctgacatgtctattaatatatgatgttgctaggcagcacagcagggagtctgtgggtcagggaactctgaagaccagcagcagcttggggtctttattgccctacagtttttcttgtctatgggtagtagatattttgtgaagttttgcagtgtatgtaaagcaggcaggctctaatgcctaaaaatatactcatgtgggctatatttaaaacaattggctgtgtaacattttcagattggtactatcaagcttttcagctaatgggttcctaacctgtaatgaagaagtaaacagcatagggtccgaggggaggagccaagatggccgaataggaacagctccggtctacagctcccagcgtgagcgacgcataagacgggtgatttctgcatttccatctgaggtaccgggttcatctcactagggagtgccagacagtgggcgcaggccagtgggtgtgcgcaccgtccgcgagccgaagcagggcgaggcattgcctcacctgggaagcgcaaggggtcggggagttccctttccgaatcaaagaaaggggtgacagacgcacctggaaaattgggtcactccaacccgaatattgcgcttttcagaccggcttaaaaaacggcgcaccatgagactatatcccacacctggctcggagggtcctacgcccgcggaatctcgctgattgctagcacagcagtctgagatcaaactgcaaggcagcagcgaggctgggggaggggcgcccgccattgcccaggcttgctcaggtaaacaaagcagccagaaagctcgaactgggtggagccaaccacagctcaaggaggcctgcctgcctctgtaggctccacctctgggggcagggcacagacaaacaaaaagacagcagtaacctctgcagacttaaatgtccctgtctgacagcttttgaagagagcagtgggtctcccagcacgcagctggagatctgagaaccggcagactacctcctcaagtgggtccctgacccctgacccccaagcagcctaactgggaggcaccacccagcaggggcacactgacacctcacacggcagggtattccaacagagggtcctgtctgttagaaggaaaactaacaaacagaaaggacatccacaccgaaaacccatctgtacatcaccatcatcaaagaccaaaagtagataaaaccgcaaagatggggaaaaaacagaacagaaaaactggaaactctaaaacgcagagcacctctcctcctccaaaggaacgcagttcctcaccagcaatggaacaaagctggatggagaatgactttgacgagctgagagaagaaggcttcagatgatcaaattactctgagctacgggaggacattcaaaccaaaggcaaagaagttaaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagacgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgaggagaatggaaccaagttggcaaacactctgcaggatattatccaggagaacttccccaatctagcaaggcaggccaacgttcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccacaagagagtggaggccaatattcaacattcttaaaggaaagaattttcaacccagaatttcatatccagccaaactaagcttcataagtgaaggagaaataaaatactttacagacaagcaaatgctgagagattttgtcaccaccaggcctgccctacaagagctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcatgtgcagagacacacataggctcaaaataaaaggatggaggaagctctaccaagcaaatggaaaacaaaaaaaggcagggtttgcaatgctagtgtctgataaaacagactttaaaccaacaaagatcaaaagagacaaggccattacataatggtaaagggatcaattcaacaagaagagctaactatcctaaatatatgtgcacccaatacaggagcaccaagattcatgaagcaagtcctgagtgacctacaaagagacttagactcccacacattaataatgggagactttaacaccccactgtcaacattagacagatcaatgagacagaaagtccacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaagtaaagatgttctttgaaaccaacgagaacaaagacacaacataccagaatctctgggacgcattcaaagcagtgtgtagagggaaatttatagcacgaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagactgctagcaagactaataaagaaaaaaagagagaagactcaaatagacacaataaaaaatgataaaggggatatcaccaccaatcccacagaaataaaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaagggggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcgataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcaacagacagggatgccctctctcaccactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaattgcttcaaagagaataaaatacctaggaatccaacttacaagggatgtgaaggactcttcaaggagaactagaaaccactgctcaaggaaataaaagaggatacaaacacctggaagaacattccacgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcctacctacaactatctgatctttgacaaacctgagaaaaacaagcaatggggaaaggattccctatttaataaatggtgctggggaaactgtctagtcatatgtagaaagctgaaactggatcctttccttacaccttatacaaaaatcaattcaagatggagtaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgccgccaaaaaacacatgaaaaaatgctcatcatcactagccatcagagaaatgcaaatcaaaaccactatgagatactatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaagccaaatgtccaacaatgatagactggattaagaaaatgtggcacatatacaccatggaatattatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacgtggacacaggaaggggaatatcacactctggggactgtgttgggggcgggggagggggaagggatagcattggaagatatacctaatgctagatgacgagttagtgggtgtagcgcaccagcatggcacatgtatacatatgtaactaacctgcacaatgtgcacatgtaccctaaaacttaaagtataattaaaaaaaaaaaaaaaaaaccagcatagggtccatatacagaggctatctgtggttcatttatataacagtccgtcctctggccccatggtattttttgcttgttttggtttttgtaaaatatacataacataaaatttaccattttaaccattttaagtgtacagtgtaatcagcaatcagaagttgtgcatctaccatcattatccatttccagaactctttcatcatcccaaacagaaactccatagcataacaaaataactctccattttcccctcccagcagcccctggcagccctctattctactttctggtctttatgaatttacctattctaggtagctcatgtaagtgaagtcatagaatatttgtttttgtatgtgtttgtgtctggcttatgtcacttagcatagtgttttcagggtccatccatgttgcagcatgtatcagaacttcattcctttttgaggctgaaaaatattctattgtatggatatagcacattttgtttagtcatccattgatggacatctgggttgcttctaccttttagctttggctaataatttgtctatgaatattggtattcaactgtctgtttgatttcctgcttcgagttctttggggtataacctaaaagtggattgttggatcatatggtaattttatatttaactttttaaacgacttcgaagttgttttccacagtggctgtgccattttacattcccatcagcaatgcacaaggactctattttttctgtatcctcaccaataattgcatttttccttttattttttggatagtatccatcctagtgggtatgaagtagtatctcgtggtttcgatttgcattttccttatgactagtggcattgagcatattttcatgtgcttattgtccatttgtatatcttctttggagaaatatctattcaagtccattgcccatttttgaattgggttgttttttgtggttgagttttaggaattctctatatattctttatatcaatcccttaccatatatatgatctgcaaatattttctcccattctctggttacctttttattctcttgatagtatcttttgatgcacaaaattttgataaagtacagtttatcaatttattctttgttgcctgtgcttttagtgtcatgttgaggaaatcattgccaaattccatgtcatgaagatttccccctatgttctcttctaagaattttacagttttagtcttgtaaatcttgtgagagaaaaaaagaattttacagttttagttcttgcatttaggtttacctcaagagaatctaggaaacaattttgtgtgtgtgtgtgtgtgtgtgtcagaaacatctcattttaagttttattcaggtgcacttacgggagagccaaagtaatagcttcctttagtttatctagtacctcgttgctcaggttctcactgaaaagtgagacttacaggtgactcagtagcaaatattggaggtgaggagtgtgttggagccagaatataaacattcctatcaaatgttggatcttctttaccagtgtgggaggttggagcactaggagcttgtcttaccagactgagaatacttcacccttctgagttccaaaggtaaccccaagatttaataaagaggtcttgtaccttatgtgggggcagttgcccatctgctataggcgatatttatgttctcccaaattcatatgttgaaatcctaactcccaatgtgatggtattaggagataaggcctaggcattaagagaaggcaaagccctcatgaatgggattagttcccttataaatgagaccccagagacattgttttctccttctgtcatgtgaggacacagcaaaaagacagtcatctatgaagtaggaagaggaccttcaccagatgccaaatctgctgtcatctcgatcttgcacttcctagcctccatgactgtgaggaataaatatctattgtttataagccacccaatttatggtattttgttatagcagcctaagtggactaagataccatcccctctcattgaagtgtttgctcacagttgtgataacctcagagacagaatcttggtaagatttagtaaggaggattttatcaatataatgccaaagctgaatttctggtggaaataatggggcaggcatctaggtcatatctgcacaagttcgatcacagggctatttgagtatcccataggtggctgggaaaaaatatactcttcaccctcaaaagtgaaggcaaattgtgattaactctcctacaaaatatttcccaattggagcatgttaggcaagtctataactccatgccatttatctatgttgttttgaatgtcatccattaaggtgatgatatctagtagaagtgctccaataaaaaggtgctcttatttaactctctatagttagcttccatttattaatagtggctttacacataggctataccagaggattgacaggtgagatggtaagaatcagtacacgttatttaaataagctatgatagcctataatccttcagggtcttgccttagcttgtactgtgccgtatttaccacctgccctggtaggggaaagttaactggttcccaccaggtagtgcccaccaataccataaaagccttaggttctatggagttacgagctgattgaagaagtccattcaaataaggaaaggggatagtctcaggggtacaaccagaatcaaagcatcttttagcagaactggatcaattttaatagttaagtaagtaattgctcctttacataatcatcctcctggacagggtgaggagtgaggggattcctttagagcatgagtgattcttaggattagggagatttgggcacccatgtccaacaaagccagccaatgttgtagagccaaactacagttaatatggtaaaagggtgattgtctactggaagtagccaccttctgcaaccaccagatccctatgtgggtgtgggtccctgccactggaggagatcaggagcaggcttcccaagtgaggctgactttgaatacctgctgcagattgtaatctaaccctagtaaatgttaatacttgcttcaccaatgtatgagagaacatccaatttgggcccctttgtcccttagggtccaatgtaaccccttttgtttactcagggttcaagctaaaccacggacctggctctacgtggtttgcttggtctagaagggtgcagcataactgttgatagtaattttgatttaggctagaaggggttatagtcatagaattaacaggcaacacttgagtttgtctttcatgtatttctactaaatccagtgaagctatgaactcttcagttgttttagcattagccattattgcccaaaaagaggacttacacttatcaggcgccctcctgagaaataagtcgttagacaagggattgaattccgtttcctctggacttgccaagtcatcatgctgcaggtcatctgttgcctgataaacccacttcagcatccccagctgatgtaggagatctttgaccttggttaacattttccattgacagtcttcccaggcctttataaggcctagtataggatggaaagcccaccaagccaagccgtaaaaatccacatcaacaaggtatatgtggactgaggcacaaagcctcttttgagggtcactcctaccttccatgcttattatgcgggatactttggcagtgacaccatttttttccatcttgtactatggcagccaattgtttaattcccctattaggtggagtttgctccctgccagatacattctgtatatatagtcaggcagcccctttttcattcagttcctgggtcaggtccttacggagagactggacataagggcaagaaagatgatgcattttctgctccaaaagagaagtggccctcttcttttgtttttctgtctttatgactttgccagtggttactggcaaagcagagggtaaatgatcctagtccctagcatgatgacaccatgctgctgctttcttctttagaggtcaccagttctcttccccaggatcttcccttccaactcatctcctgcaggagtttgagtttctacctcctctctgtgcaaaccctggtgaaaagcaaccaacagcgaggtccaacatgcacctactttatggtttggagcatcccttgagtaggatagccacttcctttggtgtcctggaatgtaactttccttgatttagtcacttgaaataatgctttagtcggctcagccaaaagatggagagctcaacatacttccaacaaaggactagaatgagagtatctaaagcataattgtcatgatagcagaggactactagctgcttgcaagtgtctcccaattgtgcttaggagaccagcatcggactgacatatctgccttatcagcttgtttgcctgccatagcagtgtccaaggacaaggatattctctcatctcagagtattctcatcacatatcaccagtctggacatggggaactctcctactatagcccattatgggatctggggtaacccacatgtggtccagaggtatgtactttccctttttctattcaggcccacaggtgcctacctagtgcctttctagtgggagatccaggtgatcaggctgaccttccctgggcagcttggtgcctctctctcaaaagtcagttctgatggcgaggatttactcaaatactggcactaccacttgtccaggctcatgaggcatgggggagaccatagaaaatatagagtgtaattcagtacagaagaatgccatgccaaagttatgcgaacgtgttccaaattctgagtcccaagcacttaaggtcgtccagggttgttttgacagttaatcctcctattgacttggtaggtcccatattgatttcctggtcatcaccaaaattccatccttgttgccacttgtaatgagttgagggatttcaggactgatcaaggaaagaaggaaaagatatgaccacagtagcacacaacaagctttttgaggggtgtgtggggtgttcagcaggcaacactttgacaggttagcatgagtgtagaggccagcacgcagaaggggaggaaggcaaggaaacttctcttcaagaaagaggaatatcagaggggcttacgtgtttagatgactaggcagcatgtcaggaagttgctgggtcagagggttctgaagggcagcagtgatgtggggtctttattactctggagttaatcttatctttggttagcagatgttgggggcagttttgtggggtatgcaagacaggcaggctctaaagggttaaaaatatgcttagtttggctatttaaaacaattggatgtgtaaaaatttgagtttggtactagcaggcttttgagtgaatgagttcccagcctgctaagaaaaaataaacaacataaggtccatatgcagaggctacctttggctcatttatgtaatagaaatatgaaatagtatggagccactttgaaaaacagtttgtcagttttctaaaaaattgaatatgcaaatgccatatgccccaacaattgtacaaattgtactcttggccatatatgccagaaaaaaatcaaactttctgtttatatgaaaacctctacatgaatacttatagcatttttattcatatagtcaaaaactgaaaacaacccagatgtccttcaacaggtaaagggttaaacaaactgtggtccatctgtaccatggaatactgctcagcaataaagaacaaactaaatatatgcaacaccttgcagagaatatgttaagtgaaaaatgccaatttcaaaatgctatgtactgtatggtttcatttacataaatttcttgacaaaattaaagaaatagagaacagattaatggttatgaagggctaaggacagagtccacactccgaggaggtggtgggtatgagggggaggtgggtgtggctactaaaggagagcaggagtttgcctagtggaattgttggtatcttgactatcagtttcagtatcctggttgtgatattgtactgcagttacccactggggaaactgggtaaagagtccatgggaacgctattatttcttttttttatatatatatacaaaatgtttaatgtgcatctggtcagagatggtaataaatgttataagtaaaatataagataaaaaactaaacagcatgtgcaagatcctctggttcataaggtgatcaggggcttggtcttgtgtcccacgactcccagtttagtgctctttgtcctgctagtaatttacttttaagtgtagtaaaatgcacttaaaatttacctttttgaccatttttaggtgttagttcacttttttaggttttaggttagttccaagaaggtccattaccttcttgaccatttttaggtgttagtccacttttttaggttttagattagttccatttttaggttttaattcagtagtgttaggtcaatctttagaactttttcatctgaaaccctacctattaaacaaatcatttcaactgaaaccctaaccattaaataaatcattccacctacccctgacaaccaccaatctactttctatctctgaacatgacttgaccaggtacctcatataagaggaatcatacaatgtttttccttttgtatctggcttattttacttagcgtagtgtccccaaaagtcatccatattgtagcatgtgtcacaatttccttcctctttaaggctgaataatatttaattggttgtatataccatattgtttttatcatctggcagtggacgttgggttgcttcctcattttggcttttgtgaataatactgaatggaacatttttgtaaaagtatatttttgagtccttgctcccaacttaatttttttttttttttttttttttttgcgatggagtctcactctgtcacccaggctggaatgcagtggcacagttatagcatattgtaatccctaattcctgggctcaagtgatcctcccacttcagcctcccaagtagctaggactacatacatgtgccaccacgcccagctaattattttatttttgtagagacagggtcttgctatgttgttcaggctcctattcttttgatacgtatctggaagtggaatttctggattatatgttaaatctgtttttacgttgttgaggaagcaccatagtgttttaaataatggctgcatcattttatattcccaacagcagtggacaaggtttccaatttttccacatcctcaccaaaacttgttattctttgttctttgttccttttattgggatagtagccattctaatgggtgtgaggtgatatatcattgtggttttgattttcatttctctattagtgttgttgaacatctttttaatgtgtgtcttgtccattttaatttctttggagaaatgacaaagtcctttgcacactttataattgtttttcattgttgttgttgttgttgtagaagtttttaatatattctggatatttatatatatatattttttattatactttaaattctagggtacatgtgcacaacatgcaggtttgttacatatgtatacatgtggcatattggtgagctgcaaccattaactcttcatttatattagatatatctcctaatgctatccctcccacctgcccccaccctacaacaggccccggtgtgtgatgttcctcaccctatgtccaagtgttctcattgttcatttcccacctatgagtgacaacatgcggtgtttgggtttttgtccttgcgatagtttgctgagaatgatggtttccagcttcatccatgtccctgcaaaggacatgaactcatcattttttatggctgcatagtattccatggtgtatatgtgccacattttctaaatccaatctatcattgttggacatttgggttggttccaagtctttgctattgtgagtagtgacgcaataaacatatgtttgcatgtgtctttatagcagcatgatttatattcctttgggtatatacccagtaatgggattgctgggtcaaatggtatttctagttctagatccctgaggaatcgccacactgtcttccacaatggttgaactagtttacagtcccaccaacagagtaaaagtgttcctatttctccacatcctctccagcacgtgttgtttcctgactttttaatgatcgccattgtaactggtgtgagatggtatctcatagtggttttgatttgcatttctctgatggccagtggtgatgagcattgtttcatggctcataaatgtagctgttggctgcataaatgtcttcttttgagaagtgtctgttcagatcctttacccactttttgatggggttgttcgttttttcttgtaaatttttgtgagttcttttagattctggatgttagccgtttgtcagaggagtagattgcaaaaattttctcccattctgtaggtttcctgttcactcttaagggaggtttttttttttttttttttttttttttttttttttttttttttttttttgctgggtagcagctctttagtttaattagatcccatttgtcaattttggcttttgttgacattgcttttggtgttttagacatcaagtccttgcccatgcctatgtcctgaaaggtattgtctaggttttcttctagggtttttatggttttaggtctaacatgtaagtctttaatccatcttgaattaatttttgtataagatgtaaggaagggatccagtttcagctttctacatatggctagccagttttcccagcaccatttattaagtagggaatcctttccccattgcttgtttttgtcaggtttgtcaaagatcagatagctgtagatgtgtggtattatttctgagggctctgttctgttccattggtctatatctctgttttggtagcagtaccatgctgttttggttactgtagccttgtagtacagtttgaagtcaggtagcgtgatgcctccagctttgttcttttggcttaggattgacttggcaatgcgggctctttttttggttccatatgaactttaaagtagttttttccaattctgtgaagaaagtcattggtagcttgatggggatggcattgaatctataaattaccttaggcagtatggccattttcatgatattgagtcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtttgttattggtgtataagaatgcttgtgatttttgcacattgatttttgtatcctgagattttgctgaagttgcttatcagcttaaggagattttgggctgagacaatggggttttctagatatacaatcatgtcatctgcaaacagggacaatttgacttcctcttttcctaattgaataccctttatttctttcttctgcctgattgccctggccagaacttccaacactatgttgaataggagtggtgagagagggcatccctgtctgttgccagttttcaaagggaatgcttccagtttttgcccattcagtatgatattggctgtgggtttgtcataaatagctcttattattttgagatatatcccatcaatacctaatttattgagagtttttagcatgaagggctgttgaattttgtcaaaggccttttctgcatctattgagataatcatgtggtttttgtctttggttctgtttatatgctagattacgtttattgatttgtgtacattgaaccagccttgcatcccagggataaagcccacttgatcatggtggataagctttttggtgtgctgctggattcagtttgccagtattttattgaggatttttgcatcaatgttcatcagggatattggtctaaaattatcttcttttgttgtgtctctgccaggctttgatatcaggatgatgctggcctcatgaaatgagttagggagcattccctctttttctgttgattggagtagtttcagaaggaatggtaccagctcctccttgtacctctggtagaatttggctgtgaatccttctggtcatggacttttttgtttggtaagctattaattattgcctcaatttcagagtctgttattggtcaacatcttcctggtttgctcttgggagggtgtatgtgtcgaggaatttatccatttcttctagattttctagtttatttgcgtagagttgtttatagtattctctgatggtagtttatatttctgtgggaacagtggtgacatcccctttatcattttttattgcatctatttgattcttctctcttttattctttattagtcttgctggcagtctatcagttttgttgatcttttcaaaaactcagttcctggattcattgattttttgaagagttttttgtgtctctgtgtccttcatttctgctctgatcttagttatttcttgccttctgctagcttttgaatgtgtttgttcttgtttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatcttcatttctgccttcatttcgttatgtacccagtagtcattcaggagcaggttgttcagtttccatgtagttgagcagttttgagtaagtttcttaatcctgagttctagtttgattggactgtggtctgagagacaaaatttgttataatttctgttcttttacatttgctgaggagtgttttacttccaactatgtggtcagttttggaataggtgtggtgtggtgctgagaagaatgtatattctgttgatttggggtggagtgttctgtagatgtctattaggtctgcttggtgcagagctgaattcagttcctggatatccttgtgaactttctgtctcgttgatctgtctagtgttgacagtggggtgttaaagtctcccattattattgtgtgggagtctaagtctctttataggtctctaaggacttgctttatgaatctgggtgcttctgtattgggtgcatatatatttaggatagttagctcttcttgttgaattgatccctttaccattatgtaatggccttctttgtctcttttgatctttgttgatttaaagtctgttttatcagagactaggattgcaaaccctgcctttttttgttttccatttgcttggtagatcttcctccatccctttattttgagcctaagtgtgtctctgcacgtgagatgggtttcctgaatacagcacactaatgggtcttgactctttatccaatttgccagtctgtgtcttaattggagcatttagcccatttacatttaaggttaatattgctatgtgtgaatttgatcctgtcgttatgatgttagctggttattttgctcattagttgattcagtttcttcctagcttcgatggtctttacgatttagcctgtttttgcagtggctggtaatggctgttcctttccatgtttagtgcttccttcaggagctcttgtagggcaggcctggtggtgacaaaatctctcagcatttgcttgtctgtaaaggattttatttctccttcacttatgaagcttagtttggctggacatgaaattctgggttgaaaattcttttctttaagaatgttgaatattggcccccactctcttctggcttgtagagtttctgctgagagattctctgttagtgtgatggggttccctttgtgggtaatgtgacctttctctctggctgcccttaacattttttccttcatttcaactttgatgaatctgacaattatgtgtcttggaattgctcttctcgaagagtatctttgttgtgttctctgtatttccagaatttgaatgttggcctgccttgctagattggggaagttctcctggataatatcctgcagagtgttttccaacttggttccattctccctgtcactgtcaggtacaccaatcagacatagatttggtcttttcacatagtcccatattttttagaggctttattcgtttctttttattcttttttctctaaacttctcttctcacttcatttcattcatgtggtcttcaatcattgataccctttcttccaattgatcgaatcatctactgaagcttgtgcgtacgtcacatagttcttgtgccatggttttcagctccatctggtcatttaaggacttctctgcattggttattctagttagccattcatctaatctgttttcagtgtttttaacttctttgccatgggttcgaacttcctcctttagctggtagtagtttgatcatctgaagccttcttctctcaactcgtcaaagtccttctccatccagctttgttccattgctgttgaggagctgcgttcctttggagaaggagaggcgctctgatttttagaattttcagtttttctcttctgttttttccccatctttgtggttttatctacctttggtctttgatgatggagacatacagatggggttttgttgtggatgtcctttctgtttgttagttttccttttaacagtcaggacaatcagctgcaagtctgttggagtttgctggaggtccactccagaccctgtttgcctgggtatcagcagcagaggctgcagaacagcgaatattgctcaacagcaaatgttgctgtatgatcgttcctctggaggtttcatctcagaggggtacccagctgtgtgaggtgtcagtctgcccctactggggggtgtctcccagctaggctattctgggatcagggacccacttgagtaggcagtctgtccattctcagatctcaaactccgtgctgggagaaccactactgtcttccaagctgtcagacagagacatttaaatctgcagaggtttctgctgccttttgttcagctataccctgcccccagaggtggagtgtacagatgcaggcaggcctccttgagctgcagtgcgctccacccatttcgagcttccaggctgctttgtttacttactgaatcctcagcaatggcgggcacccctcccctagcctcactgctgccttgcagttccatctcagactgctgtgctagcaatgagcgaggctttttgggcgtgggaccctctgagccaggtgccggatataatctcctggtgtgccgtctgctgtgaccattggaaaagcgcagtattagggtgggagtgacccaaaattccaggtgccatctgtcacagctttgcttggctatgaaagggaattccctgaccccttgcgcttcctgggtgaggcgatgcctcgccctgtttcagctcagtcggtgggctgcacccactgtcctgcccccactgtccaacaagccctagtgagatgaacccagtacctcagttggaaatacagaaatcacccgtcttctgcatcactcacgctgggagctgtagactggagctgttcctatttggccatcttggagctctccccttctggatattaactccttactagatatatgatttgcaaatattttctcccattctgcaggttgccttttcactcttctgatagtgtattttgatacacaaaagtttaattttgatgtagcccaatttatccatttttattcttttggtcttatatctgtgatataagattgctgaattcagtatcatgatgttttatcctgtgttcactgtcaataattttacaattttcacccttacctttaggtcttttatacactttgagttaatttttgtttatggtgtaaagtaagagtccaactttattctttttgttgtctatttttttctaattttattttattttaggttccaggatacatgtacagaatgtgcaggtttgttacataggtaaacgtgtgccatggtggtttgctgcacctatcaacctgtcatctaggtattaagccccacatgatgctctccctacccccaccccttctgacaggcctcagtgtgtgttgttcccctccctgtgtccacatgtggttccaagtcttagctattgtgaatactgctgcaataaacatatgtgtgcttatatctttataatataattatttatattcttttgggtatatacccagtaatggcattgctgggtcaaatggtatttctggctctagatcattgaggaatctccaccctgtcttccacagtggttgaactgatttacattcccagcaacagtgtaaaagtgttcctatttctccccagccttgccagcatctgttgtttcttgactttttaataatcgccattctgactggcatgagatagtattgggtggttttgatttgtgtttctctaatgatcagtgaagttgagctttctttcatatgtttgttggccgcataaatatcttttttttttttttgagaagtatctgttcatgtcctttgccctctttttgatggggttgtttttttccttgtaaatttgtttaagttccttgtaaatttgtttaagttccttgtaaattctggatattagaactttgtcagatgggtagattgcaaaaattttctcccattttgtaggttgttcactctgatggtagtttcttttgctattcggaagctctttggtttaattagatcccatttgtcaattttagcttttgttgcaactgcttttggcaatttcatcataaaatctttgcccatgcctattttctgaatggtattgcctagattttcttctatggtttttatggttttgggttttgtatttaagtatttaatccatcttgagttaatttttgtataaggtataaggaaggggtccagtttcagttttctgcaaatggctagccagttttcccagcaccttttattaaataaggaatcctttctccattacttgttgttgtcaggtttgtcgaagatcagatggtagtagatgtgtggtgttttttctgagatctagattctgtttcatttgtctatatgtctgttttgggaccaataccatgctgttttggttactatatagccttgtagtatagtgtgaagtcaagtagtgtgatacctctagctgtgttctttttgcttgggattttcttggatatatgagctgttttttgatttcatattaatttttaagtagttatttctaattctatgtaaaatgtcaatagttctttgatgggaagagcattgaatctctaaattaccttgggcagtatggccattttcgtgatactgattcttcctatccatgaggatgcaatgtttttccatttgtttgtgtcctctttcatttccttgagcagtggtttatagttctccttgaagaggtccttcacatcccttgttagctgtattcctaggaattgtattctctttgtagcaattgtgaatgaagttcattcatgatttgactctctgcttgtctgttgggggtggtatagcaatgcttgagatttttgcacattgattttgtatcctgagactttgctgaagttgcttatcagcttaaggagcttttgaactgagacaataatgttttctggatataggatcatgtcgtcagcaaacagagacaatttgacttcctctcttcctatttgaataccctttatttcattctcttgactgattgccctggctggaacttccagtactatgttgaacaggagtagtgagagagggcatccttgtcttgtgcctatattcaaagggaatgcttccagcttttgcccattcagtatgatattggctgtgggtttgtcataaataactcctattattttgagatatgttctgtcagtacctagattattgagagtttttaacatgaaggacattgaattttatcgaaggccttttctgcatctattgagataattatgtggtttttgtcattggttctgtttatgtgatgaattatgtttattgatttctgtatgttgaaccagccttgcctcccagagatgaagccgacttgattgtggtggataatctttttgatgtgctactggattcagtttgccagtattttattgaggatttttgcatcaatgttcatcagggatattggcctgaagttttctttctttattgtgtctctgccaggttttggtatcaggatgatgctggcctcataaagtgagttaaggagaagtcgttccttttcaattgtttggaatagtttcagaaggaatggtaccatttcctctttgtacctctagcagaatttggctgtgaattcatctggtcctgggctttttttagttggtaggctatttattacagctgcaatttcagaacttgttatttgtctattcaataactcgacttcttcctggtttagtcttgggagggtgtatgtgtccaggaatttattcatttcagtttcattcttttgcatgtggatataaagttttcccagcacccatttgtttgaaagactgtcctttctgcattgaattatcttggcactgttatcaaaaatcacttcattgtatatgcaatggtttatttctgggttctccattctattccattggtccatatgtgtgtattcatgccagtacaatattgtactgattactgtagcttaataatatcttttgaagtcaagaagtgtgtgacctccaactttgtcttatttttcaagattgtttttgctattcagggtcccttgcaattccatatgaattttaggatgtattttttccatttctgtaaaaaaacaccattgtgattttgatggaaactgcattaaatctgtaaatcactttgggtagtattgacatcgtaacaatattaagtctttcaattcatgaacaggaaatgtctttccattcatttgtgtcatctttaaattctttcaacaatattttgtagtttattgtttataagcctcttacctgcatgcttaagtttagtgaaagcaggctttcttgtctcattcacaatcttaaaggtaaagctttcagtctttcaacattgagtatgatgtttagtattttcatgaagatttttgcatctatattcaacatcagcaatattagcctataattttctttggtataagggtaactctggctaacacgaaatgagtttggaagcatgccctcctttttgatttcttgaaataatttgagaagtgttagggggaaggggtggctttgggcacagcttcatcagacttaagtgttcctgcctgccagctctgaagagagcagtggatctcccagcacagcgcttgagctctgctaaggggcagactgcttcctcaggtgggtccctgaccccatgcctcctgactaggagatacctcccagcaggagtcgacagacacctcatacaggagagctctggctggcatctggcaggtgcccctctgggacgaagcttccagaggaaggaacaggcagcaatctttgctattctgcagcctccactggtgataaccaggcaaatagggtctggagtgggcatccagcaaactccagcacacctgcaacagaggggcctgacttttagaaggaaaactaacaaacagaaagaagtagcatcaacattggctgggcatggtggctcatgcctgtaatcccagtactttggaaggccgaggcgggcagatcacaaggtcaggagttcgagaccagcctgatgaacatggtgtaaccccgtctctactaaaatacaaaaaattagttgagcatggtggcgcccacctgtagtcccagctcctcaggaggctgaggcagggtaatcacttgaacctgggaggcggaggttgcagtgagctgagatctcaccattgcactccagcctggaggacaaagtgagactccatctcaaaaaaaaaaaaaaaaaaaaaaaaaaaaaaaccagcaaaataaatagcatcaacatcaacaaaaaggacatccacacagaaaccccatctgaacctcaccagctacaaagaccaaaggtagataaatccacaaaaatgaggaaaaaccagtgcaaaaaggctgagaattccataagccagaacgcctcttttcctccaaaggatcacaactccttaccagcaagggaataaaactagagggagaatgagtttgatgaattgacaaaagtaggcttcagaaggtaggtaataacaaactcttccgagctaaaggagcattttctaactcaattcaaggaagctaagaaccttgaaaaaaagttagaggaattgctaactagaataaccagtttagagaagaacataaatgacctgatagagctgaaaaacacagcacgagaactttgtgaagcatacacaagtatcaatagccaaattgaccaagcagaagaaaagatatcagagattgaagatcaacttaatgaaatatagcaggaagacaagattagagaaaaaagaatgaaaagaaatgaacaaagcctccaagaaatatgggactatgtgaaaggaccaaacctacatttgattggtgtacctgaaagtgatgaggagaatggaaccaagttggaaaacactgcaggatattatccaggagaacttccccaacctagcaagacagaccgacattcaaatccaggaaataagagaacaccacaaagatactcctcaagaacaacaccaagacacataatcatcagattcaccaaggttgaaaggaaggaaaaaatgttaagggagagaaaggttgggttacccacaaagggaagcccatcagactaacagcagatctctctgcagaaaccctacaaaccagaagagagtgggggccaatattcaacattcttaaagaattttcaacccagaatctcatatccagccaaactaagcttcataagtgaaggagaaataaaatcctttacagacaagcaaatgctgagagattttgtcaccaccaggcctgccttacaagagctcctgaaggaagcactaaacatggaaagcaacaactggtaccagctgctgcagaaacataccaaattgtaaagaccatcagcactatgaagaaatcgcatcaactgacaggcaaaataaccagctagcatcataatgacaggatcaaattcacacataacaatattaaccttaaatgtaaatgggctaaatgccccaattaaaagacacagactggcaaattggatagagtcaagacccattggtgtgctgtattcaggagacccatctcacatgcaaagacacacataggctcaaaataaagggatggaggaatatatacccagcaaatggaaagcaaaaaaaagcaggggttgcaatcctagtcttaaaacagactttaaaccaacaaaggtcaaaaaagacaaagaagggcattacataatggtaaagggatcaatgcaacaagaagagttaactatcctaaatatatatgcacccaatacaggaacacctaaattcataaagcaagttcttagagacctacaaagagacttagactcccacagaataatagtaggagactttaataccccgctgtcaatattagatcaatgagacttgaactcagctctagaccaagcctacctaatagacatctacagaactctccaacccaaatcaacagaatatacattcttctcagcaccacattgcacttattctaaaattgatcacataattggaagtaaaacactcctcagcaaatacaaaagaatggaaatcataacaaacagtgtctcagaccacagtgcaatcaatttagaactcaggattaagaaactcactcaaaactgcacaactacatggaaactgcacaacctgctcctgaatgactactgggtaattaatgatcctgaatgactactgggtaattattgaaattaaggcagagataaataagttctttgaaaccaatgagaacaaagacacagcgtttagagggaaatttatagtaccaaatgcccacaggggaaagcaggaaagatctaagatcagcaccctaacatctagaactagagatgttctaggtctagaactagaatctagatctagaactagatcaacaccctaacatctagaactagaatctagatctggaactagatcaacaccctaacatctagaactagagaagcaagagcaaacaaattctagcagaagaccagaagtgactaagatcagatcagaactgaaggagatagagacatgaaaaacccttcaaaaaaattaatgagtccaggagctgtttttttcaaaagatcaacaaaatagatagaccactagccagactaataaagaagaaaagagagaagaatcaaatagacacaatttaaaaagcattaattctttaaatatttgggagaattcttcagtgaagcctctagccctgggcttttctttgctgggagatttttgattcctgattcaatttctctacttaatattagtctgttcagtttttctttgtgatttagtcttggtaggttgtgtgtttctagggatttatccatttattctgggttatccaatttattggtacattgttgtccttatgatcttttttatttttgttgcatcggttgtaatatctccttttctgtttctgattttatttattcaagtcttctctttttatttcttggtctagctaaagttttatcagttttggaaatatttttttccaaaaaataaacacttcttagtttctttctttttttttttttttttttgagagagactcactctgttggcctggctgcagactggacgaggctcaagcagtcctccaaacctagctcccaagtagctgggactacaagcatgtgctattttctaaatgtttttttagcgatgggggcctctctatgtagtccaggctggtctcgaactcctggcctcaaacagttctcctgccttggcctcccaaggtgctgggattatagacgtgagccactgcacctggccccacctcttagtttctttgattttatattcactatttcatttatttcttctctaacctttattattccttcctccactacctttgggctagtttgttcttttcctagttcctgagatataaagttaggtttttgattttagatctttcttcttttttagtatcactataaattatcactataatttatcactataaatttctcttttttattaacatttttaattggccagtcataattgtatatatttcaggggtacaatgtgatgttttgatatatgaataaaatgtggaatgattaaatcaagctaattaacatatccatcacctcatttagacatcatttttgtggtgagacacttgaaatttactctcttctcttcagttttgaaatatgcaatacattattgtcaaccatggtcaccatgctgggcagaagacctcaaaaagtcattccttttatctagctgtatctttctaccctttggccaacatctccccattctctcctatctcagcctctgataaccacaattttactctctgtttccatgagtttgattgttttagattccaagtgtaagtgagaagatatagtttttgtctttctgtgtctggcttatttcacttacatagtgtcctccggttccttctacgttgtcacaaatgacagcatttatttcttctttaaggtagaatagtattccattatgtatgtatatatcacattttctttattcagtcatctattgatggactcttaggttgagtccatatcttgactcttgtgaataatgccagaatgaacatgagagtgcagatatttcttcaaaatactgatttcagttcctctacccagaagtgggattgctggatcatatggtagttctatttttaatttttgtcaaacctctgtaccattttctgtaatagctgtgctaataaatttccttcttaatactgcctttgctgcatcctacatgttttggtatgttgtggttttgtttgtttcaagatactttccaatttcccttttgatttcttctttgacccattggttgtttaagagtgtttaagttttttaatttccatatgttttaactttacaagtttcctttatgctattgatttctagtttcattccattgtgaacagaagaaaatacttggtatgattttaatcttcttaaatttgataagctctcttttatgacctaacatgtgatctatcttggagaatgttacatgtgcttttgaaaagaatgtgtattgtactgttattgggttgaatattctgtatatctgttaggtccatttggtccacagacttgttcaagtctgctatttgttttttgattttcctctctgattgttctatccataattgaaagtagagtatcgaagtaatctattactgtatttctgtctgtttctcccttcagttccatcagtgtttgctttacatatttaggtattttgatgttgaatgcatatacatttataattgttatattttcctgatgtattgatcctttcgtcattatataaaattcttcattgtctccgtgacattttttgacttacagttcattttgtctgatattactattgccacacctgctttttttaagttacaatttgcatggaatatctttttttatccctccactttcagcctatgtgtgcccttaaatctaaagtgagtctcttatagacagcatataataggatgtttttcttaaactattcagtcattctgtgtatttttattggggagtttaatccatgtatatatttcaagtaattattgataggggaggatttactgttgccattttgttcattttttctgtttgccttgtagggattttgttgttcttcttttcatttcttgctttcttcctttatgttttgttttttttgtttgtttgtttgtttagtttttatattagtatgctttgatttctttcacttctttcttttttttttaacttctgtaggtatttcctttgtaactacaatggggcttacataaaatgtctaacagtctaacactctgtcttaagcatgtaacaacttaacttcaattatgcacacattacacattttcttcttctctatgttattcatgtcaaagtttacatttatttatattgtatattcattagcatactttataattattctaatacttttttaaactttatactacaattaaaagtgatttacccacaaccattacagtaatatagtattctttattagtttatatacttaccttcaccaacaacttttatacttttttatgctactgtgttgctatttagcattctttcattttcattttcatttccctttcaatctaaggagaagacttccctttagatttcctgtaaggcaggtctgttggtaatgaactcccttagcttttgtttgtctgggaatgtcttgatctctctttcgtttttgaagaacagttttgctacatatatcattattggttcatagttttagttttccttcagtgctttgaatatattatcccactctctactctcttctgtcctgaaagtttttttttgctgagatgtctgctgatggtcctaatggattttcctgcatatgacaagttggttttatcttactgctttcaaaattctctctgtctttgacttttgacaattttattatcatatgtcttagtgtggatttctttagattcatcgtgttttggtcattttggcttcctagatctggatgtccatttccttcctcagatttagggggttttcagtcattacttctttaaataagatttctagtccttcctatattctcttgggactcccataatgcatatattggtctgctaattaatggtgtcccataggtcctttaagctattttatttttttattcttttttctttgtgtccttctgactggataatgacaaataatctgtgtttgagtctgcttagtcttttttctgcttgctctagtctgtcgttgaactcctctattggattcttcagttattgtattcttcagctttaagacatctgcctgttcttttacattttctgtctctttgttgaaattttcattttgttcatggattgttctcctgagctgcttgagattttccatgatggatatttctaattctatgtcgggtaattcatatattttcattagagtcagtttctggagttttagcttgtttctttgttcagattgtgttaccctttttctgcacgtcagaagaatccactctcaccccaagtcatatggattggccttgtacaggagaagacattcaccagccaaccaagccagagcttctgtgggcctttcaacccattgtcctagtttaaactgctgtctttgttattagtgtcccccaggcatccagagtatgtccagtttcatcagtgttcctagacaggtggcacaaaagccattcccttggtagctcctggagaatttagaatgctgtgtgcatgttccaactcttttcccttcccagggagaagctgggaactgggattttccccctaccctgtgttgagccaggtacaggagctgtggtacatgcctacatgctagttgaaactgccactttcttctctgtagccctcaggatactatcacatgccagaccctttcaactctttgaaacaggtgagacagaagccagtctttcaggtggcacctggagaagttgggatgttaggtgtgcagtccaacttcttccattctgagatagaagctgggaatgggggtttcctcctgatcctatggcactgtgctgggagttgggattatgatgagtggatgtttctgctttttctacagatgttttgtttacaatctggttggtttcatacttatccagggtgcagaagcctctccatgagttgctggatttctcataaagggaattgatccttgtgttgcaattaaatcagtgtatccattgggggaaggacagtccagggcttcctattctgccatcttgctgatgtcactcctctcccttattatttcataaaactacatgtgagtctataattatctcaaagtaaaatcataatttgattgtttaaaagaacctcaagtttgctcaagtctaaaatgtctccttcagctgagatttttctgctggtatctttactcttcccaattatgagcatgtccaggctttttaatgtcatcaaattacagtactcatgagattttcccacctactaagccaatattttcttggcacaaggaaaacattggtaatcaattactccagctaaactaacccacttttccccccatttttgtctatttgaggttctggtgtgggatgtataaccgctttgacaaagggctgcagcccaagcagagtatgctagagagcctcctggaaattaagaaacagagagcaatgctggagacagatgtgcatgaactagaaaaggtgaggagaaaagtcccaaagagagatcttcttgccccttctgggtaggtccagcctgcttggagttgaattgatacttgtggaaagctgactggctggcttttttatactctttggcttttcatgtgtcccgtgtctacaaatctctgagcataactccttttcttacttcccaaaatgtggtaaatatgtcactcaactagataaacaagtgaatttgttccctttatctctttttggatctggatggaatgaataggaggaacaagagggaatgactagggaaatcacatagcatttgttatccatcaagagaataagtataacatcttgggtatactgataagaacagtgcaattgctgttttccaattaggaaaatcttacaaaagaagattcttatttccttcccatgtaaactgcaaactctgcttattgagtgaccatgttggacacttgttttttaattacaggttacagaagtcaaaaagtatttcttgttgatttcataaactgagctgcttatgaaatgtaggaatccctaagggtttgtttgaaggacaggggaaaggtacctcttagaaaagaattattggaaatggtgtgctatttaggaactgggtgtgaacccactttaagccagataaggcatagcttttctgctccctgtaagtaaacaaatgtcattttattgtgaaaataaatgtgttgtgattacatcagatcccaaactttttaatgtcctcttgggaggcaacagccagttacttggttccattttttttaaaggtggaggggggcaaactaaagcataagttaaaatcgtaggaaacatgcatccccgagaaggcccagtcctaagtagattagatgtagtagagaaacttcttaacggctcctcttttagctactagcagattcttccacaaggccagggaaggtgccctattattgacccagccctctcacttatccctgcctgactcttgagagagaatcagattcatttcacatatacccagatcactctagaaagacttccttttgaagtgtgtatgtgtttttatgtatgtgtgttattaactttctttttttaatacagagcagaaaaacaaagctgctgataatatcacccagacaaccctgttgacttttttttaaaggcaatataagtgttaagttagaaaatacagaatacaacaaggtaaaaaatgaaaagtttaaaagactccccccaccaccttcagaaaaatgtatgcatttttctgaagagaaggtccataattttcatcagattttcaatggggacgtatgaccccaaagaatcactgttgtgaagtatcagtgaatcattatattatctctgaaagtgaaaatatctgttagaggtagcatgatgtagacgacaggtcatagactttggcatcaggcagatgcagggtcagatctcagttctttactttgtacatgtgcgaatttgggtgacttacttaacttctctgagcctcagtttcttcatttgtaaaatatagctaatacctaaactaataggtttattataaggataaaaggaaatactgtgtgtaaagtgcctagcacatagaggtattcaataaatattagtgatgttttcccctgccctctccccatctcatgaacaaaattgcacttatcataaaagatgacttttatagatataagacctttgacattcttcaatggtagggcttctaaagtactatgacatgtgatgagggaaagatgttgtgggggagggggtgagcaaaaggtcatttgctaccattataagtgacagcaataggatctctgcagatcaaggtaatgtttgcctagtttttctcctgtttctaattcttctcaaccctttcttgctcctgaggcagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaattttactttcaggtatgcttagtcatgggatgttagctaacattattgccaatggagacatacaatattttcctgagaaggaaatcaaaatgatgcttaattgttagcatgagtgcatgggtgcttggtggtttgaaacatgtaaggaaagttttcttaagttacaacacttgctttccccaacccacaccccagctaggtcttgttataatacttagccaattccttttttcatagatagcccataggtaaacttgaatccactacagtctaaaattataaatttcaaattaatggggtttgaattagtaacattaattgcatcagtttaggaagtaactgaaaatctcagtgcttcagactcagactgagacatggtctgtgtgcccatctgggtttgtgcaaaataggaccctttttaggtctttttatgaagacaagtggttttgcttatctagatatcacatgaggtttgtagattttttagacacaattggcactacttttaaatctggtaggtttatcacctttttttttttttttttttttttttgagacggagtcttgctctgtcgcccaggctggagtgcagtggggcgatctcggctcactgcaagctccgcctcccgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggtttatcaccttgtgctaatgtacagttttgaaaaaagtccattctgatagcagatccagatacttctggggaaaaggatgtatttttatttaaacaccagtttttctcctaggggttgatacacttgatgggtttttcatctgtcctattggatattcagtcatgattttgctacttccacatactgagagtaggataggcctcagtcagtttgggtcatgctctgtatattctcagcaattccagaactcttaatgccaacagaatccaggtcttcacccaaaatctgttccaaatactctatatttggcttaagctaaaacattagatgacttaaagaggcatcccttgattatcacatccagttgtgcacatagaaatctctaaaggattacctcattaggtgctttcctttgaaagaaagaggtgccttttaagggtttaatttaaatataggagaggagtgccaggatagctccttgatttcttatctctagctgtaaactgtagacccaaaacatcctctttagtggaagaactctaaatcattttggttgtctttttttatatgtaagcaggagtcatttttctatttacttcctcttggtaaatttttaattttttgtttttgaataactcctaatttatttgggtctttcccattaataaataagggccatattttacttacatattcttgatagctgccttgatcctataattttaaagcatcaagacgatttcctttttttttttttttatctctctggtcctcctctttccatgctttagtccttgctttatataacctaaattatcagatgttgccagttgtcatttgacttcttttgggaaaaaaaaatggggtttgtgcacaccgttttaatctggaggctacatctactcctggctttgtgaaggaagttgccaaaaaggatgatggtaccaatctgcctccagtgagccattctggatcttgctcccagatctttctcccatatctcaatctgtattttgcagttcattaactagcatgatgttctggatagagtgtgtttagttttcagggaagctgaaagtaaaaaggtaaatggcaagatgtagtagtttttgcaaattctataaaaaactaaagagtcttgatttattcctaaagatctgtacaggg

SEQ ID NO: 17485 - DNA, 10053 bp, Human
cttagttccctagccacactagctcctctccactcaaggacatcatattatgcctcttctcaacttaaacacagcttatcagggaagcatttccagattccccacctcttccctgtgactgtttcctcggtagcacttatcactgttttttattttgtatttgtttaactttaattgctacctgtgtcccctcctatctgtaagctccatgggtaggaaatacttttcctgcccatttttttaaatatcagcacctagtgctgacctggcactagtaacccttgaataaatcttgaatggatggatgaataactgttagaggatacagcatgccaagtacttaatagaggtacagcacagttcgggggaggggggtgaacccaagtttagggccccactgtaatggccatcattattgggtagaaaacacaacatgaggctgggcaccgtggctcacgcctgtaatccaagcactttgggaggccaaggtgggtggatcacctgaggtcaggagttcgagaccagcctggccaacatggaaaaaccccatctctactaaaaaatacaaaaattagctgggcttggtggctcgtgcctatggttccagctactccagaggctgaggcaggagaatcgcttcaaccaagggggcggaggttgcagtgagctgagatcacctcactgcactccagcctggagacaagacgccatctcaaaaaaaaaaaaaaaaaaagcgcaaagacttggagatagacgctttgagcagtgaagctggcttcaagtaggataaggatagactcacatgagtccatgagagccctaggctggtgcagtcagtgatggatcacagctggtttgtgggaaggaggggcagaggggaagtaacccaacatttgggggatttgcagtagtcccaaaggaggaccaggatgtagtgtgtggtggctgcatggaattcagtagctgtgccacaataacttggggccttactgtttgcagacagcatctgtctgggaagttcagggtgggagggttgaagttatattggtggtacccaacttttatccgcatattcttcagcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcaccctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctcacatgcgttacgggttgattggtacatggggatggagtctcatgctgccctaagctgagagctttactcccaattcactcccttccctcgcagtgactttctcattctccctgggtacatcgacttcactgcagaccaggtggtgagtatgatcaggaattgggtcctgaacatcaaggtgagctaaggtgctactatcacctggtctctgggctaactcaccagattgggcttgggggtggattttataggatcatgttgcttgttagcatgcaggtcatacaaaagtgcctttttgtgggggactcagtaacaccttgaggtgtaagggatgctttcccacactggttgacgtttgtctcctcaggacctgacttctgctctgaccaagaaaatcactcttaagaccccactggtttcctctcccatggacacagtcacagaggctgggatggccatagcaatggcggtgagccccatggggtgtgggggaaggagcaaggactccatcgcctttccccaaaggcattcagtcctgcttcttgtcacttagtagtagtctctttttatcctgtagcttacaggcggtattggcttcatccaccacaactgtacacctgaattccaggccaatgaagttcggaaagtgaaggtcagaagggcaacgatcattagcaagcgctcctgggaattgcactgaggtggggtggggtgggagtaggggtttattctaatttagtattctttcttcccaccatggggttcagttactgagaagaccctgagattctgtttcttaaagcagcagcaatagaccaggtgtacagtgcctccagcctacccatgtctctaagatgtgttggtgtgatttggtcttgtggcactgccaaagggatcgataagcagagaccccatgcttcagatcaagagcctgatgaaagtagttcaaagatgcgatgccctttctcaccatccctttccagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagaggtgggtgccactggcagagtagatccaagctctagcagcccaggttgaagacaaggggcttctgttgtctaagacatctctgatagcctcttctctctgggaaaggagtgtcaaaccaagtttctgactcctttattgggttcctgcatcctttccccaccagaggctttcaaactgcccaaatgcttgctagtattcatgctttgttcttttaaacccctaaggtaggggcagtgcttgaggtctgccctgattttcttgccattgttcctgtgttgtcctccttattccatagtgtaagagggtgctccctgtgccatgttgtcctttctactcatccctcactcaataccatactgctaagaattattgggatcccttgaggaagggtgttttgggtgtgaatgtatgaacgtggtggtccatagaacttcacccctgtaatctcagtactttgggagactgaggcaggcaaatcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaagatccctccagacataaagtcccacagccccaaatgcccttctactgtcacgggttgctatagtaagtccagcccggcccactggcccggcccagctgcccactgcccggctgcttggttgacgtagctgtagctcccggggtttgtggtgctgatgggtgggcaaggccaactgatacacagaccatggtttgggggtggtgctcaagaacatagctccctcttccttctggggtgctgatagggcaggaccttcttccctaggcaggaccttttctgcccacatcttctgcagtaggcatagttcagggaccaactcctttgtgtggtccttgctctcccacacaaccactgcctgctccacacaaccacagcctgctctcctacacaaccactgcccttatcttgcctgagctgcccaccattcagggaggaagggctgggcctgacctcagtgcctctggggactaactgcacggtgactcctgccccatctgataccagctggacgggggctttcccggctgctaagactgcatgtgcctgaggctgccctgggcactgcacacatgcacgtgcacatgtgggggtgagtagaggtcagcacagctgtttgtactatttaaggcagatgtggcagcagccatcccagacacgtctgttcctcagccaagctgcagtcctgatgcagatgtagccaaaagctcctgggtcctaaatatggccacagggtccactgcccgtccccattaaccctatccacccatgtgttcctccatctcaacagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacaggtgaggcccagtacccgtgaaggccagtgggaccccctccctagtgctgcttaggctctaacccaagcactccatctgtccgcagtcatgatgggctctctcctggctgccaccactgaggcccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgaggtcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccagaaaaaaaaaaaaaaaaaaaagcccagtgtagtggtaggggcctctaattccagctactcaggaggctgaggcacgagaatcgcttgaatccaggaggtggaggttgtagtgggccaagatcacgccactgcactgcagcccgggcgacagcgagactccatctcaaaaaaagaaaaacaatcagcgattttgtgagaaaagccgttgaggtcctctcaaatctgcatgtgagcaagtaggtctacaacaggcaaacatactgcttcccgacttctgaaaagtcaaggaatcctaagtaatctagatgaaaaagtgactccttggtttcttcacattcccctccaagagcccagtgagccatcagctcctggccagcaacacacctgatacaaaatgggagaagtgtataaattattatgttgataagcaagataagtgccaaagggtagataagagtgaaagcattgggaagcctggcagagtgcagtcagcaggtcagttcctggcggttcattgagcagcttggcccaaagatgtaagtgaagtccctcctggtggagggatgagagcagctccagttactcggccttcatgacacaggaagttgaaggtggcacaggcattgggctgcaaagaaaaggccagcatcagcctgtctagcgccaggcctgtgctccccgcagcatgccccagtcccgggactcaccgtgtcctgcacttccacagcaatgccccgctgcctcatggcttgaagcacctgggactgcagcctctcggtccggtctccagtccccaccaccacgatctctagggaagggtgggtgtggctagtctacagttctgttgagaggctgcagtgggggtcgccttctggggcccagaacacctctgttctccctccccttccccagtacctatccggggctccagcaaccagaagagggaaaagctgtcttcggtgatgtcctggtgggatcccacctgtgcagggaggaggcacatttaatacgacaaatccacgcagcctctccccatctccatccactgcaggaggagacagaggaaagccaagtttgcagggaccaagcagggtgagggcctgtgactctgggcctcagtttccacactgcgggccaggactcacgttccactgcaccaccgagtgcgggagcagagcgcaggggccgagcacgcggtttccgtttatcatgaagccgcggctgttgtagctgtcgatgtacattgcctgagcggcctcgcgttgcagcagagagatgcgcgtccgctgatacagctcgtcatccgccggcgagagccgatgccctcgccgcggggccctgcggagggaaagggtcaggggcgcggggccgggccgggcagcccgagaggccggaaggtgctgggctggcagtcgccggcctagggggctggatggtcgagggcgcggggtccaagctcaccagggaagctcaacgggcggacagcgcagcgagggtcgcgctcggtacaagctacgtagcgcgagagcggtggccatggctgaccaacgcgcggcgaagtcgtcaccggcgccgttagtccccgggttgggagggccctgcggagcctgacccagcgtggctgcagcgccccctgcgtcccggagggcaccgcacagctcgaccggcccagcaggcgagtgtcctcagtcttaggaggccgagttccccgacctccggcgcagctccagtgtcagcacctgccgccctccccgccccgggcccttgcccatagtcccgggggagtggaacacctggcagcgtggccaccctcagggcgttgcctgggccgcagccgcggcctggcccccgggctctcagctattaagccgcgctcccggggcggggcgaccgcccacctggtcgcgtcccgaacacctggccaggcggtgggtgccagacttctagcccctaattccagcctttggggcttcgggcaccgtgggcggggcagccggctcaagtttctccgg

SEQ ID NO: 17486 - DNA, 56976 bp, Human
  misc_feature (1)...(56976): n = A,T,C or G
cccttcattgctctttagccactagcaggctaggtagggtgttcctaatctgcaaccggaatgtttctggtaggagccatttctcacccactctttgtcctcttttatcacttaaaatcacggaaggctgttctgaaagcggctgggctccttgtaacattaaaaaattattaaactcagaaactaattctgttttttaatcataaatatgaaaactaggaagcaaactgagaagaatgaaagaccaaatcagcggatctgaagcaggccactctcaggaagactcctgaggaataattaaggctaattttaaatatcacctcctgggtatcatcatcaccatcgttcccaggtacctgtctgagatagtccattttgaaatagatataccttaaattatgttaaaatgtactaagcacttattgagctcagtgatcctgaaatatgcctaacaataagctgcctagttgccacttattagctaggtttatgtctaggaggtctaggagggactatgaagaatatgagctgtttaattaggggtacttgtcatcactaatgaacaacaagaaatagtttgaaaacttctttgagatattcacttgcaaatgtcacccgaatttcagaaaagtacagtctctggagtaaagctattatacactcagagagactgttgtgctttgcatgcgttatatcatttagtcctcaaaacatgttgtcaagattggcattattatctccattttaaagatgagaaaattaggtgcaaagagcttcagtaacacactcaaactcattcaacaataaataactaaaaattgtgctatacacactttaagagtcacatgttcctcccccaaaattatgaaaggccatagaaggaattcaagaagtaggcttcatgacttatcgtttcttctcatctcagatgaattcactttaatctctcatgcccaaattgtaaaatatcattttgatcaccgtcaatattacacagacctgtttgaatgtgctcagctttttcagtaaaattagaagaaaccacaatttacaaacaggtatatgtgcattaaggaaaaaacaaaaaactaccatgtgattttagatatggatgccaattcttaaacattgtttattatttctgagctcaagtgcttagaatgtttaaaatgcaatatatttatgtggatttttttccaggatattggaacatatataaaatatgcttgtgcatatctaagctttgtatttatttcaggttatatgtatactgagaagaatatataaacagtgtatgatatttacatgttatttcattttttgagggaaattaacctccacaattattaactatgcataaaatgtaatggcagatatgacttatattgtataggactgactacaattcctctttagaaatagctgttctttgcttttataatactaggaaaagaggaaaagagttcttaaagaaatacaaggattcctcaagcccctcttccctaaaacatgctctatcatatctcctggattgactggaatatccttctctgcccccaccccatcaccctctcaatgcagtggaaaagtcggtgggtaattgggtccagattggaggtgtttaaatattcatgaggctggcaggggactgggagggggcgactgtctagaatgggggtaggggctgggggaagtgattagtcactgaaggctagagaacaattccgagaaagagacggagagagagggaagaaaaagacagatagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggtagagctaaagattttttacttcttgctgttgtgaaataacccgagtacagtatttccccgtaaaggcaaacaatttttttactgcttctgctctggccgtggtgctcgcgcttccttagcatatggtaactgatggttgcatcccagcttttattcttttctgtctttcatgctctggttttggaatgctgctactaattagggtgagggtagaaaaaacatgcctgtttggctagaaataatttttttttttcttattagtgaatgctcagcatttgaggtctctggtcttgagggtgtggacgtagaaaggggtgtgggggagatgatgtgggctctacctacaagatggggaggcatttctttatattatttgcaaaaagcagggttgaggaaataatattcagaactgagtattgcctctctgtcatacaattttctcacatgtgctgcggaagatgccttatttcgtgcatgcatgagcttcgaaggggcgcaggtatttatggaaaaacgtgcaggtcttatttatttagtatttatttttcaatgaatgaatgaaactgtgatttgatagattttttttttttaagagaagctaagacaactggggctgggggagaaattggccatgcagaaggggaaaatccccttcctaagatcagcagccgattgtgcaccagctggtcggaggagagggtggaccacgcccctaggagctccgatgggatgggaaagacagccgggtattacctgttggaaaccaggtcttttctcttatccccttcccttgcttctttcctgggattgtcagtgaccagagacaggctaacatcctggataataagtatggtgactcattttcatcaggaagagggacacatccaagattagcaagaatcagagcccctccttccctcccccactgcccaggttttacagccatttccaattgctcgcttatttcttgaaagacattttagaaacttgattggggtgagagtgggaaggaatgacgagtgtggtattccgcagcaaccgaccatgccatggcagtctccaaaagaagctttcaaacatttgttggaatgcatttgagtgattttggcaaaggttaaagagaaaaatgggtgtgggatacgggtgagtgtgtgcgtatgcttgactgtggtgggggtgggggtgtggtgggggcaatcttggtcaaagaagcccttcgcagactgattgccttaggggtggggtgcaagagatggaatttgggtataatttccagtgcaggtattggaaattgggcaatttgtaatacactccctgaatccgaagggggtggaagagagtggagaagaaacagcctgccagcttagcacatttagccagcgccctggaaggaagggtggggagtgaggatgaaggagaaggagcaggaagaggatgggagactgaagcagaatgtcagagcagtgggagtagagatttggcataaataaataaataaataaataagcagacatcctggattgtgtggggctatttgggggaaaaagtcggatagtgggggattgagttgggggcggtatttgcagcatctcctgaaactgccctatggttacagagattgatgcttccattggctcattttatcaaaccagggcattttctctctgtgtcctccttcattttaatatataaatgtaataaatacaggtgtctgggttaagaacactgtcaaagaaaagtcctgaggttatttcactggtgagctggggaaataacatttaggaaggtggagcactaagtaagccaaagccatccacttaaaaagctttaattttggaaagaaaaatattcaggttcataatttgttcccaccctatgtgtacatatgcaagtatacatacatctcctttaataaaggaaatcatgtatgatttttagaaaaggaattagggctaaaggaattcccttcccaaaatgaagacagctgccttccctggggctctatctcaccaacagccccaagcattcactctgatgtgcaaagtgatgaagctgaaattgtgtttagagttgtagaaattcgcatgtaaatgtatacagcatccacatacttcatatgctacagttgcatgtgtaagtggtttccacatgcctctctgtgttttagcatcatttatattcaagagaaaattaaaggtatagaaattgtcctactttgctcatgcattttataaatgtgtacttctgtgtgaaatggtcatgtctcttataaaccactgttgtgtatcattcacattagccagtatttaggataccattcaatcagactaaaggaaatggtgtattcagggcgtgggctcacactacactgactggcatttatgtagcatgagtacttaagtctcacgcaggttgcctgcttgtggatgaaattctgtatcatttatgacaaaatccagtggtgcccatccttctgctggcatctattcatcatcgtagtacttaacagggaataaaacaagggcaaaaacctgcaaaggtctaagctctgccacacccataaaatccagcagaaacgtgggaggggggctgaagggcttgcacttccttcctcttccacttgagcggcataaagaagcaaccttggatttctaagttggaatacattgccagtgggtgagaagaaagcataaatgatctctattagccattagttatcactatagattattatagcaggaagaagagaatgagagtggggtagagatgagaatatggtaaaggagtgggcaaaggaggaataaaataaaataatccctaatattgtattgccttatgattttcaaatatcttggggcttactttaaatagcttaattgccatgtgtattgcagatgattaaaaacttggcaaggtgtgatttatgtctacaaagcaagaaaactatgaggtgtttcttttgttgaaaaataatgactttagtttgtaattgaagtgtaaagaatttcatgcaagcaagtagtccctctactccccagccccccatccatgccaatatctgcttttttcctcatgcaacaaataaatcttatctctgagagtgtgatctgtggtttaaaattccgacctctctgcctttccttgcagtgttgggaaggtgtggaaggatgctgccttgctgcttggtgcaggcgattcttcctagtgataaattggattcctcccaaatctctctgagccacacccagtgtcactcagggacttagtgaattaattaagctgagccattttacttaatataattgaagcttctcgttcttttttttttttttaatagtgattttcaccacaggtttccaaatttaaacagaaaaaatatttgaagggcattttctttcttttttctttcttttttttttttttgccaaattatctggacttgcagagaaccttagaaaattcatggtgagtctagaaagtgttcatttctggtgactctataattccttctaacccatgccagggcgcatacacaatgagccctgatctctcctgctgacagagtctgtgtaactctcttccccaccccctcccctaccaacccatgctgaggcaactggaataagaaaatgcagagttaattttctttcttgctgagctggcaaaactacagaaacctcctttgatgtttcaagctaaagggcagtactcctgttcaccgagagggagagtggcttggggtctcctttgcctctgtcatagtgaaattgccagtgttattcctggggctgaattaatccacagacttcagaattttacctggccccataaggaagggtactggtgttctttcaggcaagaatagagcatatatattaaccaatcgtattgataaagtaagacaagtcttcctctattaatagttcaaagaatgcacataaccaggtcatctcaagagaaggtatagcagcatttaactattcacttccctattagtattaataaaggcattagggcaaccaagcagtggctgttgcaaaccaaagaagtgatttcatacaggaattctcccttttcaatttgtgaagtgtggtcaggtggcttttgtacctttgtaattaaatcttcataacattttcagaagtgttgggaagaatattatactgtgagtccttagtggaggccacttactgactgtgagctttaataaaccacatcaccttgggtttcagtttccttctgtagaatgaagagtaaaaaccaaaaaccagacacaaatgaacactttgcttaccttaaggatttttgtagggcttaaacatacttgatgtgaaaataaagatcaatataagaaatttttattctccccaagttttgcaatttgaggcttgtcttagaggccccagttttgcaggatgatctagtgcctgctgtgtctacctttccctgttagagatgagttccttctagtcttagttgagccttctgcttgtgctcttgctcctccccccgtgttttccccagagccccagtccctcatgccctgctctttcttgagatttcatcttcttgtgctgcactggctcctttccttatagtttatgaatatgcttttgcctcatctatcttaaaagattctctcctgactctatgtccccatctctatagttctctgtctcactctccctttagaacaaagttccaagtactctccaccctcattttctcctcttcttcactccccattcactattccatctagtttaatttggctttgattttcataatttcactgaaaaacatattctgaaagggtgtcacatccagtgacccttcattttacatcttatttgatgtctctttggcattttgtgttgttgtcaatccctgttcctgaaactgtccccttactgggtctgcatgatattaatagctctccttattctccctctcagataagaccctgctcagtctccttatagtcttctcttgctctcttcacccacctccccaaatctatgatctcctggatcataatcttcattcattccactcttctcgtttgactcactaatcctaggtgatctcatcaggtcatccacatccaaatctttagccacctgtgtgatttccagatctgtagatcagatgtctgtttttagcttctgatccatagttatcttggtctaagtgcttcatttcagagacaagtttgttaggtacaaaacccaactcagtgtcttctgttgtgtatcacacttgatcttcctcactacaattattgctctgatactgtccatccagcctcagagctctaggaacctgagagtaatcctgaatgtattttatttcaactcccatatccagtttctaaatcctttgattccttgattcttgtttaaaagattgaataaatcctctgcttttctaccctgtttatataaataacctggcacagacttttcatgactactcatctggacaaaagcagtaactttctatgtggagttctaccaccacattgttctttagtttaccttgcaaataacaccacagctatctttacaaaatgcaaatcgggttttgttattttctttgttaaaatataaactcttcagcatcaatgacacaatctagttttgcctgcttttctagtgccaaattccaacagcccccctgctcttttttttttttttacctgatgacaccatgccaagatttcaggccttggtgccttcgcttgtactccactctctgcccatgttacccttccctctcagcctgaaatattcccactttccctgcaagagttagctctttgaagccattcttaaccttcctaattaagttttcttctaccttctttttgcccatgctgtattttgtactatctctattatcacttattgcactatttgacatttattttttcacattctggtgtctaccctgtgagcttcttggggaaaaggatgaaaacataattcttgttttatctctaccataatacttggtacataaaataactcatgttaaccatgaataatctgtttgctaaataaatatggaaccaggtttatagtcttttcacaggctgtagcatatctaaatggatagaatcactaggagatttttaaaaaaatgtcttggcatgaaattttaaagtggaactgatcatcagtgattcttgttattcacttatagacatgacagccatcagtttttaataaaagcagccacaaaatgaacccatttatagactgtatttctctgaactctcatagctggcactatctcccctccatgtcctcctcgtccaacaaccaacattacagccccaccctctctggttaccacaactctggatcttcacatgcccttactttgaggctccaagtacttgcactcactgctttgcttcacaactcttacaaatagaccgtaaatcaatctgtgtgatccatgaaataaatcaactaagagtagcaatatttttttctttaaatgcatgtagtgctggcctgtgcttaggtgtgtgtgctcaaaaattaattttaccttcatttggatttcttttcttccgtctgaagtatccacataataatatttcacaaagataaatcatgattggaggtatagggagggtgaatggtaagtagtccctcaaatgactgttaaaggaatgttagtaccagatgaattggatttttcttaggtttaaatagactgaagggacttgggttctgaagtagtcctattgtgcccagcatggaacaaattgcaaccactgttttccatgaaaacactcttgccagacgctaagtagtgtattttctctgactgaattggcatgtccttgagaacagcagaaagactaaataatttgtaagtgaagtttgtcttcaactggtaaggttcagtagtatttgtcaattgccataccctcacttgatatcttgcttactgctcccaatctctttggcattgagtttttctattattttctcctcctgtcagacccaggtagagtttttctgattaagtaataccagttcatgttagtgtttagtgggtgaggctatggaaggagaactttaagaaaaagtgtgtttcttcaaactttctaaaaagtacttatagacaaaacaggtattttaagctatgtctggcacatcttagattctcaataaatatttgttgaagtaataaatgtaggaagggagggagcatcatgatgggtcattaggggagatgttctgggacagacgaccatttctgattacttattcagcgtgggctttgtgtaaatgcaagctcagctctattggtccccctcacaaggtggatgtagtcaaagttcaattccctctcctgtctgcttagatcagagagacacacttgcagtcatttcattcaggtttagcacgggaatgtgatcttccagatttcctatccttaattatttacagatcttattttcttagatgttgtttgtttaatgtcctgtttcatgtctttgtagtggaataaatcctttccctgggttctagacctggttctgccaattgcttgtcatgtgatgttgggtaagtaatttaacctttctgagcctagtatattcatctgtgtagtgggtacataaaaagaacctccaaatcctgtcttaccttttcttcttaaaattaggttggtgtgagtctcaaataaagagataacaataaaagtgttttgcaaacaatgtgtttttgaaatgtaagtattattaattaaggaatttcatagatcgagcactaaagtattcatggctctaagcaaacaagaagtactcttgctctctgtatagaatacacacattccccatttccacctgattcccatactctacagagtaaattttttgtttgtttgttttttgagatggagtcttgctgccatccagactggagtgcagtggtgtgatctcgactcactgcaacctccgcctcccaggttcaagcaattctcctgtctcagcctctcaagtagctgggactacagttgcatgccaccacgcctggctcacttttgaatttttagtagagacaaggtttcaccatgttgcccaggctggtcttgaactgctgagctcaagtgatccacccacctcggcctctcaaagtgttgggattacaggcatgagccgggcacggctcagagtaaatattaaccatgctaatggatgggaacatagtatctgtttattatttcctttgaaaacttcagtgacagaatttagataagccaatattcaaagtgttacaagacccaaggatcacttcaaatgcattagaaatacccactgtttttctttttatctttttctgttttagtcttttcctcacatttagatctcttttcttctccatttgctaagtttgctgcctccccctctatacccacccccacttcacctccaaactgggttctcagcactaagatggccaggcatgctgtgctcacatccatcacatgagggcccagtcaggcagaagagtggagagaaaatgcagggctggttgggagactgaaaatgtagatacagtttggttgggggaagcacatttcaaagatgatcccttgatcaccatttccacaacctgacttcagggctcctcaatacaacaggaataaaccttgattagagaggtgatatgtaatcctaaacctttccaaactcaactctaaatgccataatcttttgagccctcaagatctccacaaaggacattatagttcttctgtgtccctgggcatgactgggataaattaccactttaaaacaacaaaatttaacagattctcctataagcacagaattctacaaaccaaagaaactgagtttttaaacatatggataacatttagaaatactttaaagtataataactggatcaagttagtctaagaaatcctatttttcctagaagccaaaagtttagcataaaaaaattagtattgtacatattttcccaaaatacttttatacaaagggctcatgtagactgcaatagaaaggtgtgttaactagaaatttgaaaataaactggtgtccagaaggaaataatgatttctttaattatatttatatttggttaatggtatcacctttaaactttcactctagctacatccctttctccctgtttctttcttcttctgcctcagaacacactacttctattatatatgcgttttttgattgggaacaagtatccaaaaccaactttaagagtctataaaaggaatttattggaaaaaaaaaaaagcagcgatcatatgaaattagtaagttgaacaacgaagcctatgggaaccagggtagaatttcaataacaggaattcataaactctttctggggccctgcatcaaaaaagactcagttattaataatcccagctacaattcaaattttaaatgatgagagagaaagagagagataagagagagacagacaaagggagagagggacagagggagagagacagagagagagagaatgaggatgaatgaattttattggtcctgcttgggtcacctagcaactgccacagggccgatatctctgactggaaaaagggctgggtgacataggttagagacaattttggtaagcccacacttgtaaatctagtgagagggtaagttggttgagaattagtctcctgcatatatacctatatgtccacatagtccacatgtgggttagctacccgagtcagaaggaacttatctcaagtgtggtggactattcatttttccttttggttattttcaatttggtctgtattacatattattggtagggttattatcactgatggctctaaaaggaagtagtaaccacacagataactgaacctatgagcttatacacctaaaaaagaaaggtcagagcaaatctccgtaccagtttcagtgtggagatgacagacactgggttttcaccatcctcctgaggcttacctctggcaggtgccacctgtctaggaggacatactagctaccatatattcttgctaatttggaatggtgtagctttgctctaacgtctctttttcaggttgtaagatctagttcctgcaaaaagattggacaataatgggtgtaaaacagctcaattggatttatattacagaaatgctactccttgacattagtcatctcattttgaatgttcttgaattaattccagcaataataaccacatttatctatttttagcaaattggcactttgtaaaatatttgctctaaatgtagaatattggtaattagccttacatccattatttataattccagttccaataactattcaaaaatgttattttaaaatgaaagttgggaagaccctaatatcctttcattaatgactagataaaagagctagatgaggcaaagaaaaaaaataaacaaaatgatctccaaaggttaagcaaactcagaaatcggttgcttttattaagtggctgcagaacttcttagtcagcataactaggcttgactggaacctgtgaggatgcatatcctcttcctattcttactttgctttgattccggaaccaatttatctgcttggaatataagctgagaattaaattcctcttaatggccaaactagttcctataacagctgtttccaagggatttattctacaggtctacacaaattttaatagaggcaattgtctcattatttacctaaaaaggaaagaaagaaaaaaattgactggatatggtggctcatgcttgtaatcccagaaattcgggaggctgaggctggaagattactcaggagttcgagaccagcctgggaaacatagtgagaccttgtttctacaaaaaataaaaaaattagctgggtgtggtggtacatacctgtagtcccaactactctgaaggctgatgaggaaggatctcttcagcctaggaggtataggctgcagtgagctctgatcacaccactgcactccagcctgggtgacagagcgagactctgtctcaaaataaataaataaataaataaataataaaaattccccagtttctaaataattaacttgcagttagatttatttgtccatgttgtactgagggtagcccactttggttgtccagactcttactaacattccagtggggaaaggaataagcattgagttatattttgcatggacattgcatttcggtctttaaatcaattttaaaaagtattattttatttgagagatgggaaggaataagagacttcataagggagaatgatattgtcttacttaaaaaacaccaattctttctttagtaaaatccaaactgggagtttgatctattcaaacgtcatttttttttcctgaaatgcaacatctgcaatatttccttaactctcaaggacttgtttatcctaataaaagagaaggaaattgttttctctatcacctgggaaagttactctggagaactcaggttggtattaaatattcatttgaaaaagtctttcacgataatcctcttcagtgtgcctcagggctttgattgcctttggttgaaagacacaaggtggtagctttttgataactcaaccagatttgtgcatccataatgttggacaattaactggagaactgtatagaaaacctaaggacaagagttccttgcttacacattctttcttccatcttaaactttgtaccttacacctcttgagtgaaaccagtatggaggaggaaatgaggatttctataactgaaaagggagaaggagactagagttataaaataaaattactcagtttggaattgggccataaccttctagtaaaaactgtcatgggatcgttaatgaccacagatggctcagacctcacttctgaacatcatctggaaaacacaataagcccaagagaaacagtattcagaaaagaatccaagaagtactctgcaggactaggtatgaaaagaaaaaaaaaaaaataagtgtgagcactagtatgcttaaatatgcataaccaaacttaggactcaattcagtttttatcttcacttagtggaacgaaactattgattcttagctaaaaagagaactgccaattttgctgtcatggttgttgccatatcttatgctagaccaaatctttcagcaatgaatggttttcctgcaagcttctaccgttctcctgcattatcattcccgtgtcattggaaactgattggtttgtgtacatacttaagtctattttattaatcatatcttaccaaaattgttacttttgctcaacctggatatatagtaaaactccatctgtaaagaatcaaaccatgagaatcataagaataccaataggaaaattaactttccattattcaaggtctccaaatattaaaaatattatttttccttttactctttgtggttccctcaaaaagtgtcatgttgaactaactatcttctttgcaaattagactttctactcccctactcttaacaatatctttgagagatcccagcacattctcagtttcccagctcataacagaaataattgattactctccttctgttataaaagtcatactatcagttaccaaattctttttgtaatgtatttcacatatgctcttttcatcttctgccagtctttcttaaccagcattccagaagagagccaaacccaacccttaaagccctaaggccctaatgtccatatgtatgtaatgagttaatccctctcttgtgcatctagatgggtaccagttatataccatccttggaagaagagaaaatagtcactcattttcatgttctgtgtttcagatgagaaactccaggtgaaaaaaggctggacagttaccaaaattctctacatattgcctgctggctaatcttacgtttaatcccccctttccccaaatttcaatggtttctctttgtttacaaggttaattctaatttatttacttatggttgtgtttcaaggctccttaggatctattaccaatttcctattcttgtcttatctcctagtggctctggcattgactaggcttgtgaatttaaataaatttagtctctctcagttgtcatttccttttacgtaaaacgaaagtattgaatgaaatcatctctaaggctttccaacttttaacaaacatgttctatagcaaaatgcctcttttacttggatattctgtcccacccagacttagtataaatttaagtattaattttcctataattttgttcattgttaccgccactacttgaaaagtccccttttgggcctagctcaatcttgcctaaactccgggccctgaatcaagacttatctcatttgtgagggctttcctgactaacacagttctccatgacctgttttgcctcttagatcttttgcagcacatactacctgtcctttgctttggcattcatcaagcagagccttaaccatccatttgcgtttttatgtacctgattctgccaagtagtttgcaaactctttaagggtaagatatccagtacagtgcatgactcaagaaacacatattgtatctactctgtgataagctctgtattagactctaagggaatgtacaagccaaataatttctcagaaagacaggtggaaccatcttgcattacctctctgggacatttgacatcatgaaacataccttgcctcttgaatctctttattttcttggctttcataacacttgatactgctggcttttcccacctacacctttggttgcacttttttcccatgcttggcttctcttttctaccaacctctgaaaagttggtgttattcagcgttttgtccttatacttgcatgttcttactcaacacaagttctgtgaataatctaatttgtgcccataagtctcacttggactagtgaatctcaaattctccaggctctccatccaaacctacttccttggctctagagctttatatcttactgtctactggaaatattttgctgacccgcaggaaccccaatctcaacaggtcttaaaagtaagtcaccatgtcttgctcccaaatctcttcccctttcttatccagtcatgtaattcagaaacagaacccttatatcttctttttttcattggatgctactgttctttctctggtttctataagtaaaaaccaaataaataaaaaaccttttcattccttcctttctttcctcctctcaaaaatatgtcattcatgcaagatgagggcatagtaaaaatataaataaacaaaagaaagaaatatgtcttgactctatccactccatctccagtcagctctaacccagccatttttcatggagactaatgcaatactctacccctataatcaacttcttctaccctcaaccctttacaatctttccctcagcagccagagtgctattttgaaaagcgtctataagattgtgtatctcccctatttaaaaatctttgatagcatcccattccacgtagaatcaaaaccaaacttaatacaaggcctaagaaatcctacattatccaggctttgcctccttttctagtttctgcttaacaaccatgcgcctcttggtcaccaagtctgttggcctctttttagtttttaaaacacataaaacatgttcacacttcaaggcctttgcatgtgttgctccctgtgcacagaatactctttctctggctctttacttgagaagcctttccatctgagtggtgtccaagtcactctctaacacatcacacttttttttttttttatctttttgggatgctctcaatctgattttttttaaaaagtatttacttttcaatattctggtcactgcctatctcttcaagctttaaaacccacccctcttcacatcccagactctattgcaattgtgttatttcatggaatggtccatattatttcatcctttctctctttctaaacactgttccttttgtctgtaatgtcttccttcctctccttttctacatgacacatttcctgtttatttccgtgataataaacaggaaatatgtggctgcagttattttcttctttatggagactctctgatcctccagcctaatacaattattcttcgttttgtgccttatgtctagtacatacctgtattacaacattcaatagactttattatacgtattcatgtatatgtctatctcttttgctataccaggagctcctttcaggtaggagttatgtccatgtatagatctagttgaatgctttgcacactatggtttctcattaaatttgagttgaataagtgcagcctataaaatgaacaaataccagtgtccagtgagtagtatgagatggcaaaatttggttaggactaaggcaaaggttggccagcttacaatgatcagtcatggaaactgttcacttctggcacagtccataattgggcagctaatagatatttcacacagagctaagaccatacagacttggatttcacccaagtgataccagctggttgcttcagcaaataatggtcaccattttatagagagatactttagtgtagtcagaaagatagccgtccttgacactataaacttcttaatatctgggctaaggatgagtactcactgtaaaatatacagctatatcattttagccaattattctgcttcctaagcttggtgctgaacagttagcctttcctcacatttaaagcttgtatcttctggtactcctcccacaggaatcctggtgaggtttcagatcttcccctttgtcaataatataatttatagttacatgtacactgtctcttaccttctctagttaaaaaactatgtacaataacgcttagttgttgctattttttcttgtccccctttattatgggggaagtatccatctgtctgatgttattctatctatccccaaaccaataaacaaaggaaaaatgctagtagattttcctaaagggaaataaaactacaaacggccagaaaatcaatgacttctcaaccctaacttatgtctcctacacacaaaaatataattcctgggggacggatctgggaaggaatgggcttccccttataattctggtgagggaaaaatatctccaattaaatctgttccctttgcaagaatatttaagagaatcaagaagggaaaagaatggtccatgaacattaggtagctagatctttctgaagtgaagctaaataacatagaaattaaatatacctctttggggtctagatgggaaacttaaacactctcttggatttatttttttcaggaaatgttagtctaagtttcaaactggtaacttggaaaataaactttggaaatacatctaacttgtaggttgggatagtgttcactcaaaaataaaatttaggaaggaccaaaagaatataatttttctgtttagagaatggatgatcataaggaaagaaagatgaagtacactttagctgaaaaaatatgtcactttttttccattgtactttaaaatttttaattatgtcgaaggtgaagaagatgcatgagtagtttgggttgccaagaaagcaggtaagacaggcaagtattcagtattgaagacattgatttggtgggatatggtagaattttgagagacccgccagtcatgggtaaaaccacttagagccttttctagaagataattcatttgctattccacttatctggtcatacattcctttgcttccagttttcacaggctttactattaggctgttttctcaacaaaactatagttgacagagtggaaaaccatttctacctcaaagctctggactcctcaattgatgtacacccagagacactgcagtgtcagtccactgtaaattcaaattgccagtaattatacgacattccaagaatacccaacaagtctccgttactctgattaaaccaaatttcttccaaattctctggaactaagaaaggggtttcccttggattccagtgaagggtcaagaggtcaggtctatgttggcacaagaaaatgggagattagattaagaaataatgacgtttaccggacactctccctatgtatgagcttttattaccacctaacaataaaactggtactattttctccacgtgaaattctctttctttctcttttttctttttctttctttccttctttttttccttctctttctttctccctccctccctccttcccttccttccttccttcttctttcttctatttctctttctctctttcttgctttattctgtttttttttttcttttttttttttcaatgaggttttactatgttgcccagactggtctcgagctcctgggctcaagcaatcctcctgccttggccttccaaagtgctgggattacaggtgagagctaccacacctggccctgaaatgttttttcctccattctaccaaaccacattctgccttcaaaaattctgttgaaaaatcaccttcttcataaaatcattttaaacatttcctcattccctatctggttccatatggcactcactatagtaacctccttagcaattccccttttctcatattgtctatgtgtgtgcgtgcacgtgtatgtgtgtacatacacacataggagtttgtgtgtgtgtgtgtatacatacacacataggggtgtgcatatatatacacacagacactatatatatatatagagagagaaagagtgcatttatatgttttgtgcatatattatacatatatatattcacacacacacacacacacacacacacacacacggtgctttcctgtttccctagagactgctaaaaggctcattactgagatttcctctgttttcaatttcacaaggcactatgcaatgcttgcacatactgggtccacagttaaagctactaaatttttattcaagctcccaaggaaaagttgtcaccttctttgtctttatacctgatggtgataattatcattgactagtagagctaaagagagcttaggaattatctagtttgtttttcttttatcttgtatttatttaaccacagcatctttttgacccagattgaaatatttctcagaatccaagaatgtaaaacagataaaaagatgttcttgcggctgaagcagagtttggtggcccagagatctgtctagtccgctccctcctgtctcctctgaaaccccctgttgaagcctggggagcagattttgaaacactgatctacagccagtccttcatggtgcagatgttaggaggttttatgctcaaggccattcaactcgaaagggctaagatggaatttcttcccatgtcagtgctactcttttcagaggggtgaaagaagaccatactcccaatttctagatgtatatatgcctaaattttctaaagttaactcagcatttatgtgattcaggagtaaacagggctcttttacaaatgaagacttagaagttatttttttgttttccaccttttgactcttactcatcttatttttcaattaggctttatcatcaagaccaattttagacacaatatctcctctaatattatattacaatcctttattcattcaaaaaacatttattaataatctaccatgagccaagaactatgctgggtactggaaatacagaatttttttttttttttaaagaaacactctttaccctaaattagctcatagtatagtgtggtagacatatgtgtgtcgatttaaaagtctgtattctagaatgtgctcttaaataattttacttaatctcaggtagtattttcctaattgttcaagaatatttcccagtataggcttacactaatgtttcttcttgtatagatgtgactatcaacaagccttggaggtttgggggataaattttgtaaataacagaacatccatagatctaaagacttaagtaccacaactccaaaagatttttaagaattaaatgttaatatttataactatgcctgccacatagtaagcacttaacattagttattacttgttattgttgatgctgttgttgataatgatattttatctacattaagtgagtcatatacctaaatagctttttgtggtgattcttaaaggactagtttctggattttaggggtatatgtgtgtgtttgtgtgaatgtatgcatacacatctgaagttcaatgaaaatacaattgattaactgagaaatgagttatgaatgccactgacttaaactttgcatgtcctatgctctcaacactctttaatgctaatatacattgtttcttgcagtcttggaactcagaggtgtaattagccttatcttacagatgtggctaataaaggttgaataaaaatttcaggctgcctctacttagaaaccagagaggctcatcatttgcaaggagctgaaatgtagacatctcaatacctagactcagtcactttttatcttcaaggaatgacgtaaagatgcaatggcaattacaaattatcctcagtgatggtggtatccacggtctgtggctatggtatctacagacccatgctctaatcagttggtggttttgccttgactgtgtttcctgggtccactttcacttggttgctgcctaatttttgagcctgtttctctagccttgccattaatactgtgagctctctgatattatcctaatccatttcaggttctattgcttgcactgaaaaatcttactgatgtaaccctgtagtcagaaatcaggagcaagctgctaatatttttcacctggattattgcaatagcctgggagatttgcactcactgttctgtctgcctaaaatactttgttgcaacatattcacgagtagcttccttacctcttcaggattctactcaaactcacctgtttacatcttatcaaggagttctctcattaccctatgtaaaatggcaccccaccctaacactccttatctgtccccttttgttctctttcattttattttctccagcccttgtatctactcaagatacttattacaatctgctggcaccagtggtacgtaaactccatgagggctccgttactcttttggtgacttatatttcctggaacctagtacagtgcctggtacatatgaggtactcaacaaatatttattgaatgaatatatgaatgcacttaaattatattcagaagtaataataagctaaacacgtgctacagctaatgcatccatttccacctgcctccacttccttcctgattgcttttccttaatctgaaccagcagtaacccatatatttctttcaacctagctgtcagtctaaggtatgtgatgcagcggatttcccaagagtgatgaaagaagaatttggtcctgctcaccactacaaaatgcctatttatttctccttttatattttaattgtttaaatatttggggaggattgtcctgctgtggtaaatttatactcattaaattgtcaagtgtaactgtattatttatttatttattgcaggcactgtaggggaaatgcttgctttgccactggcaccatgtggctttgagtgattattgtattttacctgatagtttttggacaggactatcagggtgatgaatgggtgagagtgggaggagttcaaacactggttgataaaaggataacaaacctgtagcaataagtcagtcaccgtgaagcattctaagcactgaataagacagagcatccattccacaccctatttccattcccagttaatcttcaaagagtcaacatggcaaaaacattccaagataaaaatagcaagatcttctagaaaagatttaagtttcaaggcaaaaagaaaaatcctttatggttactgagtatgctgtgaatccacatagttgtggttgtagctaaaatgctgcatatttcttttctcagcatcagtgatttataaatagagaaatttttaaaaatgaatctctgaaaacattccagaagaaaatttgatttgtgggaattgaaggataaaatgtataatggcaagtggcacaatgtcagacactgggttctgtgcttataacctgatctcaaatcaaaacccaatgcccctggcattctcaaagctggatcatcagaggtttcatttcggatagaagtgaggtcatagctctgctaatgtaaggtaacttcagcatgtctgaatccatctaacagtcttgttgaggcagggagcctaaagaagctattcaatcttttatctttctccagggagaaacaactttaaaatgtacgtattgttggcccctatatcatttttgtttatcaatagatcatctattgctttcatggtatctcaagagttagaagaaatttagaaggcatcttatctatgagttattcatttattcattaggaaatctttatttagtcccactataaattaaaggatatagggtaaatatatgaatcagatatgtctattccctttacaggattcattaattattttccgtgacatccttgctaggttggagttcaggctttggtgcagtatctccaatattttttgtgttgatgctactcatttaatacaatactcctcaagtgagtgaaagcaaattagccttcacttgaagtagtgaggcccaaccaactcttctttacccctcattattcaaaaagtcagatgtagagaccaaagaaggatcagagtggaagtgctgaacagttaacttagtgaactctttcaccttatcttcttgttttggcttctgtcaaacttcattgtacctggtcattctctatgcttatccagagatggaagcaaaatactaaaatttcatatttgtaacctagtaaatactagtatcttggtggaaaaaaaacccaaaaatgatctaaaagtccccaaaccccttaatatattttagaacactctttctattgaatgaaaacttaactcagtttagttttgtttgcatacacaaatcaagcattggaataaatcttaagagttaaaatgaaataactatatttgtaaaatgcttagaaatatccccagaaaaatatttcttaaggctcttcatcattggctgtggcaagatggaaggcatttcaaggtctcacaaaataaaaagtaaagtagcatgcaaacatatgcagacacaaaactcttaactccggaattttagggattttttagatttctagtttgggtttaagataatggtcaattgtcacttattggaactttgatttagtaataattttaaaaaattaagtgttggactaagttttaaaatttaaaatatactcctataactaaaccatattggattatgcctcttgccaagattattcttaaaccatgatctaagaatctcctattattctttcactgtcaggatccagaaactcagtgccaagggtaagtcagccttagataaacagattgtctggcctaggccaccaatctgtccaacatttgtgacctataaagatttttttttcctgcaagcaactctgcctatgccaactgtttatatgcacagtggaaacttccaaagctgtcatttcctaggtttgctttgcttatacaactaattactactgtgctagaaatttttttctatttattggatcccagaaaggctcaattaaccagtgccttttggtcaaggatagtagctgaagaataagacctcaagattatagcatttaaactttgcacggttcatcttgttgatatggcaaggattcagggataattgcctaataggcaatattgcctaacaggataggtgggggttcagaagggctctaatgaaagagaaaaagagagagaacttcaaatcatactgaagaaatagaggaaagcagaagtaacctgagacaaaagagggaaagcccttcggatatcttgaattaaatataaaccctcagaaatatttacagtgctctaagttagtagattgtcatttcttatggagaagacataattagaatggaccccaaccacaagagacctctctattaagactcatttgcgatttggtaccatattgcaaatgagtcttaatataaaagatgtgtcagaaaccctcttctcacttcactttatatattaagtatctcttttcaggaaaccaaacaaccaacatgtatttcctgaacccctacaatgaaccaaagtctattagaggtagtatgggacattgtgatgggggcagagggatacaaaaccccaccaacaaggagggtgctatgatttgaatgttagttcccctcacatttcctctgttgaaatcctcatctgaggattacatctgggattactatcactgagatagtattaggaggtggggcctttggaaggtgattaggtcatgagagtgaagccctcatgaatgggattagtgcccttttaaagagaccccatagagcttccttgcttgacccttctgccatgtgagaacatgagaaggctcggtctattatacagaaggcaggccctcactagacaccaaatctgccagcactttgatcttggacttcccatcctctggaatggtgagaaataaatttctcttgttaactacagttaaccagtttatgtttattttgttttctaatagcagtgggaactaaaacagagaagaaagaaggttgatatttaagaaatatgtacaaattaaggaataaccctcacaaaaataacaaaacaaggcagtttgtaattaaaatatacaagtactataagagctcaggactcacaggaggaggcaagggaaactgaaagctttaaaaagggaaaaaactaggagagtgcccagtatgaagggagagtagaaggcattccagagaagtgggataacatggggcatggtcatggagccttgaggggacgatcctaaaaaatagtggagagtgtttgatggtaagaattaggggggagggaaaatgagcctgtaagataaaccatagccaacaaaaacaaaaacaaaaacaaaacaaaacaaaaaaacaaaaaaaaaaaacggcctgatagggcaagaactttgtgccattagcagcttttggctaggggagcaaagtgatgtaaaaagcatttatggcacctatgcatgcaggattgcatggaagactggaggcaggaagcaagttaagaggttattgtttgaaacacgtatatagaagagaaaataaaaccatggactagagtgttcataattgaaatttaaatgtaaaatgaattgcagactttttgaagaaaaatgggtcattttcagtgcctatgacacatgaagaaaagtctctgccaatacatgtggtccatgatcctttcaatttggctaaccagttgttttgtagtctaggctgtatgacagtgtgacaaggctcgtcatggaagtagtccttcttttacgcaatactgtgggcccttctgcagatctacttgcattccatttttatttccctaattcttggactgctggctgtatacctcaaccttcttttctgcttctgactccttcaggtagaccctatctgatatgctgtcctcgcctctgagactgggactcctctgtccactgggctctttgtcctgctctgttctctagctttggacaccatcttcagcattgaactccattgtcctatttcaaacccactgcaccctataagccaggagaatccccctaacttgccctatgatgtgtggagaaataaatatgattataagatttctagcttagatttactggaatggatgggctattggcagaactgataaaaggaagaactgatttggtgaggaagacaatgatttttatttccagcatggccagcatgaggaaaacatccagaaagaaatcactaattgaaggtccagaagtggaggcagagggtacagggggcacatgactcaaaggctgattgagagcttattcatcttcgtggcattagttgaggaagggttagaaagaaaagagctaagagaagggcttactcacccttcagtggcagaagatacttcattcagagaaaaagaaagagcagttagtaaaagcatatgggatcagggaagccaacaaaaagaaagctctaaaataaatggtcagtactattaaatcagagtgattaagaaggatgacaatggagaatagaccattgaatataggaataaagagaccattgataatctctgagtgggtagtttagttgagtagtgaggatgaaagccagagtttaaaggcttagaagaaggttgaagtagaagaaatacagataactggcatagaccacaaatctagaaatttggtattcctctcagtcaattcctgctactacaaaaaaaaatcacagattggttattagtaacagaaatttatttctcacagttctgtatgctgatccaggcaccaacaggtttggtgtctagtaaaggcctggtctctgtctccaagatggtgctttactgttgcatcctcacatggcagaagggcaacaaggaataaattcactttctcaagcctttttatgaggacatttgctgagacctcttgacctaatcacctccgaaaggccccacctcttaatactattgcattagggattaagtttcaacttgaattttgaaaagacacaaacattcaaaccataacagtgtcgaatggagaaagagaaatgagattgtaataaaaagatgctatttttcaaggtagggagaaacctgttttaaagtagagggaataatagagaagggaagactgaaagggtaacagaagaaatcaatgtgacagtaaagaagggataagttcaaatgtttagatctcagcagagttccttatggagaaatgatacagctttgaaacagaaaggaaaaagaagaggacaagaaatgtattgaaatgggatggtttatattcaggggatcctgtcaaaatcctgaattttgatgctgcatgtgatgattcccacctttaatcccagctactcagtagggtgaagcaggagaattgcttgaggccaggagttcaagaccagtctgagcaatatagtgagaccctgtctctaaaaaaaaaaaaaaagaaagaaagaaagaaaaagaaaagaaaagaaaatcctgaaaccctgaaaccctcccctcttttttccctcagtgaagaactttggctggctgttcagaggaaaaatgggaaagaaaaaccttcaggggagtttactaactgacaggaatgaattagacagcactttcccaagtgttctatggatcacctgacatagtgtcacctggagaaggtttttaaaatgatctctggaggagacacttcattcacaagctcctcagatgattatgatgcttgcaaacgtccaggagtgagtgccttgttggaggtggatccatcttgaaaacactgactaatttaggaacctagcaggaagctacattgtctctcatcctgtggttatttttctcttcacatccctcacagggctcccttcgctgggtgtatttctatggtaaagagtgcaactcatcccagcatacaccggcataagctcttggttaggtccaaaatatcagcgagggcattatagtatatccacaacccaaaagaaaacctcagtactgattatgtgcacacatgaagtttcagaagaatgtaaacgatgtattttttctactgaattacctttcagtccattaagagtttatttcgggtagccatctgggatccccctctctctgtgagccccctttcttttctctttccctcccataccatctcctatttctctgttcctccttctccccattcccacttccatccttgacttgaagtgggacattagatctttatggttcttatggcattgcactgagctctactctagagactcagcactagaatctgcacatgtggaagatccacaggtgctttcttgctaacctaatcatctctaatagcataactttgatatataactataatttttaaaatcatactctagtcttttaaaatcatactctagtcttttcttactctagtcttactccttctaaaaattaaaggggaaggaaaaagtgtgtggaggaaagtaaaatctggtcaggcatggtggctcatgcctgtaatctcagcactttggaaggccaaggtgggaggatttttttgagcccaggagttccataccagcctcaatagcgagaccttgtctctacaaaaaaataaaaataaaaaaattagctgggcattgtggcatgcctctgtagtcccagctacttgggaggctgaggtgggaggattgtttaaatccaggagatggaggccacagtgagctgtgattgtaccattgcactccactctggaagagaccctgtctggaaaaaaacaataataataataataaagaaagtaaaatccaattctgtcacactgagaaaccttttattatttggaacccatatgccaacaggccctcagtaaatgaagcatggtcagtggaggtggggttctgcaacattatgagtttcttgctaaatgaagtcaagtctctcttcctctttctctcacacacacacatccatgcacactctgcacatacggaagacctgttgtttgaaaagttaagttagtgtttgaaaagtatatcatttgtttttaatttgttgcatgaatttttgtgttcatttggcaagataaattttactaccagttatctagatgagagggagtcaactttgaaccctcatttgatgcctaacctcggcatcaagagaaaaaatctatcctaaactcagttcatatgtacatttctatatttttcttttctcttgctgcattccattttatttaccaacacagaagcagaaggttgtagtttctctatttcctttttctgataaacacctcaaaagcatatagtaatttcctccatttttatctggcccgtgcttttcttaaacacatgtaatctgttcttccctccctcccccactgttctaaaattgctttccctgaggtccttggtggccttgtaatttatatttgcaaagacctttctcagccttcacttaacattttcgcattgactgtgctgaacacttcttaggatcctctctattcttggcccctgttctggccctcttcaattgttactctcctcctctaagctggttttactttctcctctgtcttctagatagaggtgatacaaaaacatgatcttagtttttctgatcttttatttttaattctcttaattagaattttcttccaccttcatagcttcaactatcaccttctcataaaagacactcaagtgtatatttcctgtactaagatgcttctagttgcttactgggtgtctagttccttccaaacatttaccattgaaactgagtccatcacctttccccaaaatccatctttccctttgaattctccacaaataaactgtaccgctcatttaattctgaagatattatcttttttattatttatttaattctttcatttgttgttaccatatttaaacagtaattattttgagggaaagaatcgtattttctacatctctatattcctgtattcctgatgattcttatccagcattctttttttttttttttttttttttttttttgtgatagagtcttgctctgttgagtcttgctctgttgtccaggcttaagtgcagtggtggcaccatcataactcaccacaccctcaacttctgggatcaagcaattctcccacttcagcttcccgagtgactgagactacaggcatgtgccaccatgcccagctaatttttaaaaacttttttgtagagacaggttctcgctcttgcccaggctggtctcaaactcctaagttcaagtgatcctcccaccccagcctcacaaagcactgggactacaggcatgagcctctgcacccagcctcctatgcagtgttcaataaatgatttttattaagacgtttcacctaagttcctaatattttgcatatacttctcactgtggtaatttttgaaagggttgacagattttgatgaaaatgaatagatatgaagtgtaattttggttcagaccaccgtcttgagacaaaatagtagctactaaatgtactgacaggagaatttctgtaacttattaacagtggattccgtacaattttatatacctctgcaactgaatgtgttctgctattcagaacttctgaaagaggaagttaccagccaaagaaattatgaggcaagttgaaggatctagttaggttagactaagcagacactcaaatgagagggaaggcagagctaaaacttcaagactgggtttctctacctcatctgggagaatactgacaacagggcatataaatttttgtctttttgcccaaaatatgaggtactgggctaggtgcggtggctcatacctgtaatcccagcactttgggaggctgaggggggcagataacttgaagtcaggagttcaagaccagctttgccaacatggtgaaaccctgtctctactaaaattacaaaaaaattagctgggtgtggtggcgcgtgcctgtaatcccacctacttgggaggctgaagcacaagaatcacttgaacctaggaggcggagggtgcagtgagttgagatcttgccactgcactccagcctgggcgacagagtgagactctgtcttaaaaacaaaataaaataaataaaaaggtaatttttccaatgtcaaaggagactagaaaaagtttttgaagaatggtgtctgcccctactttgtgtggcggggtgaaataccactatttcaccaagggtaacctgcgcctcctaaaacttttatttctcccaagactaagtttacagattcttagaattaatgagttgaaaaagacttgaccatctagttcaaatccctcgttcagagacatgccacatgcttcttaatcctggttgtatgttaggttttctaatcttgcctctgggccttatctctgaagtcctcactctgcactggccctagagtttgagtaatgccatccaaatgtaggtattgctattatattaaaaataacactttgccttgttcatatttaatgaattttcctatgaaagatagattcatgtatcacttttcagatatttaacatctgaaattaaaaaaaaaattagccctaatgaacattttctacaatacatggatcaagagtagagaggaaatattggtctccacatctcccctttccactcccccaacaccaaatccactgtctataggcatttacacattccttctgtgattggatgattctgcctttttcaaggctgaaaaattcaagtcaattgactctcacagatttgaagttttctgctgtggtgtaaaaaatacatccatatttcaattgttttcactttaatttatcagttggccacaatatatataaaacagaattgcctggtgctcagaatgaagtaccaagtgattcaaatattgactattctactcaatttcaatataaacttaagcaagtcacacacttgtccacttatccagtagatgaaaccgcaaaggaggagagtttatctgaaaagttcttctctggagaaagatacttagaaaatacaaatggtccttactaaagaccccagctcatcccaggaagatctgaggaaaagatgagcagacccaatgctacttcagctcacctttcttagcagtcttttttttaaaagctctgttttaattgaacactatgttcctgagtcagaagagtgcttcagtaaatctgccttcctggggcacaacgaatcacacacagtcacactttcagaaaggcgaatcctgccaaacgttggctggacaaaagatggctttttttctcctccagcaaaaattactcaaattgcttgagaaagaaacacagtatgtttatccctgtttacagatatttagctagtgccccttcagagggtcatgttcctataaacagcatcatgataattatatccactgctgcaaagaacagatgtgtaaattggtggtttcttgggggaaaataataccaagtccattttccagaaatgtacacagtacagtgcagctgtaacattctgtgcagaggtctcattagtgtctattactgagtgaggtgatttttaaagaatatggaaattcacggggggcatctagcagggaagtccagagacacctaggaaatgattcagatggtttggtatatttaaaaatttctagtgatactgggcaaatctccacatctaaagaaagtagtaataaatctttgattataaagttttccaggcaagaaatatgtatgagtagagggtaggattaggaaacttctcatgccccacacacctctgagatctgtgtaacttaggtatagactaaactttagtgaggccaggttgcatcaaggtggtcaaattttcgatctgtgaacaccagaatatttctaaactcattgctgaagggtctggcagggatcagggttcctgaaactagagtcaatggttccttatttaaaaagccaatgttaccttggacacaagaattagatgaaatcctttctgctaatgaatttattttgttgtagatacttgcttttccccagggtatatatttatgtgactatatggtaatcagtattatccctaaaaattaaaacacaacactaaggtcagcttattgtattagaatagctattgaacaggtctgttattacaaatatgcatatcactataagcttcactatcttctctctgcaaaattctcttaaatcatgtcaaatagtatgtacagaatattatatacagggatctagtgtctgcctgaaggatgggatttctcctgaactggggctatcagtaccttcacatgtaccaaaactttgcataagaccaatatatatttcataacttagtaaatgtgataaaacactgaaagttaatttgcattttcattgaatactataatattcaatgacattatgcaaaactggggcattttgcttctgggacagaaaagtataaactatttcttttaagctatgcttctataattccacacgaactacccaggaggatcaaagcatgttagaatgactgaaatacaacaggaacagtctagtctgttaatctggatttttcaggcctgggatggaaggataataaattgaggcctgccacatgccttaggccaaagcatgcctttgacactaatgatctaattcagttatctactttgtccaaaattcagccttctcatactctgtgccctggggacataaacaaaaacacagggggtgatgaggtagccccagctctatctggggctctactgactcactctcttggtctcagtttcaagggctatgaaatgtcatggtgtgatggtctcttctaggccttgtgtcttatgttcagtgggtctatgcatgctggaatttagaatagtgattcttggtcatttgtgtgggatagcggctgctgggtatccacttgacttgaaagtaaagaggtaatggggtagaaatagaaaattctgaattgtttaatataaaatcaaggaagctgtttccaatcaggactgtggttcaggtctaaggaccatagatgcagcccactagcacatttactaacatgcagtttgggctctttatactaggctccctcgaccagcatctctgaaagttgaacctatgaattggatttaaacaagcctctttggtgtaaatatgtatactgagggtggggaatccctgatctaggtaaaagaggactttttctgctaatctgaaatttggttgggagaaaatgatgtaatctacctaaacttcgattttgtaataatagaaatgttatctttccatcgttctcagaaagtaaaagtgtatcagtgaaacagccccttagagaagtttcttagaaaagcaagcaatttcctagtaaaaaatggattgtatttcaaaaagaaattgttaaacttgaaacataaaaggctttccccacagaaataacctaaaatttccagacctgtctgtaaaactcagattgatccaaaatgtaactgaaattctatatgtttgcaatggaaacatagaagaaaataatgttactgggcttcggagtgtaatagaaccatttcctcatatataatttcattaaaaatgcaaaaatataaaaaactatatacacacgtacttgcgtataatttcccttttctagtctacaagtattatggtagcccaccctcaacagtactgagaatgaaaattatagcaaaactcttttgtattagttacttctgtgtcataatgagagtctcaagataaatgaaaggagggatggataaaatgatttcttatgatgggcaaaggttggaagaaacatcatgtggggagagggcaaagagaaaacagataaaaagagaataaaagaggaaatgagtggcttatgtgagcaagcgatgagctaaagtggaagtgtaggagaggtgagttgcttaggtctaaggagaaagactgcttaggtgtgtgttcacccccaggacgaagaaaggaacactgggtgagattttgttcaactacccatagttaccaccagatggtgaaactgatcccgggcctcttgggtattgatcagtttatggggagatggggagaagactatctttcacttgttaattcattaatttctttcgcaaatattttttcagtacctgctaagtcccacggactatgctaggagctgctgttaaaatgacaaaccagataaggtcactgcccttaatcaacttacagttgggtgagaagctatcaggtacaagtatggccctagaacaaattagtcttttctagttaataatcttatgtgatgagatttggccttgctcctttggtgacttgcctcaaggagccccaggcaaaaccaatgtaacatatattaataatatatgaaataatatattttgtagacacaattgccttatgttgtccaggctagcctcgaactcctgagctcaagcaatcctccccacctctgcctcccaaagttctgggattacagacgtgagccgccgtacccagccaaaaatgtttattttgattagatgactggtattaatctgattaaccaaagagacaaggtattactaaattcctcatccctggtaacatttccatgttagctgttttctatttgttttttcttttccacaatggtgcggcctagaaacagttaaccttcttcgggctattacataccttagacatataaaaaagctatgagcattcaacactgaaataatcatataaaccaaacatactgcacactacttcagggatactctgaagcccatccttagaccccagactcaaacaaaacaaaatacgatgtaaagaactgacacaaatcatcggagtttagagaacaacgtgacgggcagcagaggagaggagagggttgaagcaaacttttttggtttttttttcctaagtagggctggttctggcttgtcttccttctccccactttgcttcttactcttgggcttacaaactgcctggtttcccttctccaagtcagggcttcgtttctctgccttggccttcctaccccaccttctgcgttctgactcaatgaggcccttttcgcgtctcattttctgccttctttaggcgttccctcggcggctctgcagtgtgatctcatctctttgtttctccccggctgccgtcagtcaccggctctctgcgcccccacccgcgcgggctcgcggccgtgctgcgggcgtggcctcagccgctgagaccctggggaccgcagggcgtggcgcggcctccgcccgctgcacggagagccccccagaggcagcgacacggcgcttggggtccgcggggctcctcctccaactccgcagacctccggggaggcctcttgctccccgaacacccgggagttcgctttcatttttaacgaatctccacaatctcttgtttgggagataattgcttctttcaggggcttggagaacaaaagcgtcagcccagggccccaggtctctccgcgggaggagggcacccaggggcgatgcgccgggctctctccttcgcccttcttggcccgctcgccttcagctcccacccgcagcagcaaccgcagcctgcttccggggactgagcagccctgggtcagccaaggttaagcagcgggtggggaagaggagagaaagctgggtcaattggaagtaaccttcttgtaccgcccactttttccttgcttggaggcggcaaaaagcactttagcattcttcgggctgtttgcgcctctttctctaacagggccaggggagtggaagagcggccggcaggaaggtttctttgtcagcaaaagcggacctttggaaactaaacagcaatgctctgtctttagaagacagcacaggaaggaacaaacagctgaggagtgaaggccagagaccccatttggaaaacaatggcctttcatgattattactatttttaaaaagttttctaggctttttcatttgaactttccatttctcactatgaaatgcaggttctatagacaattgcacacaagtttctttttcgggggggagggtaaacgaagcaggtggaaagaagtgagatgattgtagacgtggccaaatttagacttggtgtgagatttcctcttcgcttggaaacacatggcaccagcatgcatttgttcattcattcaataatgtgaatgaacattaaacactacgatgtgatgggctttgtcacaggctgtaagtggcttcaggtccacatgaaaggagagcgaaaaattaaaataaaatattagagagagagaaaagggaagaggggcaaggtgtcaggcagcaagcttcttagggtcagaatgggtccccatccctaaaagctgatgactgaagagacccacgagggtagacgagctgtagagagacaatactgcatctgccagtgatgagtgtaggaagctcatgagggttagaaccttccctctctgttttctgacctctttttctttttaaataggttgaagccaactgtggtagaggataacagtgattcgcgtatcttatttatttatttttagcagccccctcccccgcaactaggacagtgagttccattcagattttcaacacagctaaaaacttggctttaaaacttgtgaagggagacatttctttagaatctttcacttttttcatcgcagaggctttgggggaatgtttagctttttgctgaatcatgaagggtttgttactgcattctgagagggtaggaattagatgcctaaaggatggtgtctgctttcctgttgaggtggtttatttaacagttcatagaggcatgcaggtcaagtcatccttaactgtacagagtcaagggtattgccacatgggaggctggccagcggagaagtttggtgctctctcagtttggagatcctcatgttgtatacatattccaaaattcccagtaattatgtacctataattatatacctataaataccattccagatactagaataagatcacagataacttcttagatgtttcttttctagagaaatagggaaacagaacatatatacatttgcacacaattcaaacttacactttgaatgtttgtcttaaatctcctagtcaactcccttaatgtacagacaaagaaacagatccagagaagtgaagagactttcataaagttggagtcaggttgggatatgtcaggcctggccttcttgctgctgattatttctctgaattttataatagaggcacctctgaaactgtctgaaacttttcatttaaagagatattcaaaaagaactgtagatttctcagaacgggtgtgtttagtctgagtgttgtgggccagtatatttcatcattgaatgtgcaaaagatttgttaaaatggagatattggttcagtgggcctgggcggggtgacagtctgcattgccagcccaaactgcccttagtggtgcagatgttgctggtccacatgtggaacggctaggctgtagacagcatctgtcctccttgcctttccttcttgctgagggaacagccctggggatttaagaagccctttttgtttctgttgccaggtcactgtgctcccttagctaatctcgatagctttcactgccttgtcttcatccagatctaagattgttagaaatagtccctagagacaggtgtcttgagctggagggtgtgatcctttgtatagtgacttagcaccatttaacttggttccacaaaatgtttctttcacacataagcaatttactcaactcagattgttaaaaaaaaaactgtttttccttccacaagtgtcctcccagctgcagctcattgcactcccttgcagctgggagtgcagctggcatgctgctagctcactggtctggcccttccactggaacccagcaagttttttgtgctttttttcaccactctcttctatcctgcacttctgcatgtgacgcctagatttagctgtaagtgcctttgtgcagcatctgagttgagcaagctgctaagatataactgggcagaggttcttctaaggcaggcaaacttcagtgtcacccaaagggtggtttgacttggctttgctttgtcaagcccaccgggctttgatatgactttgtttttgtttgtttgtttgtttgtttttgtttttttgagaggaatctcgctctgtcgcccaggctggagtgcagtggcgtgatctctgttcactgcaagctctgcctcccgggttcacgccgttctcctgtctcagcctcccgagtagccgggactacaggcacccgccaccaagcctggctaatttttcgtatttttagtagagatggggtttcactgtgttagccaggatggtctcgatctcctgacctcgtgatccacccgcctcggcctcccaaagtgctgggattacaggtgtgagccaccgcacccagcaatatgactttgaatcgcaagtttggcttggggagaaactagggctttttttttttttttttttttttttacctgggagctgtcaaattgcaaaccacagggcatgctcacaagagaagtgggaagatagggaccatttcatgaatttctcaaatgccaaagcaatgcatattttcttagcttgataagcaatgggaatgtctaaagtttgtttttggtgggggtcggggggaaggggaagggcatattgtaatgaaaccacaattctattttagcttactctgataaaatatgttgcacagagtggaagacagactaaggaagagagcttcttagattgaatgttatagtgttagcttttattgtcagttttaaaccttaaaatatgagaatagtacttctaggtagaatttctgacatttggtaaaaggagaatcttcgtctaggtcctccctgcatacccactgcactatcgccaccagctacttctgttattgccttgattctctgcagtgatttaaaccttctgttgtatgtttcttgggtgcttccatatcttccatatcatggcatagtcactcagatgcatactcatttaccagaggctgcagaggtatcaggcaactttggtttgttcagcttaccgggttttgatatgactttgaattgcaaatttggcttggggagaaattagggaattttctatgtagtaactgtcaaattgcaaaccacagagagagttggctactggatttttctgggaatcatttattcctagtcttgggtataattctgagctgatacagtaatatgggaaattcttggtttctgagaagtaaatcagaatcctggtaagagtggtgacatcacctcttgaactcaggagagtctccaggactttttatgcagcaacacatctgtaaagctccccattgttggagtttcactaatttggtgctctgtacatccctttgggccatgtgacatcacttatgagagggttgtggcatgtctcatagtgttgtatatgtcaagtagaaagttattttcattgacctcaagactgcagaattagacaatatctccctatttttacccaatttagccaaattctttcattcaaagattagattattattaatccctgaacgcaggttcataggaattaattcaagagtcgtaaaatttgcttgcctggtttccaaactaaataaaagggaattttctttctttgatggctccaaagggttcggtgtttctccctgcagaaccacaaagtgggaggtgtgctgctgctttgtaccatgaactacacagtcatcaaacatatacattttctccacaacctatgctgcataaataatatgatactttctgagtatcattcgattcagagcaatttgtacggcatgcgtgaaacagttctagatggggtttccttatatacctcactacaattgtgaaaaaaaggaacacgaatagttggttcaagtaaaaagcaatgtttaattcaggaactcaggctgaatttaaatcctcacactcaggaataaatcgcagaaccttctctttaccacctgctcaatcccttccttctgataagaatgcataaggttgactctagtccattcatctgcttttctcatttattaaatagccatagttcctgacctgatgccctctccctccctcttctcccagtattgctttccctgctctctgatatttttctcttttgctttcagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggtaattttacctcacatgtaacctatacaagtattttaggttaaaaccctgactctgccacttactagctgtatgactttgagcaaattacttaattacttaactaatgtccttctacttagtcttttcatctgtaagataatagtacccattgcatagttttgttcttagaattgaattagttaatatacaaactatatgcaataaatatgtttggggtgtgtatatatcatataaaagtgcttagaagagtgcttgacatatagttttagaatttgctattattatgttctccaagcatatgaggtattttatgtcattacttttaaaggtcgcttttttatatgtgttagtgggaggcatttattatttttttaagtgtgcatatccctgaaacatccctctgtggagctataaaagaaaactataaaatatttaccatataattcactcaatccccagtctccagaaagtaacaatttgtacttcatttgtattgtcttcttccaggcattttacaaatactattttctttcatcctcaaaaaaattctgcacaataggtaataggattctaatatgggtgataagaaaactgaaatttagagaaattaagtaatttatcccaggtcatacatttaagcagtgaatgagccaggattcaaactcagatcttttgaccccaaaaccatgccaggtagcaagtaatcaatgaatgtcaatgacagatcatcgagagagaatccagtgccaaaaatgaagagggtgtcaacaaaataagaacaaggacaatggcagcatgagcaacaagaacaaacttagatccaaaattaacagttaaagatttttctagagtcctgcatatttttccttaaactgtccagcagcttggggacagaaatctaattaaaatggaagtctatgcatgctcaaaccacatgccttgtacctgatgcaatccgcttccaccccagtcctgaaaaaaggcattcagttatttttttctacatgtggaagaatacaacaacataccttctagaatcagggagaaatgtacttgctctttttatttttttttaatttctcaaatactgttctataaggataatcactcacctggtgattaatgtagaatgttaaggtgtgtacaaattactgctgataggtaacactgtccttgcaaaatcatcccatgtgcccccctcaaataaataagtatacttcaaaaagcagtgtgcttgctatacaagtgcagttttaagaaaaatcactcagctctctcttgcaaacatgttctttcccctaatgcctcctacacagagattctggagccacccccttcagaatatctgaaatatagaccaattttgctcgttaaaactacttcaagtagtcctagagctgatattaggattgctacttattcagtcatacttttcgagtgttcattgttgaattcttagattgaattttctattagtttccttaaaatataagaggttggagggctaagtttaagacccattctactaattgtgaggctttccacaatctgtgtttccttatttttttaaaggggatggcacacttgcttagccttcttcattatcattctcagaggaatcattttaagttgaaagtacttcataacctataatgcataaatttaaaccactgtcatttccccccaccacagcccttggcaaatggggtcttaaattccttctcccaccaactagacttttagcatgcattctgacacgtattgtgtatccttactagatatgaggtatataatatttgggctttactaactatccagtgggggtgcattggatatacttggcttggcaatttcaaattataatgatcttcagtaccagatgctcttaagctagtcccctacaaatgtctggcagcttcatttgtaacttttatcaggcttgagtattaccacacacaagcacatagagtagctctcagaacctgcagaggcaattgttttactagatgtgtgagggatatagttggatcaatgggatagatactgtatatgaaatagtggctaaatgagtttgtgtgtgtgtgtgtgtgtgtgtgtgtgtgtgtgtggttgggggatgtcaggtgaaggtcacatattttgggaatgaatagatttctagtttcagtgaatttctatcactaagctcctacactaggtgaagttttggggggtgggtaagttagagaagactgagaaggaatcagttggtgtgtgtcaggtgatagtagagtgggactgtggtttaactttgacaatgtaaacagatcttcccccttcccaagataagaaagaacagagttgagtactatggcacattttacatggtttcctgcttatctctttctttgagaatagatatagctcagtagtactgtcgagttaagaaatagcttttccaccctctgagtgatgatacctacaatcatcaggatgaatacagtctcatgaccaaatctcctctggtatttgtcttatcaacatgccttaacttaatgtcacgatgctctagaaattactctgagagaataatggtgatggcaataattatgatgagaataatggtagcagccacccctttctgagtatgtacaaagtgtcagggactgtgctgggtgctttatgtgcattaactcatttgattctcatatcagcccaatgggatagtttttttattccctcatcctgcagatgaggagcctaaagctgacttgcccaaggtcaggatctaccaagtaactggcagagctggaattcaaacttacacatgtctaactccgcagcccatgctcttaagcaccagggaatattgacttttacaggaggaggactaagcaagggctttgtcattcagaagctggatgacgctgggctccttcctggttcctcatctgtgttgattataaaacaggcacagtgatgtgttcctcacatgatcatgatgaggattgaattgaaatactaaatatatatactgtgcacttataaatgtaagaagagagaggaaaatgactgctggagagtggcgtgatgaaggctccagcattagtgacctggagcgagaacacccagccagtgagctgagtgttcacacacagagagtttacacactctctgagcaccaacacagtatggcatgtggtcatgcaacaactaaaaataacatttttttttagtatcaactatgtgccagcactattttagccactgaagcttagaagattgtaaaaaaacagataaagttctgttctcagattgtttatagcccaagcgaagttcagttagtaataaaataaaaacatacagcagatgatcataagaactaagaggggaaagacagagaagtggaccaagagtgacaacatttgaagaagggtgtgtggtagagtgggtgagaaaagtctctgactcatttattcattgaacaaaatgtctcaagtacctgctgactcagactgtaacttatgaagggggtttaattaagaaaaaatagatgaacaatcattatttgttatagtaggaagactgtagtaatttaagaaaatacttatcttattgcatctcacatttttgagtatccaacaaaagacacttcgcagtgtcttacctggaaggaagattgttttatgctaagttccctgggctctggggccctcttcctgctggtgagctctgaccatcttcaggagcttggcatgtgctttgctcttggggcctctcagctgggaaagatttgcctctggtggtagtacaggggtttgtctgctggtaaactgcttttctgtctttttcttgatgcattggcttcctgcagctcttcttctgtcttcagttgctagcagaagaggcctcacagtccctctcatggactggtctgtgatagcctttttagctgagtgatggggagttccacccttttgttcctagctcacagtggctgctaaaggcatagcaacctctctgagagcagagtctagtgtccccctcactttgccagcccttctgtcctttgagcatgtcatttcttgagggaatcaacatgtgcttctgtaatgggcagtgttcatcagagggtttgctcccattgctcaagagtagagatgcttcctcccagggctgacttcccataggtattttcctgagtctcagtgattttgacccttgattcagttaggtaacttatacctatgtctgctatatccaaaagttttctagaggagtttagtcaagtgattctgtctggcttgtgccttggtacatgaccagcatgattaacgtgcctcatcgcaacactgggctcttccaacccctgtttagggaaggagacttccttccttgaataactaagggactagttattcccagcctactccccttaagctttggagagcaatacacagattaaatataaatagtagggagcagagattctccagcaatctcccatgaatattttcaccacttttatttatttatttgagacggagtttcgctcttgttgcccaggctggagtgcaatggtgtgatctcagctcatcgcaacctccgcctcctgggttcaagcaattctcctgcctcagcctcccaagtagctgggattacaggcatgtgccaccacacctggctaattttgtatttttagtagagacagagtttctctatgttggtcaggctggtctcaaactcctgacctcaggtgatctgcccacctcagcctcacaaagtgctgagattacaggnnnnnnnnnnnnnnnnnnnnnnnnnnnnnnnnnnnnnnnnnnnnnnnnnnnnnnnnnnnnnnnnnnnnnnnnnnnnnnnnnnnagtccaggagtttgagaccagcctgggtaatatggtgaaatgttgtccatctctacaaaaaatataaaaattagctgggcatggtggcacatagctgtagccccagctatttgagagactgaagtggaaggattgcttgagcttgggaggtcaaggctgcagcagtcatctgagatagtgccactgcgctccagcctgggtgacagagagtgaccctgtctaaaaaaaaaaaaagaaagaaaaagtacacacacacacacacacacacagaaaaataattttattgatatgactctaacgagtcaatagataaatataaatcagttgtctttatcttagatgtattattattttcaagtgcttgtttattattatgatcaatggcgtttctatagctttgctatttcttttcttgttaaacctctgcttactaatttctataattggggaatcatatacctgttgtagttagatgctcttgaattccaccactgagaagtgaaggattttaacaaaaattgacaaaatcgaatccagatttcttcacctgtcatcatctttctgaaatagcactaatggagatgctcagattttggattcatccaataaatattaattgagcatctactttgtgccaggcaccattctagaaactggcattcagctctaagtaaaatagacaaggtacttctcaaaggctgactttttttctgtttgaaggcatcagttgcaatacattatttacctcttctatgtctttgtgggacataatagggttatagatatacaaaataaaagaaaacaacttttcagactggaaactgagttctactctgataatgctttatactatgttgaagataccacctcatattattttggaagcaggtgggctgtacatgttgaataaataatacattaaagtggactgaagacccatcttttgatcaccagctcttatctgaaaagttaacattactactgcagtttccaatatgagatattttgttttcttatacagtttcattgcttctctgcgcactctgctccccattcccctcataccctaggtatgaggtcttcaaaccagactgcatgttgggggatccggtgtatgcccactgtgcttattcatctttttatttttattttttttttttaattttttttttaatttttttttttattatactctaagttttagggtacatgtgcacattgtgcaggttagttacatatgtatacatgtgccatgctggtgcgctgcacccactaacgtgtcatctagcattaggtatatctaccaatgctatacctcccccctacccctaccccaccacaggccccagaagtgagattccccttactgagtgcatgtgaactcattgttcaatccccacctataaatgaaaatatgcggagcatggttttttgatcttagcgacagtttactgataatgatgggtaacaattacatgcatgtccctacagaagacatgaactaatcattctttatggctgcataacattccatggagcatatgtgccacattctcttaactcattatatcattgttggacattaaatctttttaaaggacacttttttccttacccctgcacccaaaccggaatagacattccctctatagaactggaggaggctggaccactgtattctctctcctacctaaagggcattttactgtatttttgatctttgtctaggtttaaagaaagtacagaagctccactgtgaactactttaatacttgcacattttccctaaagtcaattgccatggtatcaatgatgcttaaaaatagagtgaaattttgttatgtgactttcacctcaataaattattaataaaaaataaagtgggccataagtaggtacttcccagattttatttatatttatcaacactttattctggttcctttacaggctgtagaagattctgataggcatgaaaactacaacatatttaaaaaaacattgcttaggatatctccggcctttcaagtttgttctcaaaaataactttgcttgatcaaatgaactatattttggtttactaaagatgttctcagaaagaagaatatgtgtacatcaatgatttgtaatgcatttaaaattcaatactattttttaaaaatttaagtattataatggtactatttatagctagcagaagtagatatagggccaagttttaatttgcttggaaggttgaggcattcctatgataactgggaaaagtgaaatgcattgaggtatcccagatgaatggatgatgttatttttagttctgaaagttagccattcatggatttttgcctagagctcttttgtaacatattgaatgcaaatgtttggacattttagaataaatcttaagttgtccattcctcctttccccaaaggaaaagaagaccagagcaacaatgttggatatttaagtaattacttcttatttctggctttcttatctgtaattcttaaatatcaattaaaatcattgttcattcatctaatggatttagaagtttcattagtgtcaacaagttagtgtaatggtactcttcattttttccaaccaatattcatctgagattttaatgtttgtttaaaaagtagggatgtcctacaccttggtttcctttaagacttcataaattgcagagctctcaaacaaatcagtcagtaaaaaatattaagccataacaataaagattcctgaaaaacttatggtaactcgtaatgacacccttcctacctataatgtactgcactggaatgtcctctttacttaattcgcagatatcaacaattctgtgtaaaaatgaaataactttgaaattccctcagaaacattagagttcattacaaagcttatttgtggcaagacttagtttaaaaactaaatctatctttagtgacatttatgagctgactttttagccattagatagcaggattccttttctggacatttcatcttaactcacagttttagagtgttgtccttacttgaaaagaagagtgtaagatcaggtgtctactgcaaattcctgggaagttatttattgttaaagcactatgatgtggtttaagtgtattttcaaaaggattctatgtgggtagacacagtatccttccgttcagtagcatttgtatagtgcttaacataggcactgagtatttttaagtgaataaatgaacgagaatgctgatgtgaagccttatggattatctactacaagtaagtccaagctattccaggtcagccatgcaataaaattggacttggaagtaggtgggaggggagaagagttgaggtcaaatacaagctgggccactgcctccctcactcgctgtatgaatttaggcaagtcacttaacttttcagggccagggctgtcccttttggaaagtgaaagtattttgctgaatgtgctgagtagtctggtttctctgggcttgaatgtccttcatcttaagtaagcgcttctatttctagtggggaaagggtcaaagcgttctcagaacctggggttactccacatagccagttttgggaaatgttctttttctccttgtcttaacaaaatacacaacaaaatacactcccagtccacttacttttatactgtactgtgaaaagaattttaccaagaaataacctgcagtttaaggaatattaatagaatcattagaaatacaaaagaaagacacacaaacaaaatccagtggtgtctagcttcaaacccagtattaacttaaaatatttttatttatggatgtctctattcaatcactgaagtctgacctcttcttagcctggtttatttccttccctttcctcccctctcctctttcatttcttcatctccttcccacatccctctcctctcctctcctctcctctcctctcctctcctttcctttcctttcatttccctgcgtctgtttctttactgctatctggaaaaacttctattaattgtcttttttttcccaactaatctctaaaatttagttttcctaaatctctaatgatgaagtccagcagtttctccaggatgagctacatgcgtgtggagtactttgagcatctttttgggtatagtcacttatttgggtacctggctcttataagactgtcttcacctctctctcctaactcttgtttttcatggttctccccgtttctgctcactcctgcttcccttgaatttcttatacttctgggttgtttaagtgaggtttgtctcacaatcttggcaccctagtctagtcttagcctttctaaaaagtcattctaacatagatgctgtgttcagaagcttaaattctgattttttagaaaattgaagttgcagatgctttaagaaattgagagagagagaaagagaaagaggagagagagaaaattgagagccctttctttatccttgtagtttctttgtttatatcatgtagactctcagcttccttctctttgtgatttccagcttttcaggagtttcatccccctactccttatgttcataaagaaaagacagagctctaaaatgttagctttcttgagtcactagagagtcttttgtggacacctgctccttctgaaacaattgacttgtctactttcacaaacagcagtatttgtattaaagaaccagttggcatcaatgcccaagtgcaggtgtcctaatatataagatggtgcttcattcagaaaactcaaggtagagtaaaataaattatcaacatcttggctccatgctccattcacaactgttaattttacagggttatgcttccatctctgagcagagaactcctggcagggacagctgctcctgtgtctcacattgggctgagctcatcccagtaggagtcatcaagagcagcaggttagcgagaaggtgatagtacatcagagaactgagcagtggaggagggagaaggatgggcctctccaaagtgcttttcatttactcctttaatctttgtgtgtatatacatgcatggttaactaaggaaaaaggaaaagttgacttgaatttgactgagaaaattatcaaacctgcttttacttgtacatgtagctcattttcaaaaatacttttgtgtatccactggtatgttgatggtcctatgcagcaataggtctgtacgcttgtccaaagaatgtctaacagccccacatcatgattagcaggagctgggtcactggggcagagctggtttgacaggtggaaaacttgtcctgagtagttctgtattagcttacctcctaaactggagcaaaggtcaaggccaatccaagattgagaacaggcgccgaacatgttacatggtaaacactcttttattagtggtcttttgagggaaagttgctgtgttgttctttgctgttatttctgctagaacagtgttcacaaaagtgaacaaaagttcaatgctcaagttaaagaaatctaagaatggagactatcagtagccatgttggggcaccatggtaaacaatggaactggataaaattttatgtagttgcctacacaattctttctatgaccatacctgctgttcctatcctctgaattaattttcatgtggaaaatagtcatttgcagcatatattaggctacaaatgttgccatcaaaaggtaacattctatatgctagtctcttgtctttagtactaagatggctctattgatgataatacgaacacattttaggttcccaattgctttgggaataaagaattgtgacttagttaatatatgttgctttttcaaaaggagaaacagtgtttcccatcattttttaaaattcaggaatagtggtcttttttaattcagattttgaaggtttggtaagtttattgctaatgttggaccacacgcaagagaaagttagacattattttgtgaccagcattgttaagttgtcacattctgaacaaatcccttaaagacctggaactcatttacattttgcataaaatcctgatgggatttatggtttaaactttgactatactctttgtcttgaatttattaatttccttatcaggcttaaaacttgggggaaagtagacttttgcaaaatatttttttaaaccattaagttttatacaaagtccttctcaaaaaccctgtaaaccctctatctttcagagctctttgataaaaacctggggtgaatgtgatttattttttgcttttgtttctggtttgcttgcttttttgagacagggtctcaatctgttaccaaggctgaagtgcagtgacacaacaacagctcactgcagcctcgacctcgcaggctcaagtaagcctccttcctcagcctcctgagtagccaggaccactggtgcatgccactacacccatctaattttaaaattttctgtagagatggggtctcactatgttgccagggatggtctcgaactcctatgctcaagtgcctcctgccttcacttctcaaggtgcttgaattacaagtgtgaaccactgcacccagcttgtaaatgtgatttgagttgtcaaagtacttctaaaaaaaaggctggtttaagtttgacatggagcaacattgagccggggaaagaaaatacgtagaaaataatgccagtggccagatgcggtggctcacgcctgtaattccagcactttgggaggtggaggtgggcggatcactgaggtcaggagtttgagaccagcctgaacaacatgatgaaaccccgtctctacaaaatacaaaacttagtcgagtgtagtggcacatgcctgtaatcccagctatttgggaggtcaaggcaggagaattgcttgaacctgggaggcggaggttgccgtgagctgagaccacgccattgtactccagcctgggtgacagactgagactctatctcaaaaaaaaaaaaaaaaaaaaaaaaaaaaatggccagtgattctggaaggtccgaaagacattacttttcccatacaatactgtgggagaaagatgaggcttgatttgaacttccagggtactgttgaattcttaactccaaaaacagtgcctggcacaaaataaatcacttaataaatacttgttgaatgctgagatttaaaggagaagaatgtcattgaagccctctcttttcccttcttttctcgacaaaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacataggtgagcaaccgcgagggtcagatgcaatgggtggatggggaagggagttgctattcggaagaccaggccacctgggtcattgagggagaggaaaaagtctagaagatgttttccagaaatcaagggaagctgtgcttaatttcccaaagtggcaggactaagagctaaggttacattcccaaatatctccagagaggactaccagagaggactcaggcaggtctatgtagcagccagtactagaaagatctggcaattaccttaattggattgatatatgcagtcaaactagataaatctgctttaaaaaagtattctgtgtgctgatagacttagtttaataagtaattactgaggctacatatattttatggatgggaattagctaatgtgattatttggctctagaaaatgcctggtataaatacagccatcctcttcttgatccagattatatagtgtgtgaattgttggcagcaaaagtataatctcagaccacccttccctatctcacattatgtttctgggcattctctccaccatcggttggtgagtagtgtgtgtatatgtgggtatgctcagagaatgttaattgtaacattaattggggtcaaacataattaggaaaataagtctgtcgatgttgccaaaaacaaaagaaaaaccccaaatacagaatatgttgtgaagtcaaacataaataatcattttattattgaagacacgactttctacaatatgcataaataattgagggttcctatgattacaaaaaggtactggattctcttcagtttggagctgtaacttgcaagttggagggttttcactattactgctcaattgtgcagaattggaatagaatattcccagagcaagataaattcaacagagtttcgtccctggagactagatccttccctcaccccaacacatccacagtggtaaaggaggccaacagtttccatgatctttctctagtctaatatgaccgataaatactttccagccccaaagatcctcaaagataaagtttcttctgtgtccatttaaaagattgggtttactcctttagaagcgcctcggtttaaccaatgatgtttgtcatccaagggtccaaatacggactgaaccaccgtgtgctccttgggagaaaacctactccatgagagtggtctgaggaatgttttggcatctgaccatcagattgagaaagtaatgactggacttttaccttgatatacatttccccaaaatcagatactacaatatggtaggtgactattctagatattttaggtctacttctttcatcgtatccctaaaattctatgaatatgatgccagattatattaattaacattgttattggcatattccagctctggataaatcgtatgcttcttttcattttgaatctttattctaacacacaactgtcccaggggccagacattgaggtttagaagatgggaatttttccctggaaaaggtaaggcatgtgataaaaagtggggtgtgggttttaatttactcagcaaagcaaaacttaactacttttctttagatttaaggtttgagcctcaggtatgatgtctggaaatcactttgcatatccacaagttacttaatgtgtcattttcatacatcttagaaattaatcatgcttttaaatacagaacatatctgacatggcacagaccatattttttaactgggatttctaaagttgtgggaaacagagaaatgatgtgattttaggtatatgcttatgatttgggttgatagaaggattttttgaatcagtaggaagtctaatatataatatattttaaaagaaattaagttttattatgtttcaggttatgataactaactgcaaatgaattaatgaaatattttatgtagtaagttgtcaacaaatgtcaaatattgaatataaattgatgaaatttaaattatagataataatttgttcactcatttatatatttctcttgcata

SEQ ID NO: 17487 - DNA, 24394 bp, Human
  misc_feature (1)...(24394): n = A,T,C or G
tatctctggattacttgtaataatacaacgtaaataagatgtaaatagtttttacactatatttctttctttttttttttttttttttgcgagggagtctcactctgtcgcccaggctgaagtgcagtggtgtgatcaccgaggctggagtgcagtggtgcgatctcggctcactgcagcctccacctccccagctcaagtgattctcctgcctcagcttcctgaggagctggaattacaggcagggtctcgctctgtcacccaggctggagttcagtggtgtcatctcggctcactgcaacctctgcctcccaagttcaagtgattctcgtgcctcagcctcctgagtagctgagattaaggtgtgcgccaccacacctagctactttttggcatttttagtagagatgtggtttcaccatgttggccaggctggtcttgaactcctggccttgagtgatccacccaccttggcctcccaaagtgctggaataacagacatgagacaacatgcccagcatacactttatttcttaaaatttgtattatttttattggtgtactgtgttttttaattgctttttatttcccaaatattttccattgaggttcattgaatccctggatgcagaacccttggatatagagggccaactgtttgtcaaattatttataatttgctttttattttttcccttggtatataagttttgaatatattatcaaaatatttgatccagttttcacggggacagggtctcgctctgtcacccaggctggagtacagtggcgtggtcctagctcactgcaacctcaaactcttgggctcaagttgtcctcctaccttagcctcccaagtagctaggataacaggcatgtgccaccatgcctgggtaaattttaaattttttgtagacacagggtctcgctgtgttgcccaggatggtctcgaactctaggcctcaagcagttctcccagtttggcctccgaaagcattaggattacagggcgtgagctaccacgcccagtcccaattttgctttgatggaataacagtgactctcattggcaaccagctcattttcatacttctttagtgtattttttttcgaagcaaccatacttactttattttatttaaccaccaattatgaattggtttccattggaatggagtgaagtcttttttttttttttttgttgagacagagtcccgctctgtcacccaggctggagtgcagtggcgtgatctcggctcactgcaagctccgcctcccgggttctcgccattctcctgcctcagcctcccgagtagctgggactacaggcgtccgccatcacgcctggctaattttttgtatttttagtagagacagggtttcaccgtgttagccaggatggttttgatctcctgacctcgtgatccgcccgcctcggcttcccaaagtgctgggattacaggcgtgagccactgcgcccggccgagtgaagtctttttgaatagtaaatgcttgtttgtgagtcatcttattgtgaacacccatatattcttttctttttttttttttttttgagatggagtctcactctgtcacccaggctggagtgcagtggtgtgatctcggctcactgcaacttccgcctgctgggttcaagtgattctcctgcctcagcctcctaagtagctgggattacaggtgcctaccactgcgcccggctaatttttgtatttttactagagacggtgttacaccatgttggctaggctggtcttgaactcctgacctcaagtgatctgcccacctcggcctcccaaagtgctgggattacaggcataagccactgtgcccagcctaacacctatatattctgattataaatgttctgagagaagttgttaaaaaacaaaatatagaaaacttattactataggcaatacaacttttatgagtacctgttgagtaatttatgctacaattttgttttatctttctgccagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggtatttttgtaatgaaattttagccccatatcatcgaagtacatttcaaccttttagttgaatataatatcaatcagatacttgtgttttgtggaaggcataggaactttaaaatatatggagaatttgatcacattgcactgctttccattctttctatcctagtctaagccttttctcattcttgacttaattattgaaacagccttctagctggagtctgtgtcctttcttgttcccctagtttattctttacacagagagatagcttttttttttttttttttttttgagactgggtctggctctgtcgctgaggctggagtgcagtggtgtgatcttggctcattgcaacctctgccttccaggctcgagccatcccccacctcagcctcccatgtaactaagactacaggcatgtgccaccacacctagctaacttatatcttttctagagatggtgttttgcagggttgcccaagctggtcttgaactcttggggtcaagcaatccacccgcctcggactcccaaagttctgggattgtaggcgtgagccaccacatattatcattcttctatttaaaaccctccagtggcttcattcagtttcaaatccaaaggcctgtgacagccactaacatcctttatgatttcgctgcctgactttcttttcagtttcatctcctaccaccctgttaggtatgtgaatctatttcctcagctgtaaattttacaaactctaagtacaaatcaggtgtttcccatgaaaatttagggtccaaattgagatgtgctattaacttaaagtgtacattagactttgaagactcactaaaaaaatagaatgtaaaacatctcattaataatattttatattgactgttgaaatgataatattttggatatactgggttaagtaaaatagattattaaatgaatttcatatgtggctcacatattcctcatggacaatgatgcttcaactgatttctaagaaccaagccctttgatttggcagaaactttcccctttttatttattaataggcctttccaaatctctttgctttaattatccatatcatccatctatagggaacattgttatggttggcaagaactcgagtcttaatgctgaaatactttttttggtttgagacagggtctgccttgtcacccagactgacatggtggagtggcatgatcacggctcactataacctccaccccctgggcataagccatccccccacctcagtcttccaagtagctggggactacaggtgcccaccaccacacctggctaagttttgtattttttgtagagatggcgtttggccatgttgctcagactggtcttgaactcctgagctcaagtgatccacccacctcagcctgaatcatacttaaaaacaattttttttggccgggtgcagtggctcacacctgtattcccagcactttgggagaccaaggcgggcagatcatgaggtcaggagattgagaccatcctggctaacacagtgaaaccctgtctctactaaaaatacaaaaagttagccaggcgtcatggcgggcgcctgtagtcccagctacttaggaggctgaggcaggagaatgacgtgaacccggcaggcggagcttgcagtgcgctgagatcgtgccactgcactccatcctgggtgacagagcgagactccgtctcaaaaaaaaaaaatttttttttaagagttggaatattgctacatcacccaggctagagtgcagtcacttttcacaggcttgatcacagaacactatagccttgaaaccctgagctcaagtggtccttctgcctctcaagtagctggggctacaggtgtgtcccagtgtgcttggctgaattacactttgttatgactgtcaaagcagctctgtagttatatttaatttagtgaatcatcagctgtcagatgaagacaactatatagaagactcagtgagaaaaggcaaatatcagtgtccttaatcaaggagctcacaattcagtgagaaagacagagataagtgaatcactcatacaaggcagattattccaactgataatagctgcaaatgcagtgtcttgggaatgtgaggacaagattaaatctaactgaaagagggccgtgcagggcggctcacgcctgtaatcccagcactttgggaggctgaggtgggcagatcacctgaggtcaggagttcgataccagcctggccaacatggcaaaaccccatctctactgataatataaaaattagctgggcatggtggtgggctacttgggaggctgaggcaggagaattgtttgaacctaggaggtggaggttgcagtgagctgagatcgcgctgttgcactccagcctgggtgacaagagtgaaactctgtctcaaaacaaaaacaaaaacaaactctaactgaaagaatctggaaaagaagcggcattcaaatgttaagatttcttttttctttttttttttttccccatatgggatgcttcacaaatttccatgtcatccttgcacaggggccatgctaatctttgtatcattccaattttagtatatgtgctgccaaggccagcaccaaatgttaagatttaaactgagctttaagggaatgaggagaaggactttcacaatagacagcatctttgagcaaagaggttgggaatagttaacagaggtgaaagtgctagggcaggaatgaattttctttacaatgcccctctttaaaaagtaaaacaattattggcatagaattttaagcatggcatatttaaatttattttctttccaggattcaaaagattcttctcttttggagagtgatatgaaacggaaaggcaagctaaagaataaaggaagcaaaaggaagaaagaagatcttcaggaagtagatggagaaattgaagctgtcctacaaaagaaaggtaaggtgtgagtcttgttggtggcagtggtcatgtttgcagtgagagaagcatcattctgtcccaagctattttgcttgagggaccttctatgtgcagaaatgtttaccaggaaatatttctatatttaatggacctttgtttacttaaagactattcattataattatgagttactactgaatcattaatcttttcatctcctcatttttgtttaccagctaaagccagggggttagaattccagatctccaacgtgaagtttgaagatgtgggaggcaatgatatgacattaaaagttagtgcaaattctgaattttacctcaaatggatatattactaatcagttatgagaaaaaagcctacctctttgtttctaatatgatctgggtgtagaaaaggaaactgggaaggttgagaagggcaaacctgacctgtaccctttagggcattgcaggagaaaagatgcatactattttgaacttttctattattttaattatagtatatataagatccatgctttataagtaatattgtcttagcaatactaatagtaatggtaactttatttttatttattttttattttattttatttatttattttgagaaggagtgtagctctgtcaccaggctggagtgcagtggcgcgatcttggctcactgcaacctccgcctcccaggttcaagagattcttctgcctcagccacccgagtagttgggtttacaggcatgtgccaccacgcccagctaatttttgtatttttagtagagacagggcttcaccatgttggccaggatggtcttgatctcctgacttcgtgatctgcccacctcagcctcccaaagtgctgggattacaggcgtgagccaccatacctggccgtaatggtaactttatttttaatgcctactctttttcatctgccatgctagttaactttgcattacatcctcaaggtatataatgttacagcttaggaaatagctcctcagagaggttattgctgaaatcacacagtaggtaccagagccaggattcaaagtctgatctaagtctaaggtgtatattctacctatctactccatttcactgctccgaaaaataggacatttcattctactttgattgttctgtcttgaaagacatctttgtgcttatcctctgctaggaggtctgcaagatgctcatacacatgcgtcacccggaggtgtaccaccacctgggcgtcgtgccccctcgtggagttctccttcatggaccaccaggctgtgggaagacattacttgcacatgcaattgctggggtgaggcttgctgacatttgtttgcttttgctgtttttgttgttattatttgtttttgttttttctctttggtcaacttaaaccagacatggcattcttcaggaagagaacatagtcattggaactgatccctttgttatcatgctggtattatttgtggtatttattcatttagtttatttattgtttctcacgagcaacttgagggatttttttttttaatgtatgtaattgtttatatggcaagagttagataaaaagtaaaataatacagtttttttttttttggagacagagtctcactctgtcacccaggctggaatgcagtgtcgtgatcttggcttactgcaacctccgcctcccgggttcaagcaattctcctgcctcagcctccccagtagctgggactacaggcatacgccaccacgcccggctgattttttgtattatagtagagacggggtttcaccctcttgcccaggctggtcttgagctcctgaggtcaggcagtccacttgcctcagcctcccaaagtgctaggattacaggtgtgagtcatcgcacccggccataataatacggttttaaacaaacctttttattaacacatagcttacattttagttactttgctttccctttaacccaatagttatttcagtttacttatttttttgagacagagtttcactgtcacccaggctggagtgcaatggtgcaatcatggctcactacagcctcaacttcccaggctcaagtggtcctcccacctcagcctcccgagtaactggaaacacagacacataccaccacgcccagcttatgtttttgtttttttgtagagacgaagcccactatgttgcctggctggtcttaaactcctggcctcaagcagtcctcctgtctcagtcttccaaagtgctgggattacaggcatgggccactgcacctgccctcccagtggttctaaggagcagtaaaataagaaaactagggttatattatttttcatatagctaaatttattcaaaatttttatttagagtcatgttcttatactttttagttttaaaataattctttctaaaatggtaataatagacacttactttgagaaattaaaagttagcaatcttattttaaccctctcagatttttcagaaactgtaggggacagtaatgtaaaatatccgagtaacttcgattagaaaaatagcatgctcgccgggcgcagtggctcatgcctgtaatcccagcactttgggaggccgaggcatgtggatcacctgaggtcgggagttcaagaccagcctgaccaacatggagaaacccccatctctactaaaaatacaaaattagccgggtgtggtggcgcatgcctgcaatcccagctacttgggggctaaggcaggagaatcacttgaacctggaggcggaggtcgcggtgagccaagatcatgccattgcactccagcttgggcaacaagagccagactctatctcaaaaaaaaaagaaaaaagaaaaatagcatgttataccaagcgctaatacaataatgttctatgaaagaaaatcatttgtaaagggggacttgattggtttgcttcatttttgtttaataattccattacatgactgactactgcatgccagactttggaatatagtgttaagtaccacaatcgtagttctaatatgagagagacattaaacagtcattcatataaataaatgctgtacataataatgactataataaatggaagacaagaagaagtgcaaaatggtatgtggtatgttaggattcccaaattagagttgggttcaaggaaggtatggttgaggaagtgaaatttcaagataagcacaagaatgggagaacagtagtctctcttctctcttttttttttttttttttttttgaaacagattttctctctgttgcccaggctgagtgcagtggcatgatcacagctcactgcagctttgacttctcaggctcaaatgatcctcctgcctcagcctcacaggtaactgggactgcaggcatgcatcagcatgcctggctaatttattatttttttagaggtggggtctcacttggtgttgcccaggctggtctcaaactcctctcaaannnnnnnnnnnnnnnnnnnnnnnnnnnnnnnnnnnnnnnnnnnnnnnnnnnnnntattttctccttagcagatgggtaagaattgttttgataggccaggaatggtcactcctgtatccccagcactttgggaggctgaattgggaggatggcttgaggccaggagtttgggaccagcctgggcaacatagtgagacacagtctctccaaaaaaaacgaagaattgctttggctcagccctaagtggggataacatacctcttgaaagtcaagaccctttattcagaaaagataatagaattttatagtgacatgtataaaataaaaacaagttgaaggtatccacttaaatgtgtttgcatgaaaccgttgattttttttttttttgagatggagttttgctcttgttgcccaggctggagtgcaatggcgcgatctcggctcactacaacctccgcctcccaggttcaagcaattcttctgcctcagccttcccaagtagctgggattataggcatgcaccaccatgcatggctaatttttgtatttttagtaaaaatggggtttctccatgttggtcagggtggtctcgaactcctgacctcaggtgatccgcccacctcagcctcccaaagtagtgggattataggcctgagccaccatgcccggccaaaaccattgattttcaaatagtgtttttcactgggccaacataaaaagatgaagttcctcaggaaactagctatttaaaaaatttgaggggactggataagaaaaagtagggaaattaaaatttgaatatttggttattcttttatgtgtctgcataggaacttgacctgccaattttgaaagtggctgctccagagattgtgtctggagtatccggagagtctgagcagaagctgagagaactatttgagcaagctgtggtgagtcagttaatgactaatgccaggtggtcagacgctaccagcttatattaaagatcctgctttttctgatgctagtatttgttaacccactcactggccattcttttattaatataaacatggtaatttgctatgcatgatggctaaatatttaaagtagatttagtgataccagctgttggataaataacccttttcatttgaaatcaaacataaatgtaattggtgagaaattctgggccgtcataccctgtagtcatatgttgaaaatatattatccttatgatattttccactcacttttactttcctcaacttaagtttggccaaaaaaaacttgtaagcaatgtaaaaattgttatttaggctattataaaagcaaccataaaaataccagaataaattctgtcattccttactagtaaactagggcaataataatacccaaatctcacgtggctattgagagtattaaatgagagaattcttataaaaccttcgatatggtgccttgcacacagcacaagccctgtaaatattagctgtaagattattcacacttgaacaaatatcactgtgtttaaaactaaaaaatggtgaaaagtttatgtcattattagcaatgacaatatatagtagctgatgaatatccaatacaactgttagaagcctgtgtgaaattagaagagaaattatatttaagcagtaattgagaaaaaaaaaacattttaaataaaaagaatgggtaggccatctacttagttatggtgcgggctgacgttgaaaaagctgtgggcaacactaggaggataaagagaaaaaaggtggaaagggcagagtgcagagcaaagctgaactttctcaggtgctacctgttttccaaaacgcggtggattccattgttaaattggcacgcatagccagagacaagtagtaaattttgtgcgtatggtaaacacgatgaataagggtaagaggcaaatggcatctttaggttgttagttctgtgtttaaacctctcactaaaccagtactgagccagtacagtacctcacagtagatgctcagtaaatatgtggcctagcaccccgcttttcctggtcccctcttcgctaatgagaatgagtccagtaaagcatgtggatcaggaaacaaaaaggtgaaatccaatcaagtgatacttggttgaaaactatgctttctttaggccacattctgatgaccatcatttattcttttttttcccccattcaactttccaggtcactgacaagtactgatgtgcttgttttctggtgcttttggcctctgtaattttactcctttgtaactgggtaatatatctagcagtcataggcgtcttttgcaaacattgtcataaggatgattagggaagagatccagctagcgataagctaaatatctttccctttaagatgtggttgttcccatggttttgagatgccttaagcgacgctgacagccttacttagcataatcactgtcactcctaaccattgagtaactgattgagtaaaatgatttagattgtaaatctagataattttcttcaatttttttcattttaactgatccttatctcttttttgtggtaaaatatatataacagaatttaccattttaaacatttttttaagtttttgtaaattattttatgtcttccatgatgatttagagggactatcttcaaaccagtacagatatttcataaataatacctggctgttttctaaccaactgagtaatttgttgcataataagccacctcacatctttcagcaagaaatacattaaatttgaatagtaaagatattacacaatgaattaggacaacaatttaaatttgctttaaatgtttctttgcggaagaggacactacacttctactcaatgaagagaaacatttttacagtccagaggtcttttattaccacctattatgccatgaattcacagggaagaggctccagcagttcaggctccttcctattggttctcagagtgcacttctctgggtggagcatgctgacactttccctttggtttcctttttctgatcattttcctccatgtgtttcagaaagctacctcggctcctagaatgcttaatgtgctcaatatgcacgttgattctcgcacacattgattctcttggcaagaatcttgcccttaacttgtttctttacaacaatgccagcagcatgctggataacgttatagactcttccagttttgtggtggtaacacttgtgggacattcctttttgaacagtacccattcccttgatgtctacagtatcacatttctttttctcttctcttcttttcttttttgagacagagtctcgttctgttgcccaggctggagtgcagtgggacaatctcagctcactgcaacctctgcctcccgggttgaagcagttctcttgcctcagcctcccaaatagctgggattacaggcatgcactacccaccagctaattttttttttttttttttttgagatggagtatctctctgttgtccaggctggaatgtctcagctcactgcagcctctgccttccaggctcaaataattctcctgcctcagcctcccgagtagctgggattacagacatgcaccaccacacctggctagtttttgtatgtttagtagagacggcgttttgccatgttggccaggctggtcttgaacttctgacctctggtgatctacccgccttggcctcccaaagtgctgggattacaggcatgagccatggcgcctggcctacaatatgacatttcttatagatttgcatacatatagccaaaggaacagctccatgttttctgaacggcctagagaacatctctcaggtgcctctcctctttctctttgtgttcatcattttggtgaattactggaagatggcagttccaactgaaaaggccattttaaacatttttaagtgtacaattctgtggcattaagtacattcatattgttgtgttatcattacccccatccatttccagaatgtcttcatgttcccagacagtaagtccccattcctctctcctaccagtccctggccatcaccaccattctactttttgtcttaatgaatttgactactctcggtagctgatccttacatcttaacttattctttctgaaccgtgtctagtttatttcttaaaaacaaaaaaactggaggtgatctttacactgatgtattagaactttaccatccttccttattcagtgtagcctttaaaataagcttccggtacttttcagtgtggatgctgggaaagttctggagatggatagtggtgacgtttacacaacagtctgaaaatatttaatgccactaaactatatacccaaagtggttagaatggtaaattttatgtatattttaccacagattttttaaaaagcttctggtgcttctcaaatttcctcttatagcaaattatagggaaagacttggagattcttacgttagtagaaaccctcataacgtttctagtgagcttgggtttgctaatttaaagtttataaacttgttgtcttaagtttttttttctgtgcatatgcttatccaaaatcattgtttctgtttcatagcatagcaaatgtatctaatttacaaaagaatttcagtagatttatcacaaaacatgcattgatgaagagactataaatgtgttaccctatctgcagtctcttactgtgtacttctaatcatcttggttctcttaagtcaggtaaaaatcagaagtaacacatgtgaactgccttctttagggttattcttttggcaaatgatccttgaccttgaagattttttttaaaatgtatatgcttaattgtgcttcagtataggggatgcatttatgattgtctttttgtgatatttttatttctagtcaaatgcaccatgtatcattttcattgatgaaattgatgctattacccccaaaagagaagtggcttcaaaagatatggaacgaagaattgtagcccaactcctaacctgcatggatggttagtttaaaataataaattcattttaagagaataaattttttaaaatagtgtaattaatacatgaagataaaaaataatattcatatagtaaatatcaaatagtgtaaaaaaaaagtcatactgggcacagtggctcatgcctgtaatcctaacactttgggaggctaaggtaggaggattgcttgagcctagtagtttgaggccagcctgggcaacatagcgagatgctacctctaaaaataaataaaaagaaatagcacttgttttgtgtacacaagaaaatttgaagtatatattttatgttccttgcattaccagattgtaggttgcttcttcttctgattgatggactgattgattgattgatgagatagagtgttgctctgtcacccaggctggaatgcagtggcacaatcacagctcaccgcagccttgacctcctgggctcaagtgatcctcccatttaagcctcccaaatagctgtgaccacaggtgtgcaccaccatgcctggcttttttttttttttttttttttttgagacagagtctctgttgcctaggcttgagtgcactggcatgatctcaactcgctgcaacctctgcctcctgcgttcaacctattcacctcctcagcctcctgagtagctgggattacaggtgcgtgccaccacacctggctgatttttgagacggggtgtttccatgttggccaggctggtctcgaactcctgacctcaggtgatctactggcctcagcctcctgaagtgctgggattacaggtgtgagccactgtgcctgggtgttttttttttttaaagacggtctcactatgttgcccaggctgatctcgaactcctgggctcagtctttctgcttcagcctcccgaagtgctgggattctgttttatttttatctaaaattttcttgccatgtctttgaggcctgcattctgagaaaatgctttcatggcttcctgctagctaaagaacacactgtggctgggcgcagtggctcatgcctgtaatcttagcactttgggaggccgaggtgggtggatcaggaggtcaggagatcgagaccatcctggttaacacggtgaaactctgtctctactaaaaaataaaaaaataaaaaaattagccgggcgtggtggcgggcgcctgtagtcccaggtactcgggaggctgaggcaggagaatggcatgaacctgggaggcagagcttgccatgagctgagatggtgccactgcacttcagcctgggcgacagagcgagactccgtctcaaaaaaaaaaaaagaacacactgtataaactcctcatgatttaattagcatcttactaccttcttgttacctgtgagggaaaataacctcagactccctgctgttcaatcctggttcagctgagagaaataatacttaggaaagataagatttaagtcctcagttttgtccattcctagaaatacattcctagattaagccagaacagctgaagactattttgtattcccctgctcgaattaattttatcagtctattctgagacacagactttggcatcctccccagcctccctgttgtcctgctcaccttgcctggatgtgccatgcatgcttgaccctctgtgctttcactaatactctttcttctacatagaattccattagcctatatatctgcttgttaaaattgtatttacccttcaagccttttctgaaatgttaccacctccatgaaccctcccttattcctcagttggaattcatgatgtcttttctcttattaccatggtgctttgtttatatctgttattatacttcacaaaatttgtctgatgccatttttttatttacacactcaatgtttctcaatagattgtgaactgctgaggacagagtttgtattttatttatcctcctcacaccttttacatatttgacatttaataaatgttggttttatatgtatgttgctgtcgaaatctgtaatactttatctttaaccatgaaatgattctgtaaccattattgccgtcagtgtcaagtgctttgttcactactctttctctgtctcttactagatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaaggtatattcttatagaatgaagtttgtatgccactaagtcatcttaactgaatggtttgaaagtaagaggtgagaaataccaagtagccttttctttctctctctttctttttgtaccaattaaattgatttggaaaaggagaagcccacattaagaaaatcatttatgcctgggtgcagtggctcatgcctgtaatcccaacactttgggaggccgaggcaggaggatcacttgataccaggattttgagcctgggcaacatagtgtgaccctgtctctacaaaaaataaaatcagctgtgcacacacctgtagtcctagttactcaggaggctgaagcacaggaggattgcttgagcccaggagttcaaggctgcagtaagttatgattgtgtcactgtgctccaacctgggtgacagagggaggccccacctctgtaaaaaaagaggaagaaaacaatttactcatcagtaggataattgtttcaggttgttttttcagaagtagtaatggacttatgtatccatactcatttgtctggtcttattaacaatggcttgcattcttcagttggctgaccaggttagtggcaatgtctggagctatggcatacagcagccatctggtccacttataggttaaatctgagtaccatactttaacctattgcactaacctgtctgagaccacaggtcctgttaccagtaatgaaatggcagccagacagttgaaagctgtttgctgcagtaccagcctttcctggtaattgagcaaatgagtaatgtccatagagcaaataaatatccaccaataaccagaaatataacttcataagcgagactatctcaggaagcactgttgaggtggtagagtggaaatctagttaagaaatgttctgggccaggcacggtggctcacgcctgtaatccctgcactttgggaggccgaggcgggcggatcacgaggtcaggagattgagaccatcctggctaacatggtgaaaccccgttactactaaaaatacaaaaaattagccaggcatggtggcaggctcctgtagtcccagctacttgagaggctgaggcaggagaatggcgtgaacccgggaggcggagcttgcagtgagccgagatggcgccactgcactccagcctgggcgacagagcaagactctgtctcaaaaaaaaaaaaaaaaattgttctgaaatattaggtcgggtatggtggctcacacctgtaatcctagcactttgggaggccgaggcgggtgcatcacttgaggttaggagttcaagaccagcctagccaacatggtgaaaccccatctctactaaaaatacacaaaaaaattagccgggcgtgatggtgcatgcctgtaatcccagctacttaggaaactgaggtaggggaatcgcttgaacctgggaagtggaggttgtagtgagccgatgtcatgccactgtactccatccagcctgggtgacacagcaaaaccctgtctcaaaaaaaaaaaggtatttaatgaggaaggggtacactgaagatcctggtgaggtccaggaacagtgtgggagtaattgcacatataagctcagacatgtgagactgggcagagtgccgcatgtgagattgtgatctcagataggggctagatccaggtgatgacgaggtccagggtatgagtaagtgtaagtaaggaggagaaaggccagacctaggcgggactgggttgcagaggcaatgaatagatgcccaaactttgagccagtgaaggaaaattattccacctctgcctcctgttatccttggtccttgtccagtgtttttaacatttccaagctttagtttatttacctataatgcagtaataataatagtaataactttatctgtaaagtgatcataatactacaaaggcttcctgtgagtattgaattaacataacctagcacaatatctgacatagagaattttttaaataaggtagctattgatagctgtctcttttattattactattttttatatagagaaagggtctcactatgttgcccaggctcatcttgaactcctgccctcaagtgatcctccggatatcatcctgtacttcaaaagcatcaaattatggaaaagtttcagcatacataaaaggaaacccgtataaattgttccagtttctattggtgtaaaacagaccacaccaaaatttagtgtcttacagcaatactcattttattgtgtctcacagtttctgtggatcaagaatttagaaaggcctcagctagatggttctgccttgcggtctcacgtggctgcagtagctggagctagaacagtggtagctttcccttcttttggagtttctacagtatgatgaccaaaaatacccactttttttagggatagagtacaactatgaaaagggcgatattattttctgttagccattttcacaacatccaaaatgttcttagtacggatagtccccaactgacaatgctttggcttatagtttttcaactttacaaagggtttatcatgatgtttttgacttaagatgggtttatcaggaatgtaaactcatggtaagtcgaagagtgttttgtattcttgtgcatagtagcaaattggatctgtatcttttggaaatagttctttagtggaaagttttcttgattcccattattcagagtatcccagtgaaattttaaaaaatttgtcagtaatgtttatctgcttctattctgctcacttatatgatcccaaatgatttttctataatttattctttattagcttgacatttgaaaatattagtcttctttacaaagttattaattttaaaatatatttccttgtccaagttagtttataatatcaaaatatgtaaataagaattaacattcattggcgcatgcctataatcccagctacttgggaggctgaggcaggagaatcgcttgaacctgggaggcggaggttgcggtgagccgagatcgtgccattgcactccagccagggcaacaagagcaaaactccgtctcagaaaaaaaaagaattaacattcattgggcactaactgtagatcagccattgttttatgtgctttgcatgtattcatttgtagcaacagccctctgaataagtgctactataatatagattgaataaatgaacaaactgaagcacaaagattaagtaactggcccagataacaaaggttaacagagctgggattcagactcttgcagtttggcttcagacctttcatcctgaatatcttttttttaaattattcgagatggagtcttgctctgtcgtccgggctggagtgcagtgacacaatcttggctcactgcaacctctgcctcccggttcaagcaattctccttcctcaggctcccgtgtagctaggattacaggtacccgcccccatgcccagctaatttttttttttttttttttgagacagagtctcgctctgttgcccaggctggagtgcaatggcctgatctcagctcactgcaagctccgcctcccaggttcatgccattctccttcctcagcctcccgagtagctgggactacaggtgcccgccaccacgcccagctaattttttgtatctttagtagagacggggtttcaccgtgttagccaggatggtcttgatctcctgacctcgtgatctgcctgcctcggcctcccaaagtgctgggattacaaggtgtgagccactgtgcccggccatgcccagctaatttttgtatgtttagtagagacgggattttgccatgttggccaggctaatctcaaactcttgacctcaggtgatttgcctgcctcagcctcccagagtgctgggattgcaggtgtgagccaccgcacctgccctcatcttgaatatctttactgcttttaagtttttattcagtaggtcttatcagaaattgttcaagatattcctttaataacaattatctagaagtccagatgtttatagataccatgttgccagttaggttgaacaaaattttccacacatgtagtacaggggatgaacaataggtaaagataaagttggagttgtaactgtcctaatatgaaatgggaagtatatggcaagataattttcaatgatgaagataattaatggtttgtgtgtatgtgggggcttttatttctggtagatatccatttaatctactctaaaagtacccccataagttatttatcttatttcccctgtaatgttgtaaattcttaaaggcaaaatattttttaaaaattctatgtattcgtcacagcacttagcatgtttcctaacaaagcagatatttaccataatcctttctggaataagatggaacatgtaataatgacagcgtttgttgagtgactgaactatttgatcttatatagtatccattttgatacctttggcagacgtgaaggacttcaaataaatatagttggtgacttgtttttactattagatcaggaatcagaaattttttcccctgtcttttctacagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggtgctttctctaaaggcaccttaaattgtccttttaatgttctttgtgttatcttacattgaagcaagggtcaatacaattgaggttcattactttctgttttattggcatttaatctatagaatacttatcatttatacccacgatgtttatcatttcaaaaatatgagttgttttatgtttagtttattttaataaattcattttacaataatgattatgaaattctggaatggggttggcagactgtggcctacccacccaccacgtgtttttgtaaattaaagttatattggaacacagccatgttcatttgtatacatgttgtctgtttctgctttcgttcttcatggcagaattcacacaggagtctgcagcagagaccgtggcccacaaagcctacggtgtttacagtctaaacctttacagaaaaaggttgtcaacccctatttcagcattggcatttaattatatctcctggttaacttttggttaggtagattacagtggtctgttgacacaactatatccatgtcggtagctgcaaacagctctggaggacagtcatgtgaataataggggacagttatcagtccaagatcggtattaaattttttagttttatgagtcatgaaaattcaatatatatatcatttcatatagcattttatagcttgcacagatggcttctgtatgttatataatttgatccctgtaaccttatataaatgtcattttccccattttataatcaaaggcactaagcttaagtggttatgatttcctcaagcccatacagcctctactttatagagcaggggcttcaatccagatcttttgttctcagataatttgtttttttcttagacatttgaaactgcaattaattctgtaaaaaataacaaactcattccttttataatattgcatataaattaatattttataaattgaattaattggttacctgttttttagacttatcctttcatcttctccacaaagcaagaaatctgccttttaagtttaagatttgatagtaataggaaaattgccttccctctacttagttgataaaccatcaaggaaccatattaatgaattatactacctccagcataagtgttttaatttcatcaggattcaactgtttcttgaatatttataaatgaaacatgggaaatattatggttgctgaaatgaatatttgccaacgcttatatttgctatacctagccctagtatatagaagtcattcttatatgtttaattataattataattggtatatctttacttgaccagagcatatgatccttaagaataaaatgaacttgtctcatgtcagagagaaaattattaaaatacatagacgttcaggatagcttacggaaatattacagtaataatttttacaagtagaaaatgtaacttttcaatagctgttgtggtgtttctttatttttttcccctctattgttcccttcaaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggtaggtatatcagctgccaaatattattggcatgtcatggattaaagaccagagataaagctccatgcatgtgtactaggttctgtggctaaactgacttgactataatcactgtgtctaacttgacttgaatgtagcacttctttcaagcccccaacaatggtttttcttttgtttgagatccgatttgtttatttttttaaattgatgtatcatagttgtaaatatttttgggatacatgtgatattttgatacatatattaaatgtgtattgatgaagtcagggtaattgggatattcatcacctctaatgtttatgttttctttgtgttgggaacattatactttttttcttctagctgttttgaaatatacttttttcttctagctgttttgaaatataatttccctaccgtgctatcaaataccagaacttattactcctatctaactattttttttacccgttaaccaacttctcttcattatactcatctccaccttcccttcccagcctctggtaaccatcaatttgctctctgtctccatgagatccactttattagctcccactatgagtgagaatgtgcaatatttgcctttctgtgcctagtttatttcactaacataatgacctctagttccatccatgttgctgcaaatgacaggatttcattcatttttgtggctgaataatattccattgagacctattttatgctgatccttttggttgtgcttcatttctgtagcagtgagtttaaaccacaaaaaattataggtttcagttaagaccaaattgtttgacaaagactttctgaacttgatcttatggatcaaggcaattttaatgcacataaaactttggattaatttttatttactttacttttctactcatcattccatggttcattaatggaaatatgatcgatttagaggtatgtactactgaaagagaaaatacactgggattatagtcaacagatatctctggcttttaactatgcaaaagttactgctgcatctgatttcttagaggagaccattgtctaaacattttataacctagaaatttaaatggttttctaaaacatatttgttgaaatattatatcattatgtctaaaatgttcttagacattatgttcaagtataaattcctcaagtgcagggacttttctctttatcaccacagagcatgaacaggtaaaccaggtactgttcgtatcttcaggcctcacagtcatgttgaaaataagcctgagaagctgggcgcagtggctcatgcctgtaatcccagcactttgggaggctgaggcaggtggatcacctgaggtcaggagttcaagaccagcctggccaacatggtgaaaccccgactctactaaaaatacaaaaattagccagacgtggtggcatgtgcctgtagtcccagctactcacgaggctaaggtgggaggattgcttgaacccaggaggcagaagttgcagtgagccaagatagcaccactgcactctagctgggtgacagagggagactcaaaaaaaaaaaaaaaccataaaatatgtatctggaaataatttgaacctgcagtataaaatggacatgtaatggatcgccgtttgtatcattatttccaggcaccagtacgcaacccagaccagttcaaagctcttggattggtgactccagctggggtcctccttgctggtcctcctggctgtgggaagactctgctggcgaaggtatcatataagttcaattgcatgtaatttatttcttagtatcagataggataatatgaacttaactttaaatattacagtgaggtaagtcttatgcataatttttatcagaagtttattttagcaaaactgacaactttcttcattaaagtttcctacttttttaaattacaaaggcacatgattgaaaaatgtttatatcaaccataatcctatcaattttaacatgcaattattatattttctgtgtat

SEQ ID NO: 17488 - DNA, 8542 bp, Human
  misc_feature (1)...(8542): n = A,T,C or G
ttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgggcctgttttctgccttgttatttgatgagggggggatggggtaaggacgagggagggagggacagagccaggacctgggtctctgttgaagcagtctgctgtcttggcaagtaggtacctcttagctttgggtccatctctcagtcactcatcagacactggttgagctcctgctccatctttgcctgggatctgctgtctccattgtcactggctgcctggagctctctatgtaccacgtgcagcacccggatctccttcccaaagtgctcatgcaactcctggaagctggagggggtactcacagtggctagaaagccactgtcctctggggatgagatgggttcttggccagttgcctggcacagctcccagtattgggttttggtggggggggaggggggacagcagcccagccagccgcctccagctcgcgccagccagtgcccacagccaagtctccagctcttcctgggtttctgcagccagcttgtaggcccgcccacctgtgccctccaccccaggggtcaggatggtaaaggcatagggttctgcagccttaaggtgtggttccacctggcagttctctaacaggatgaggcccaggggtgcatggtcggtctagtgttctaggtagaagaggaggtttcctcggaggatgaaccatcggcgctggtagctgaggtttcgggtccccttctttagcagaatgccttcctggtctggggcctgtgttctgtaaccatggaagaaactgagcacggactttctgtgcagttttcatcgtgatccaatatgggaggaaacccctagggagagagaagtggcccatctagttgcctgggggaagagtaggggaactctcatgctgtcctcgtctggcttcagcacgtgctgcctgcgcacagtcttggcttagggggatgcaggctccgagtgtcaagagctaggggtcccagcacaggggctgatccccgctacctccccaattcccccttctgcttgggccacattccgctacctgggcaggagttgctaggccctgtttgctcaggggggcttcatgctgcagagaggcactgttgcccttttccaggcctacctgagagcagggcacaaggggcttctggcctgagtactggcgccaatgccacctctccagtgatggctctcccacctcagaaaccaggaactcgcccagggtatgggcgtgggacaaattatttcccctgggtcctaaagggaggtgtgttcagaaagtgcccggagagccgtccaggggccccaggctggccatcgggagagtcaggcttcccctcggagaggcaaggctgcacctctcaggctaggagggctgaccactggaccataggaatggggaaggcaggatttctaacgagacggtaggggcgctgagcccttagccctgggggaagggtgacttgaacccaggacaggaaaacggagcagcaacccactgaccctgctcggactttgcccctccatcctgaccctgggcggccctttaagcagatgcgctccagtttttctccagagcctctactgcttgaatgacggactcgaagctacttccggccatttctcacgcccagtcagagtccaggaattcttaggttccctcttctcaccattgtcctcccacgtgactgacgtcacttctggcgggagagagggtggaggcgtcttcgctcgcttatcgcatacttccgcccgctcttccagttagttccctaacccgagtgaagccacttccgggcttcccgggcgccttccgcagtcctcttccgggtgatggcggccgggtgccccggatgtagccctggcgcaagcatctcttcttttttccacctcgccttccgcggattcccaggtgagtgcgcgagggtgggaccgcccgaatccccgtggccctctaagttgtacacagcccgggacagttggggctcaccacacggaattgggagttcggagcagggaggaacggggtggcgagagcgccaggtcctgggtctgcccgggcccggcgagctccgagagagccagggtagagagcgggggtcagcccgtggagccggtggcgcgcagactgcgggggctggagttgggggcggtcacgtggtgaagcctgtctcctttcagccagggtcgggggatccagagggtccgctcctccgtccccgccccgtttaactcgcggatgctagacccaagtcctggaggcctcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatcctttcctcagcttgagaaacacctctttgccccgtcatgccaaagaggaaagtgaccttccaaggcgtgggagatgaggaggatgaggatgaaatcattgtccccaagaagaaggtgagggggccagactgctttgtgtgggggaaagaggagctagaagcctgaagaggaagaaagctggcgggagaggggcggggcgggcaggcagagaaaagcctagttttttcaggttctctgaggaatgggttgggagcgtctttagtgtggctcctgaaatatttggggaagtagtcgagatcctgaaatatttggggaatatttgggtccagatccggaagtatttggggaggtagccagtaacctgcatttctcaactttctggctcctgctcacagctggtggaccctgtggctgggtcagggggtcctgggagccgctttaaaggcaaacactctttggatagcgatgaggaggaggatgatgatgatggggggtccagcaaatatgacatcttggcctcagaggatgtagaaggtaagctgtacccaagaatacactctgctggaaaaacaagtaggggcctctggtggtgtggagcgagggaggctccggtctcttttttccatgcctggaaaagggcacctgtgtctttggtgcaggtcaggaggcagccacactccccagcgaggggggtgttcggatcacaccctttaacctgcaggaggagatggaggaaggccactttgatgccgatggcaactacttcctgaaccgggatgctcagatccgagacagctggctggacaacattgactgggtgcggcccaggggctggcgtggctggggcctgggagtggcagatgctgggcctgctcccgtggcagttggtgggaaatcactccatcttcccattacaggtgaagatccgggagcggccacctggccagcgccaggcctcagactcggaggaggaggacagcttgggccagacctcaatgagtgcccaagccctcttggagggacttttggagctcctattgcctagagagacagtggctggggcactgaggcgtctgggggcccgaggaggaggcaaagggagaaaggggcctgggcaacccagttcccctcagcgcctggaccggctctccgggttggccgaccagatggtggcccggggcaaccttggtgtgtaccaggaaacaagggaacggttggctatgcgtctgaagggtttggggtgtcagaccctaggaccccacaatcccacacccccaccctccctggacatgttcgctgaggagttggcggaggaggaactggagaccccaacccctacccagagaggaggtgagcttggaggacagaggagggggcagtgggtaggaagtgagacactggaggccaaatggctttgcctgttattttagaagcagagtcgcggggagatggtctggtggatgtgatgtgggaatataagtgggagaacacgggggatgccgagctgtatgggcccttcaccagcgcccagatgcaggtgagctgctttctccctcctcctgccttgtccctgcttcccccactcctgtcagttgttccccagctctgccctctccttgcagacctgggtgagtgaaggctacttcccggacggtgtttattgccggaagctggacccccctggtggtcagttctacaactccaaacgcattgactttgacctctacacctgagcctgctgggggcccagtttggtgggcccttctttcctggactttgtggaggaggcaccaagtgtctcaggcagcgaggaaattggaggccatttttcagtcaatttccctttcccaataaaagcctttagttgtgtactggggccttggctgtgctgatggccagaagccaggggccttctccacagtccctttggacttgtcttggtccctgagtactcccatgaagatcctccttggaggtgcctgtcaggtatcctgtggcctccctgcctggactctgcttgccgtgtaaacacccccaactgcgctgctctgtgctcctctcccaggtttcttgttcgattcctcttaggtctttggctttcaggacctcagattctttatccttgtagccaccagaggacagagccccagaagtggatgttttaggcccagaaggaccagggcatcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcaggggtaagataccttcctttaaacgtcactaagaaagaagaggcctgccggtgacacagtaagatgccattgatctaaagatgcgtcttgatttcagaaaggtccggaagtggaaagcaggtttcagggctgctgaggtacagggttctcctgtaggccccagggatggtctcaggggtgctgagtgcgtgcgtggtaaatggatggagcccaggggcgcctcctgccagtgtcctccaggcactcaaacctagcccttctgaagccgacctcacgtgacctcacagcccctcctgaaggcgcctcactgatgacggtgggtggaataacagcccccagagatgtccaggtttggaaccccaggacgtgggaaagtgttaccttgcgtggcaaaagggacccggcgcctgtgcttcagttcaggatttcgtggtggggagatgaccgtggatggttgaggtgggccctgagtaatcatgggggcccttataagggaaggggagtcacgagggtctgcgcatgaagcaaggaagcttctggctgtgaagatggcaagaaggcctggggccaggcgatgaggtggcccctggaggagctggaaaaggcattggattctgccccagagcctccgtggagaaacaaagccgcactgacaagacttcagcctggtgaaaaccattttggactcctgacctctagaactgtaagataataaattggtgtggttttcaacctctcagtttgtggtaatttgttaacagccccaataggaaacaactactcatgcatccaggggacacctcatgaaccacccgatctcactaagttctcccttcctgtgaccacattgctatttcaggtccctgtcagcacttataaatgtggctgcctcttgctagggtggcctttatagcacatctgaaacagcactccttggctttttgtttgttttgtttttagagacagggtgttactgtcacccagtaggggtgacaacatctctctacactggagtacagtggtgtgatcatagctcaatgcagccttgaactcctgggttcaagtgatcctcccacctcagcctcctaagtagctgggtctacaggagtgcaccacttcacctggctaattaagaaacttttttttgtagtggcagggtcttgctatgttgcccaggctagtctcaaactcctgcactcaaccgatcctcccagatcagcctcccaaagtgctggggttacaggtgtgggctactgtgcccagtgtgcttttcttttttagttgtgtgtgtgtatatatgcagtttatatgtatacagtttgtaagagatacatatagatagatagatagatataaactttttgtttgagtaagtttttttttttttttttttgagatggagtttcgctcttgttgccgggctggagtgcaaatggcacgatctcagctcactgcaacctctgcctcctgggttcaagggattgtcatgcctcagtctcccgagtagctggggctacaggcacctgccaccacgcttcagtacccttcagtggttttttgtatattcacagggttgtgcaaccatcaccacagtctaattttaaaacctttttttcctaccatgaaagaaacctgacccatgagtagccccttctcactactccccacctttcctcaccccccagccctggcaaccacccatctacttcctgcctctagatttgcttcttctgggcattgaagataaatggaatcatatatgtggtcttctgggtctggcttctacttggccctatgctttcaagttcagccatgtggatatcttcatctatgtttattgtttttttttttttgagacggagtcttgctctgtcacccaggctggagtgcagtggcacgatcttggctcactgcaacctctgcttgctgggttcaagcgattctgcttcagcctcccaagtagctgggattacaggcctgtgctaccacacctagctagtttttgtatttttagtagagactaggtctcaccatgttggccaggctggtctcaaacccctgacctcaggtgatccgctccccttggcttcccaaagtgctgtgattacaggcgtgaaccaccgtgcccagtccttttgtttattgttgaataacagtgtattgtgtggatgtacggtacattaatactaattcaacttcaccctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17489 - DNA, 54711 bp, Human
tctctgggatattcaggtagagctgcctaataaccagttgaatgcatgggtcaggagaaatatctggttttgaggtatcaatttgggagtcatcagcaaagatatgatcattgaagccaggggagcaaatgagataaagaaaagagcggcctgtaatccgaggcttctctttcctcaagtggatcacttgaggtcagtagttggagacctgcctggccaatatggcaaaaccccgtctctactaaaaatacaaaaattattcgggcttggtggtgcatgcctgtaatgccagctacttgggaggctgaggcagaagaatagcttgaacccggtaggcggaagttgcagtgagcctagatcgcgccactgcactccagcctaggcgacagagcaagactctgtctcagaaagaaagaaagaaaaaaaaatcacatgtagagagaggacaagagcgctcaggccaaagccctgaagagcaccagcataaagcgttggacaaagaggagcctggaaagtaaaaaaagaattactaaggaagtagaagaaaaacaaggaaagtgcagtgtcatggaagtggtttaaggaggagggagtggtcaacagtgccaaatgctatcaagaaaccaagtaggataacctctgaaaagattctatgggggctgggcgcggtggctgacgcctgtaatcccagcactttgggagacagaggccggcgaattacaaggttagaagttcgagacaagcctggccagtatggtgaaaccccgtctctactaaaaatacaaaaaaatagctgggcgtagctactcgggaggctgaggcagaagaatcgcttgaacccaggaggcggagattgtagtgagccgagatcgtgccgctgcattccagcctgggcgacagagtgagactcttgtctcaaaaaaaaaaaaaaagaaaagattctatgggatttagtgagatgtttcatggcagaccctgatgagagagagcagtttcaagcaagtagtggaggcagattggagtgggttgaaagataagtgggaggtgggaaaatgaagacagttgggtgtaggcaactcttttgagaagtttgtagaagagaagagaaggaggtggttggagaggcagaattcttggtaattgtttatttgtttttagatggaagaggtctatgtttagatgctgttgggaaggagcaaggacaaattcctaggcttcgtagcaaaaagtcaagagcttcctctacggtggctctgtttactctctgcagcaggtcaggttatttgctgagggttacagggcagatggagcacttggggtttgaggggaaaggagaaggtttgaaatggtcactgtggagaacagagggagagctgactagtagggttgtgggtcaaaactgagggcctggtagaagctgggaaccatgggtttatagtggcacaaatctgtgaagttgaatagttttccccagcaatgtttagctgcctgggcgcaggcatggaaaaggcggacagttggaccgattcaagactgggatgttgccaggcggatgcgacaaatcagggaactgagggtatttaagaaagtgactaagtaagggaccaagatatctggtctgagcaaagtgaaggagaatcagagacaggtcctctatgagccaagccctaggaacactcaggaacatgaagaaagggttttggaaaagagagtgaacggcaagcagaggggggaagacctgagatgggatggaagggcagatatggggggagggggttgagcccggagacttgcctgtggggaaagcaggctgagggggaattttttaaggggcaggagggccttgagagcggtagcagcgagaagtgaggcggccccgagcgagggggcgtggtcaggcgcaaatcccgggcgagggggcggggccccggtaactgggtcccagtgccgctgtggctgcggctgcctctgcgaggctcccgcctccccaccccccttcccagggctccttcccgcccgccgccgccgagacccaggctgaagctggggaggacggtggagcccggcccaggccgttctcctgcccccgcggctggagcatcgtctgggactactggctgaaggcgagccccgcagcccaagcgcagcgcacacgcgcgcccccggccaccgccgttctctcttccctcccctcctctcccctcccctctcctccgcccccggcctcggctgcggcgggaggaagaacgcttcccaaccagccaggagagcccagatctattcccattcggggagaaagaagagaccccgcacttggatccgaccgacttctcgccccggggccacggaagtggctcgccgtccaccggagagtccccgccgagcgtagccctccaaccctcgcccaaccgcagccgcatagacagcgctccccagcgggcccccggccccgccgagcccactccccgcgcggggccggggccggggccggcgatgcctggcacggcagcggcggtggccgcggctgctgctgctgctactgccaccgctgccacggctgctggcccgggcccgggctgggggcttgagtctctgcagtggggctgagcccgcagtcccgccccccgatcctgaggccgctgctccgccgggcgccgggcctcctccgcccgcgcctccgccccaggagctggagccaagcggggagctcgggccccgcgcccaggcccggaccatgcatggccaccgagccccggggggcgccgggccttcggagcccgaacacccggccacgaacccgccgggcgccgctccgccggcctgtgccgactcggaccctggagcctcggaacccggactgctggcgcgcaggggctcaggttcggctcttggcggcccactggatccccagtttgtcggaccctcggacaccagcctgggcgctgctccaggccaccgggtcttgccctgcggtcccagtccacagcaccaccgggccctgcgcttctcttaccacctggagggctcgcagcctcggcctggtgagtgagcgactgagagagcatgggagcccgggccacgggcctggtactgggagcgggttcttgttctcgagccctctaagccccacctcggaacaggctcgcttacctcggccctttgggttccctcaaacccctcctcctccccacgtcccttggccttatgtccagtcctttcaacctctgtccccatctcctctctctgtcccttgtgcccctcaacctctccaacccccttctcctctgtctgctgaggctaatgggagagggagcactcgcgagaaaaagagggaggattgcaaggcagcaatccttggatatttggttggggaaaccagggtttcgtttggagaacagaagaaaaaaaggagccttacatttgccaagcgcctacattgtaccaggcactggactgggtgctttacatggattttcatttcagcttcaggaaccctcatgaagtagataccattagtcccattttgtagggaaggaaactgaagctcagagaagttaagcaacttgcccaaggtcacacagctagtatggagccacgattcaaaccagatctgtttgtgtccaaagtctgtggtctttctgcttccccaaactgaggctggagaccatgaaagtaatgccaagccttctgcttatgtgattttctcctgtactattcagcagccctggagtatgagcggaaaaaaaaaagaaaaaaaaaaaaagaaagacggtggattgatccaaggttgagattttgccaggtgtgtgtggcgggagaacaagggaaggaaggagtagaaggtgctgagagagaaatggtggaagaggtgggccttgggagtcaggctagaggagaaggctggaggggctgataggtagggagacagcagaaaagccaacagaggcagaagccagttgtagcaggagctggagagctgcaggtccacgaggttggttgtgatgtgaaatcaggatggtttcttggatttgaaaaggtggagcagctttaagtcaggctgaggccacagaccactgcctttgtgctacacagacctgagtgtctgaggagcacagcaggaccttccccatctggggacattctcatacgggcctgagcccaggagccacagaagaagagcagcgcacatctgccctgccttccactgggactgaaggagttgttaagcccttgggggctcccgggttcacacctcaggctccacagatctctgggaccgtggccttgcaccaggtagcagtagtgaagtataaagcatgggtaggatgtgccttttggtgccttcatgaccttgggctagtcatggaacctctgggagatttcagggggctccctcagtgtgggctgaagataaccagctggcaacaggcccttaacaccttggcctgcatgttacttctgctggctttccaaactccccttgacactgtgtaaagccagtgcctttttgcagctgccaaaacaggccacaagcactcccaccccaggacttttgcattggcttttccttctggctggaagctcttcccctagccctccacctggcttgctcctcgtcttgcatgtctcaggtcaaatgtcacctcttccaagagactgtccctaaccactttaggtagggccacttgtgagtctccatcagagactgtgagtgtgcttccatctttgcacttagtacaatctgaaattatcttattgtatgtgtctactcgtttattgcctatcttcctctactagaatgtgagctccatgggggcaaggcgattatatctcttttgctcactgttgtatccccagcaactagcgcagtgcctaacacgcagtaggtgttcaagaaatcctcattaaataaatgcctaaacagatactaaagaagcacatagtaggccctcagtaactattgcctaaaagaaggacaccaaattcctgccctctggatactcttgatctgaaagtcagtagctgggcaatgtctagacccccagtctctggcctctgtaatcaatacaaggtgatgattctgagtatgccttcccaatccaccaattcattcaaattacaaatcataatacccttcctaaaccactctcctcctccccaaaaaggcaacacagagttcccaggatccttttccccaacgaagtccttgcctctgtaattgcatagtgggtgtcttttttttttttttttttgattcaagatggggattaggaataagacaagtgtcagggaaggacctggcctcctattctaactaattcactttgtgaccctgggtgagtgacttttcttctctgaacctcagtttcttcatctagagaatgcaatgaggagtctatgaattaatggttgtaaagcctgcagcatggtataaatcctcagcaaccaggagtttaaaaaaataaaattaagttaaaaaataagagaaaaaccttctgaagaagaggcggaggaattactcaggccctgactaggcgggcgccgggccatgtgattcactgcagcatgggttgtgagaggccacctcccccactgcccagccggcccaggggtaggcacaagtgacttggcttctctctccatgggactcgcctataattggccctaagagggcagggttagtggttgtagggtgtgtgtgtaagagagagacagagagggtttcctgagcttcaattaaagggctgaaacatgctggtccacatgttaagatttctgtgtgcctgctgacttcctccctaacactgctgagacctttattgaatcaccatctttagggctcagtggctcatcctgggggtggggggaggcttttaaaaataataattgtatcttagccatgtgaacagccttgaattgcttcaaagtgctttctcttttagtgatcctgtctgcttcctggtggggaaaggtacagttgttattatgcccattttccaggttgattaaaccgaagtccttgttggatcactgggaaaacccagtgaaatgccagagaggggtttgagagagtcagaaagcggtttgcttgcaggggtttgcagagatggttgctctattcctcagggttgaggcctagaatgtcctttcagatgcagggattgtggggatattggtgtctgaccctagctaagtcaaaggagttgcacctgatgttagagccgttttgtgggtaatgggggaaactgagccagttgaggggggcaaggggaggggctgactctttctcatttggatcctgaggcatcttcagagtctccaagagtaagaattggagctagaaaagactctagatactgcctcgttctgagtttccctaactgagtgagcatcagaatctcttgttgaccttaaaaaaaaatgtgattccacactccacctcagagtgccagaatcttggggttgacaaccaaggaacctattttcaaaagctccttaggtgattgtgatgcacagcctagagtgggaaccactagttaagtccgttttccagatgggacagtgaggaaggctcagagaggtagtgatttttttagccatcatcctacagtgagtcagcatcattagggccaggagaatacatcggcctccccatctaaggccctttccccagggccccatgtgggcttctgtcaactcactcccaaccgcaaatggaggcatgggattaaacacaaagggagagtcaacctcctgccctcatacacacaaacactggctgcctcagtttacccttattctcagctctcgtgaatggctaccatttggcagttcaaattggaaggcagttgccattctgggactctaggcagaggaaaccctggcatcatcagtgcccagtgcaggatctggccctaaggaagggttctagaggggtgtcaataaagggttgtagagctagagaagaacatggaggacaattcaggtaagaggttcagtggaagcaaaggcagcgagacatggggcactggggaatagggctggtattgggaggagtggagtgacaaggctgacaaggaactttcttctgagggtgaagagaaaccatcgaagggtttattaacgagaatgacatgctcagacggggtgtttggaaactctccctagctgcatggggagaatggatggaaggggtgcaagagtggaagcagggagacaggcaggtgagtgttgcagttttcccagagagaggtgatagcttgagttagagcgatgggaggtaaggagggtaagatctgagagatatttagatgctagcatggacaggccttggtagtagcttggatgtagaggctgagacagaaggcaaagtccagattgctccatgttgttttctgaaaccaactacagtgacctggtggatgttggtggggccatctatatacaagagagggaggaggtttgagggaagatagtgaattatgtttgagacaagttgaattcgaaacgcctgggggtacatgcaggtgaagatggccagcaggcatttgtgggtttggttcatttttgttttttactacccaggatgatcacttttaatattttggtctgttttctgctagatctttttctacatattgacgtatattttacataattgaaatcatactatatgttcaactttatatcatgctttttcatttaatatatgtatttttccaatatcattaaaaactcttcatgaacattttattttttttgaacaacattttaatgactgcataataatatgccattgtatggatttaccataatctttttttaaacttttattttaggttcaggggtacatgtgcaagtttgttatatgggtaaactgcatgtcagggggatttggtatacagattatttcaccacccaggtaataagcatagtacccgataggtagtttttcgatccttaccctcctccctccctccaccctcaaataggctccggtgtctgctttttgtttctttgtgtccatatgtactcaatgtttagctcccatttataagtgagaacatgcagtatttggttttctgttcctgccttagtttgctaaggataatggcctctagctccatccatgtttctgcaaaggacgtgatctcattcttttttatggctgcatagtattccatggtgtatacataacacattttctttgtccagtctactattgatgggcatttgggttaattccatgtcttcgatattgtgaatagcactgtgatgaacatacatatgcatgtgtctttatggtagaacgatttatacttctttgagtgtatacccaataatgagattactgagttgaatggtaattctgcttgagttatttgagaaatcaccaaactgctttccacaatggctgaactaatttatattcccaccagtagtgtataagcatttccttttctctgcaacctggcatgttattttttgactttttagtaatagccattccgactggtgtgaaatggtatctcattgtggttttgatttgcatttctctaatgattagtgatgttgagcattttttctttttttttttctctgtcacccaggctggagtgcagtggctctatctcagttcactgcaacctccgcctcccaggttgaagcaattctcccacctcagcctcccaagtagctgagattacaggtgcttggtggcaccacacccagctgatctttgtatttttagtagagacggggttttgccatgttggccaggctggtctcgaactcctgacctgaggtgatccaaccgcctcggcctcccaaaatgctaggattataggcgtgagccaccacgcctggctgatgttgagcatttttttcatatgcttatcggccacatgtatgtcttcttttgaaaagtgtctgttcaagtcctttgcccactttttaatggggttgtttattgcttgttgatttaagttccttacagattctggatattggacctttgtcagattcatagtttgcaaatattttctcccattctgtaggttgtttactctgttgatagtttcttttgctgtgcagaagttctttcatttaattaggtcccatttgtcaatttttgtttttgttgtaattgcttttagtgccttcattatgaaatctttgccaggtcctatgtccaaaatggtatttcctaggttgtcttccagggtttttatagttttgggttttacatttaagtctttaatccatcttgagttgattttagtatatggtgtaaggaaggggtccagtttcagtcttctgcatgtggctagccagttatctcagcaccatttattgactagggagtcctttccctattgcttcttttgtcaactctgtcagaggttagatggttgtaggtgtgcggccttatttctgggctctctattctgttccattggtctgtgtatctgtttttgtccagtaccatgctgttttggttactgtagccctgtaagtatagtttaaagtcggtagtgtgatgcctctggttttgttttttgttgttgttttgttgttgttgttgagatggagtctcgctctgtcacccaggctggagtgcagtggcgtgatcttggctcactgcaagctccgcctcccgggttcaagcaattctcctgcctcagtctcccaagtagctgggactacaggcacccgccatcacgcctggctaattttttgtatttttagtagagacggggtttcaccgtgttagccagggtggtgttgatctcctgacctcgtgatccacccgcctcggcctcccaaagtgctgggattacaggcgtgagccaccgcacctggccttttttttttttttttttttttttttttttttttgagactgagtctcgctctgtagcccaggctgaagtgcagtggcatgatctcggctcactgcaacctcctcctcccgggtcctggttcaagcaattctcctgcctcagcctctcgagtagctgggattacaggcacacgccactgtgcccagctaatttttgtatttttagtagagatggggtttcgccacgttggccaggctggtcttgaactcctgacctcgtgatctgcccgcctcggcctcccaaagtgctaggattacaggcgtgagccaccgtggtttggtttttttgtttgtttgtttgtttggttggttttttcagacggcgtgtcactctgtcgcccaggctggagtgcagtggcatgatctcggctcactgcaacctctgcctcctgggctcaagtgattctcctgtctcagcctcctgagtagctgggattacaggcgcccgccaccatgcttggctaatttttgtatttttagtagagacatggtttctccatgttggccagactggtctcgaactcctgacctcaggtgatccgcctgcctcggcctcccaaagtgctgggattataagcttgagccaccatgcccagctggctttgttctttttacttaggattgccttggctatttggacacttttggttctatattaatttttaaatagttttttaaaattctgtgaagaatgtcattggtagtttgataggaatagcattgaatctgtaaattgctttgggcagtatggccatttgaacaatattgagtcttcctatccatgagcatggaatgttttcccatttgtttgtgtcatctcgcaagcaggcatttggacgtaagattggaaagttcaggaaagaggcctgggccagtgatgtttgggagttttcaccaccaacacataccatgtatagatctgggagccagtcccatccttgaagacagacagtaaggttggcagggtcacactcagatgaattattcagtacctgctgtaactttgccatagaaatgccttttttcaggggaaagcagtttttaaagtatattttcatgaagctgagacccagccgtttttaaggcatatttgagggctgggcacggtggctcacacctgtaatctcagctgctcaggacgctgaggcacgagaatcacttgaccccgggaggcagaggttgcagtgagccaaaattgcaccactgcactccagcctgggtgacagagcaagactgtggttttgttgttgttgttgttttctttgtttttgctttttgacggagtcttgctctgtcgcccaggctggagtgcagtggcaatctcggctcactgcaacctccacctcccaggtccccgttcaagcaattctcctgcctcagtcttcccagtagctgggattacaggcgcacaccaccatgcccagctaatttttgtattttaagtagggaaagagtttcaccatgttggccaggctggtcttgaactcctgaccttgtgatccgcccgccttggcctcccaaagtgctgagattacaagcatgagccaccatgccaggccaagactgtgtcttaaaaaataaaatcgaccgggcacggtggcacacgccagtaatcccagcactttgggaggccaaggcgggtggatcacttgaggccaggagtttgaaaccagcctggctaacatggcgtaatgttgtctctactaaaaatacagaaatcagccaggcgcagtggctcatgcctgtaatcccagcactttgggaggccaaggtgggtggatcacaaggtcaagagatcgagaccatcctggccaacatggtgaaaacctgtctctactaaaaatacaaaattagctgggcgtggtggcgcatgcctgtagtcccagctactcgggaggctgaggcaggagaatcacttgaacccgggaggtggaggttgctgtgagccaagatcgtgccactgcactccagcctggtgacagagcgagactccgtctctaagaaaaaaaaaatcatccaggtatggtggcacatgcccataatcccagctactcaggaggctgaggcaggagaattgcttgaacccaggaggcagaggttgcagtgagtcgagattgtgccactgcgctccagcctgggtgacagagcgagactctgtctcaaaaaaataaaataaataaaataaagcatatttgccgggcacggtggctcacgcctgtaatcccagcactttgggaggccgaggtgggtggatcacaaggtcaagagattgagaccatcctggccaacatggtgaaaccctgtctctactaaaaatacaaaaattagccaggcgtggtggcgcacgcctgtagtcccagctactcgggagactgaggcaggagaattgcttgaacccaggaggtggaagttgcagtgagccgagatcttgccactgcactccagtctggcaacagagcgagactccatctcaaaaaaaaaaaaagcatatttgaagccagtcatggtgcctcacacctgtaatcctagcactttcggaggctgataggggaggattgcttaagggcaggagttcatgaccagcctgggctacatagtgagaccccgtctctacaaaaaatatttttaaattagcagggcatggtggtgtatgcctgtagtcacagctacttgagaggctgaggtggaaggatcacttgtgtccaggagttcgaggctgcagtgaagtatgattgtgccactgcactccagcctgggtgacaaagtgagactctgtctcaaaaaataataaataaataaacatatttgcatgaagctgagacccatttcacgtacacccagggtagctggctattgcaaagtattgagggaggagtacttctgaaaagcaaatcaaacattggtaaagtaaatttgtgtggttcccagtgttctctctgttgagggcatcctgagaggccagtgagggggtttgcttacggaaaggagaagagagggcttgggacaggaggggatcgtggggtctgctggggagttttggagagaagtagtttgagattccaggggagagtctggggaaagaaccaaatttggttcctagtccactagggccttccaaacaaacacaacaaaatgtaaagactctgggtagctgggaaaaggacttccccagacaagactaaaagaatagaagcttctaaattgcagatggctggcagtccgctcttggccctttcaggcccctctgtccctgggggagggcccaggtggggctgcctgcttcctcaagggagagtggagtggcagctaacaatgccccacacaaacccaagccatggctttctgggggccagttagctaaatgccttaggcagatgtggagctggccagacgctggctgggtggggctaggacctgtctggaatgagggcaggaaatgcagtctgccattggctagcaccacagagttcagttccctcatctggagagagcaaacatctttggagcaatgagtccagcctctctgggctctggtgcccagttccttggacctagaaggtgtgacacctccaaacggtgtctgaaaacacacacagctcctgagacaaggctgcagggcatagccgggggagcctcagcactcctagctctgctattggttcactgttcctccaggcctcccttcccctctcagggtcttagtttccctatttgtaataccacaaacctggtcattgtggcatcaataaataatacttggtgagcaaatagggtacaggggaagggagagtgaaagaggggagcaaggggggcatttctttatttaacatgtacctgttgagtgcctactatgtgctaggccctgtgcttaggtgccaggtaggcaacaagacagtcactatccctgtcctcgtggagctgatatctagcaggaaagacacactacaagcaattccaagtgcagatgctgcaagaacacatgagggtggggggagtgggcggacagggcaaaggagatatttgagttgagacctgaaggataaataggagtccagaggtagggagaggcagactagcagttcgggtcacgggaacaacatgtgccaaagccctaggcggaagagagcactttcgaggaacagacaaacggccattgtggctggatcgtggggcggggaaatgttcctgagctaggccttccttgtccctgtgctcaggagtttcacccctgaaggcaaagggagcccttcacaaggctgaagggattgcaggggactgtgttttccaaaagctggcagtggtgtagagaatgcctcgtagaggcccggaagatgggagtgaaatcagttagggggctggagggggaatgaagcatagggattctagagcaactgaccatggtgcatctaaaggacttggggcctggctggacatgtgggttgagggagaggaataaacctaggacttgggcttgggcagctgggcggatggagttgtccttcctgcgatggggaaggcaggaggagaagcagaccggggctggggtaggagtgtcgttcacgatgtgctgaggctgaggagcctgaagacaggacatctaggtgacagcacccagttggcatcagatatgcctatctgggtcccagagtaagggcaggtgggtgaggggcacaggtatgtagctgagactaagagggaagagccctccttggcgcttccccatggcccctgcagggaaagggttaaatcgcggagggaaggcgcctgtggaaagcgggaaaggcgggactggcagggctggcctttgggagctgcagctggcatagaagcccttccgcccgccagggcctgctaggcctgggccgccaccgcccacaccaccgcctttgccttcgcctttgcctttgccttccctgctccccctccagccccttccctgctcccctaggctgggggacccccctacctaatgcattccaggtgtagacgcagcccctcccccaccgcgcgggtgtgggaggggcagggaaggctggggtcactttcaccgcatctcttagggagcatctcccaggcttgctgactgcttctctctctctggagaattccctcagggatctctgtttgggcctccctgactctggcaggggctggcagcagagagagccccccagacccaggtccgccactttctaaagtgtcacgtgaccttgggcaagtcatctcacccctctgagcctcggttttctcatctggaaaatggggctgtcattcccaccttctagggttgttgtaaggattcaatgccacagatccatccccagcccttggcatggcacattgtcaccatgttcaacagatggccctggcctgccctttttgttcctgcccctctgcctgggtctgtatccctcgctgactaccatgccctgtgtggacctttctgtctctgtctcccttctgacttgtcccttccttttgtccatctccctctatgtccatctctgggtctctgtggttttcctgtcctctccctccttgtgtttgtcccagtgtctttctcttatcatctgtcttttcccctcataatccttctgtgtctccaactctcagatttggccaggcctctggtgaatgggaagggagatgggtgggtgttggggtccctggggttgaggcaagggtcagagggaccatccccctagcggctttgcctcacaggaaggggaatctcagccagcgtggcagccccagcatctggtaattactgctcccagtgctcccagctgcagttccactcccttcccttcctgtcctctgaagtccccagctcctcccggggcgggggagggagatgggcgggggtggagctaccgccccctatcctctggcctctagtccagagaagcagggaggaggtggccaggccctcacagtaatcaaggaactggaagagggatgggctgcttgtgctctcatgtggctgcttggtttgtctgtgtgtgtgtgtgtgtgtgtgtgtgtgtgtgcgcgcgtgtgcgcgcgcatgtgcctggccttctttgtccccgtggatctattttgtgtgtgtgtcttaatgttcttgtttctgtatggccatctgtatgtttgcatatagatccatgtgtgtctctgggtctgtatgtgttacgtgctcctctgtgcctggttgtatgtcaccttggccctaagtatgtgggagtttctagatgtttctgcgcatgggtctccttagatcttgtggatgtgtctgtctgtttctatacctgtgtctgttcccgtgcctgcgtctgcctctgcatgccccctataggtctatggttgtggtgtagggaagggggtgtctgcttgcttgtatcttttggcctttcctgatccttcttcctgctgtggagccttcttgcaaacccatgacattacgtacttcaaatatatgcttcactcatacctccccacccaatatccacacttttgcccactcttcttcccttgtctgcagaaccattctcagtccatctatacctaaaaaaaacacaccccatcctggatggtgcaactaaaaaccacctcctttaggaagtcttctctcctcccccctccaaatgtgatttctttcccaactcagcagtcactgaaggtgtgctctgtgactctggacacagacacacctgggatctggtcccagctcaaccacttttagctgtcctcaggcaaattattttgcctctttgtgcatcagtttcctcatctgtaaaatgggtaatagctcaccggatcattaggaggatgccatacgagatagcatcaacacaacacctggcccagagtgggtgttcagcagttgaatcctcatatcttatatcctctactaaaaagtgaacagcttgagttccagagatttctgcatattcttacaatctcctgctctctcttctttaggcatcctgcacagggcagaaggtaaatcgggtcacacagaacaaaaggcagattccaattcagggaacttctgacaagtaatgcatgggccagctccctgagcctgctcagacacagaggaaactgggcccttccagggagtgggagataggacctgcaaggcttctactcaagggcaagagcatgtgagatagggcaaggcataaacagcaggagtagaatgagccttcaggatcatctaactcagatagtgcaacatgatggcccacaagttgaatttgactcacaagtttcatttggcttgcccacagtttttaaaattaagggacttcacatgaaaaacctggatttcccggccgggcacagtggctcatgcctgtaatcccagcattttgggaggccgaggcgggtgaatcacctgaggtcaggagttcaagaccagcctggccaacgtggtgaaacctcgtttctactaaaaatccaaaaattaggcagatgtagtggcgtgtgcctgtaatcccagctactcgggaggctgaggctggagaatcgcttgaactcgggagacagaggtagcactgagctgagattgcgccactgcactccagcctgggcgacagagtaacactctgtctaaaaaaaaaaaaagaagaaaaatctggatttctggattcccttgaaatattggaagacctgacaatacagcgccacattactgcaagatgacacctgggtggaggggagaagctgctgcttctacttcaggttaggcatgtgctttccagtttaacccagtccccaccattccccatggccttagactgtcccactctacagaaagttcctcactttatactagggtctgcactttacagaaacatccttctctttacagaaggggcctcactttacaaaaaggagttctcctttttaacagtcttctgttttgtcatgatccttaagagtcctttggttacaaacaggccatccattttacaaaagggcctttagagaactctcctcactttacagcatgtccctccactttgaagaaggctcctctttttggaaaaacttcttccctttacagaagggccttctgtttatcaaagagatctccatttcacagaaagtgtctccgttttgaaggatggaacactcttcaggaaactcgaaagagttaggaagctcctgacttgccagaatggcccccacttcttgaaagtgtcttcacactatagaaagtgcctccatttttctgcagagtccttatgttgagaagaatagtcgacttcagggaaggaacccctgagctacccacagggttcctgtaaacagctccttctgcacatttcacacttgaccgagctttgtgtttgaactttgagagacaacatctgccaggtcaggcagcctgggtgcagtctggccttgaaggcggagtggggcagctggcctgcagttcacattcaaggggcaggtgggaagaggtggggcagttatggctttttttttttttttttttgtcaagcggagggatgccccttcccctgacagaactggcttcccaaaaggcactttcctttctgctgttcttctccactccctctgctccctttccccaccccacccccaggaattccagctgtcccaggagcctacctctctgcccggaaaggaaaagatttgagggctgtagggagaagtttgcctgggctgtcaggagacctgcgtgctaggggctggcttctgctcaccctaggatctcgctgattgctcacaacaagcagaacacacgttttctccccattttagcatctctgcagagctatccttcatagctgtgggccccaaatggggaaattggggcccagagctttgaagccacttgccccaggacaccagggagttaatggccaagggccagtctggggccctagtagctgtcttgagattaagccaaggctacagctgggagaagtgagaggggctgctactagctgggagggggaaaacttggcagctgagattcccaggaagggttgagggagatgcagggtccagttccagtgggaatgggcaaaaggagcccttgtcctcagacacagctagatgctggactttctctgccagtaaacccagaagcatgtgctcagggcacctgccacgcaggggcatgcagcaaccagaaacaatttttgcaaggattttcctatttcaataataataaattgtcatgggaaaattcaaacctcagctacacttcttgacacttattttacagtttttttctggtttgtattttgaattgaatttgaatggggaggacagggcaccattgtcttcactgccctaccacctcgcataggaatcctgccctgatctgcagagctatcctggtgagtggggctaggttctgtgtctctcactggctgagtttgcttgtgtttctcagtgtatatacagttttacgttgggttgcagcctacagcccgtgggcttatgtatttatgtgtgtagttttgtggctttgtggatgtgtgattctgttggttttcaaatttaacccatatcactctgtgtgtgtggtggggtgggggtgggtcactgtgctctttcccttccttgtcccataggctcccccaaaccaaggaactgctattattgtccttctttccagataaagaaactgaggctcaggtagatggggagacttgcccagggccacacagctagtaaaaggtagtgttgtgatctaaactgaggtctgtgcaagtcctaagccagctgttcctaatacaggtgctgcagcagttcaatccgtgcagttcagtcagtgatcatgatgacaccacccttgttgggaatagtcaagtatcatagttttataaattagtgacttaagaaaaaaaaaaagaccagattcaaggccatccctgaaataatggcactgtcgtgagcattcagatgcccatggcagaaaaaattgggtagagtccctagcctgcttgaggcttaagtggacaagagtctgggggaactctggctaccaggtgctgtcttgaaggcccggctctgccacattcatttggaagctttccctgactagcgttgccagaattagccttcagaaagtatttaatacaattagatttgaatttcagatatacaataagtcattttgtttttagacggggtatcactctgtcgcccaggctggggtgcagtggcatgatttcggcccactgcagcctccgcctcccgggttcaagccattctcctgcctcagcctcccgagtagctgagattacaggcgcctgccaccatgcccagctaatttttgtatttttagtagagacggtgtttcgccatgttggtcaggctggtctcgaactcctgacctcatgatctacccacctcggcctcctaaagtgctgggattacaggcatgagccactgcgcctggcccaacaagtcattttttaagtatagcttaagaaattgttagtataagtattcatgagacatattatactaaaacattccttgtttatctaaaattcaaatttaactgagtggccgggcatggtggcttacgcctgtaatcacagcaccttgggaggctgaggcaggtggatcacctgaggtcgggagatcgagaccagcctggctaacatggtgaaaccccatctctacaaaaatacaaaaattagctgggcttggtggcaggcacctgtaatctcagctattcgggaagctgaggcaggagaattgcttgaacccaggagtcggaggttgcagtgagctgagatcgcaccattgtactccagcctaggtaacaagagcgaaagtccatctcaaaaaaaaaaaaattaactgagtgtcctgtattttatctggccaccctatccattctcctccactgagcttccccagtccccacaggctcgccctcgttgcctttcctgagttagagtctttgtctttgagattgggagctccctgagggtaagggtcaagattgcccttctggcctgctgaatgcctgggggggcaggggtttgagagtggggcaggaagggtgcataccccacccccatccccacagcagagctggcacagtgcactggcactcctggggtgcctagagtatgctttcctaggtgacaagagatgtccgagtggcagtggtggttgtgtgtgtgcagttgtgccgagcacggtgcacacagacatgagtagctctgtggttctctctctgggtctttgagggatgtgcacagttggtgtgtggctgggtacatttccacaaagtgttatcagatttggtggtggctgggtgtggtggtacacacctgtagtcccagctacttgggaggctgagacaggaggattgcttgagcccaggaattcgacaccagcctgggcaaaatagtaaggcctcacctcaaaaataaaaaataagaaagatttggtggtgtgaccaaatgtgtgtgacgggggctttttggtgatctctgctctactgggcattggggaattataaatccgttgatggaaggggcagtgctggtggaggatcttgtcaggtgtggaggtgtgggtgtgggtgtgataatgttgtggattatcaaccacaagaaaaatgggctggaattgggcacactggctcatgcctgtaatctcagcacttttggaggcagaggcaggaggatctcttgaagccaggagtttgacaccagcctgggcaacaaagaaggaccccatctctacaaaaaaaattaaaaatagccagccatggtagtgagtacctgtagtcccagctacttgggaggctgagatgggaggatcacttgagcccaggaatttgaggttacagtgacctgatcacactactgtacttaaccctaagcaacagagcaataccctgtcttaaaaaaaaaaaaaagggctggagaaaatgaatccaggaccttgctgggtagggacgggatggggcagtgggaatggctgtggtttctaggaaggaggaggggggcctaccctgggagctccccaagggcagggatgggattttctcatctccaagcacagggtctactaggttcaaaaatattctggagaccaaactcagccaaggaaagccatagagttcagcatggtcatgaggggccactgagagctagctgagaagtttctttttttggtgtttttgtttgtttgtttgtttgtttgtttttgagacagagtttcgctcttgttgcccaggctggagtgcaatggtgcgatctcagcttaccacaacctccgtctcctgggttcaagcgattctcctgcctcagcctcccggtagctggtattacaggcatgcgccaccacgcccagctaattttgtatttttagtagagatcgggtttctccatgttggtcaggctggtctcgaactcccaacctcaggtgatccacccacctcagcctcccaaagtattggaataaaggcgtgagccaccgcgcccggcctagctgagaagtttctattttcccatggacagtagggagttacagaaggttcttgtgcaggtaagtggcatgatctgagctggactgtacgtaagttcattcagccacctggagggagcaagacttggagccaaggaggccactgagggaaaataggagacagggaaatgtaggcagagagacaagggagagggagttctgaaacgagagggagggatcttgaaccttctcccgctcagtgaaacctagcctggttcttggccaggcctaggctcctaaactggacccctgttcaactccctgtggacagggttgaggggtgtccctctgactagctacactgcagtttgtgactttcggaagccgttgggtccacccgcccctcctggttcccctcttttccagcttgcccttggagagcagggttaataagaaaggaatccagtccatgaccagtctgcccaaaagtgtgccattcattgatttgctctgtgaccttgggcaagtcactgcctctctctctgactccatctcctcactagaaactgggctgacaatctcttttcctctcacctgggactccagggaatctttgcatttcattcagcctcctcttcctgcagggctgcctgcaaggaggcagagagaatggagaggcaggtctgtctgtgggctgtcaggtgagatgggtgaggagggagcaatgggtgggctagggcagggccatggaaagtgggatgtatggtcactccatcccgaggaccagcactggaggagaaggagagcagcattatccagggaccctgctgctttgctacagatagggtagggagggcttgcccagagaggcctgcctgctttgaggtgtggagataggtgggctcctccaggcccaaggaggcagacaaggggcaccagggaccctggcacctatgtgtgtatatctgaggaggggtctctgcatggcagggtgcctggctttactcactgcctctctggccctgtcagctcctctctgtctctctcccttgctctggccatgtgtctctccaaccacatctccgcctgtgccaccctccaggtgattcatcttcctcacccccacgcccagggggagggcagggcaagaccaggccaggatgtgctgagcagggcagggtaagcggcacagctgagtggagaggagcgcctcctccatcctggccaggccctgccagcttaggtggggaaggaagtgaggaacgacacccaaagcaaggtacagagttggggaggggcgctcggcctggggcctggggcaccctgttccctcagtgctgggaaaggaccctgatctgagtcccctggggtggacctggctgggatgtagccaggggtgaggtcaggggcctagggaagctgctggaaccctgtgggttgggctatttcttccctccgggactgggagacctaaaatcccctgtgactctttctgcctgtgtgaccctggaagggaggctgcagaggtctttgtgtgtgtatgttttcacagcagagtttgtatgtgactatttaggaggaggcaagtgtcccacagtgtgtgtattcctgggcctatggctaagacccagggacaccgtggatgtgtttgttagatgagtatgacatagtaaatgacagttgtcccttggtctccatggggaattggttccaggacagcctgaagataccaaagtcgccaacactcaagtcccttatataaaatggcatgttgtttgcatataaactatgtgtatcttcctgtatatatatatatatattttttttgagatggagtctctgtcgcccaggctggagtgcagtggcatgatcttggctcaccgcaacctccacctccctggttctagcgattctcctgcctcagcctcccgagtagctgggattacaggcatccaccaccacacccagctaatttttgtatttttgtagagacagagttttgccatgttggtcaggctggtctcgaactactgacctcaagtgaaccgcccgccttggcctcccaaagtgctgggatcacaggcgtcagccaccgcacctgacccttcctgtatactttaaatcatcgccagattacttataatacctaatacaatgtaaatgctatgtaaatagttgttatactgtactgggttttatttatataatttttattgttgtattgttattttttgtctttttttccaaacatttcgatcaatcagcctccatgcagaggccgaggatgcaaaacccatgaatgtggagggccacctgtatgccacatgtctgtgattgtgagttcgtgtttctgagtgtgtggtatcatgtgactttatgctgttttgccactgtatgtgattgtgtctgacatggtataattgactctgtgcctatagtctttgtgtgtaaccatgtttgcaggtgtgacatggtgtgtatgacactccatggccctgcaattgtgagacatagtgtaaatgacaatgtatatcttttgtgactcagtgaaaccatgtttgaagaatgtctaactgggtatatgattgtctgtggttgggcggttgtatgaagctgtgtgtgagatggcagaattgccattgtgtgactctgtgtctttgtgactgcatgaccatgtttgcaggtgtgtgtgatactgcgaggctgtgtgatcgtgtgtgaggttgtggccgcaggtctttgtgactgtgtgtaactaggctttcaggagggcgattacctgcagttgggtgaaatggtgtaaataacaccaagtgtttctatgactgagtgggcccatttgtgactagtcatttatgagactgtgtgtgatataagctaacagaccctttgtggctgtgagtgggaggccatgtggttgtggcacagcataacttacaccatgtgatggtggtacctccgggagctcttgactactgctcactctcttgtcctcacacctgtttgcctccatctctccctatgcaaggggtttttgtggctcccttctgctacaggatgaatgtcagcctagcatccaaggcctttcccactcctctctggccccacctgacttctctatcatttgaggcactcccacagccccctgcccagccaggaccacatgagccccacattcctttccttggggcatgccatccctggggtgggggtccctcactgcctcccagaccaaatcctctctcctaagcatgaccatcatctcctctagagccaaagatagaggtggctttaggggacatacagtgagggaagagggacagtataaaaaggcctcccctttttctgaactggctgcttgatttaaagttattcctgtgacctgaactctggatgttgcacgtgtgtgtgtggcagaggtggaagatgcatgtgggtctgtgtagatgtggaagttgaggaaggtagtacagattgctgagaagttgggattttctttttcatttttcttcttttttttttttttcttgagacagcgtcttgctcttttgtccaggctggagtgcagtggggtgatctcagctccctgcaacctccacctcccaggctcaagtgatcctcccacctcagcctcccaagtatctgggaatacaggtgcacaccacactgcccagctaacttttatattttttgtagagacagggtctcactttgttgcccaaactcatctcaaattcctgagctcaagcaatcctcccttctcagcttcccaaaatgctgggattacaggcatgagccactgtgcccagccagaagttgggatttcaagaagcaaaacttgctcatgaaacacaatttcatcatttttaagcacacttagctgcacaaaattgtaaacaagaaagtctagatattctcagggccttaacaaaagcgttgaagaatggtttatactcagcatacctatgtggctgtagaaacaagggctgcaaacgcatgtataaactttagggtgctcacagccacccccagcctggttaaactccctagtgatactgcctgctgacatacatggaatcaatgcactagtcacaaagaattcttatctattgatgaaaacagccagccccagccctgggtctggctctccatctgagggctaggataggggcttcccagaaaaacactgtggccaggaaaggggctcagagaaacccaataccccagatagctgctaagacatgccagtcctaactttaaccccagtcccctttgggttaaagtcagttacttcacacccattttctcccttcctgcagggctgcaccagggaaaccggatcctggttaaaagtttgtcccttgaccctggccaaagcctagagcctcatccagaaggtccccagcggcttcgctcagacccaggtcccccgactgaaacccctagccagcgtccttcaccactgaagcgggcaccgggcccgaagccacagggtaagtggtcctggaaaagagcagagaagtggcccaggggagggtacagaggaggggagaagttagccagtggcagagaagagggtttgttagaaggatagggagccaccatgctcccagggcagtgctacctacctagtgcacagagtgctgtggcctgaggctaatgtgtgcatactgtgatctcaccttagcccctttgtgtctacctcaggcaaaggtgcagattggtgtttgtggaaggggttgtggcctggccatgacagccagccacctccaaatccagctttttttttttttttttttgagacagaatctcactctgtcaccaggctggagtgcagtgacatgatcttggctcactgcaacctccgcctcctgagttcaagcaattatcctgcctcagcctcccaagtagctgggactacaggcacgtgccaccatgcccagctaatttttgtatttttagtagagatggggtttcaccatgttagccaggctcaaatccagctcactgatgtctcccttctctcttccccattcgtctctccagtgcccccaaagcccagctacctgcagatgccccggatgccccccccactggagcccatcccccctccaccatcacgcccactgcctgccgacccccgagtggccaagggcctggctcccagggcagaggccagccccagttctgcagcagtatcctcactgattgagaagtttgaaaggtgagtctggtccctagggcaccctctaggggaaagggggagcctgggacaggaagggatagtcaggagaggcctctcagtcaagctcataccctgcttccatgtgtgtccaccacccacctcagagagcctgtgattgtcgcctcggatagaccagtccctggccccagcccaggtcccccagagccagtcatgttgccacagccaacctcgcagccaccagtgccccagctccccgagggtgaggcctcccgctgcctgtttctgctggctcctgggccccgggacggtgagaaggtgcccaaccgggacagcggcattgatagcatcagctcgccatccaacagcgaggagacctgcttcgtcagtgatgacgggccccccagccacagcctctgccctgggccccctgccctggctagtgtgcctgttgccttggccgacccccaccggcctggctcccaagaggttgacagtgacctggaggaggaggacgacgaggaggaggaggaagagaaggacagagaaatcccagtgcccctgatggagagacaggagtctgtggaggtactgacctgtgttcaccgagaggcaggtccatgtggagaacctggaagcgccttttgtgcttgattcttcccctagctcagtatttctcgaaataggaccttgtttccaagctctgtgacactgggcaagtcttttccctttctgcttccctaccataagcctcagtttccttatttgtaatacggaaagtctcttacttacatccatagagacttctcaacagctggaggaggggcgcaagagctagagccctgcaggggcccgaggctgtgcagatgaaggctcttggcagcagagacccctttctgtgcccgggcagcctaacatttcttcagaaggcaccatcgcacttgagttagatctcagccggaatacttgctctgctaggaccaagctcaagtgtaggggccaaagccagggactgccggcatggcaggtagtcaacacatatatctaaggaataggaaactaggccaacaggcaatgagttttatacgttcttatacttttgtgcttttctcacaccccaggtactcagcaagcccttgctgatagtgtactgagtgggtgaataaatgattaattaacatttatataccatttaatctgtagtctgatgtgttttatttatattaaattatctaattgtctccattaccaatggacttcagtcctattattattttgttttggttttgtttttgtttctcaccagcctctacattaaatagattctattattatctgtatttatggatgaggcgtcctaaatacagagctgttaaagaacttacacaagctagtgaatggcagagcttaggatttgaacccaggaagtctgacttaccatcccacatgcttaaccactacactctgctgagtgaatagagagagcgggtgaatgagttgttgagtgagggagtgcacgtcatcagaatggaggggtaggctttatggtagactggggactcagggatgaagctgaaggacttacagatctagagatgggggtcaaggttatcctagggtggtattaggcttagagtggcatgggaactgttttaagaattctgggggcttgggtgagggttacgatagaggatgatggatcaggggttactgtttctcctttccagttgactgtgcagcaaaaggtgtttcacattgccaatgagctcctgcaaactgagaaggcctacgtttccaggctccatctcctggatcaggtgagtggccccttgggggtacgagggccccaggaccttgtaggtgcgtttcaaggaggcagtgatagggcctgagttcaatcccaccattgtggccagaatttagaggcagtaaggctcctctctgaccttgaagtcagcttgtccctgaagccatctctgattatgccccaagcttgatcagtgagggctgataccaaccctcactcctaacgctgggcaggtacaccagccctgactgcgactctgacactagtactgacttggacccagatcctgaatttatccctagctgtgaacttcattctaaccctggccctattccagatcccaaatccactagaatccctgagagtagagatttttatctttgttcactgctctatcttaccctctatgacagtgcctcgcacacagcagacattcaaaaatattcattaaatgaacagatctaattccaactttctctctgaccctgaatctaattctaagcctgaccttgatcctgacttctaattgttccaaagcctaactcttggcagcagggacccctttctgtgcccaagcagcctaacatttcttcagaaggcaccctcgcacttgagttagatctcagccagaatacttgctctgccgggaccaagctcaagtgtgggggccaaagccagggactgctggaataacctgaaatccatctccccaatatataaccctaaccccattccctgtctcctcagtctcaagaccaatgctgatcccaaagctccacaagcctccccacaaatactgccctcacccttcaccagccaagccccaggcccagctgggctgagtgcttctgccctgccccacaggtgttctgtgcccggctgctggaagaagctcggaaccgcagttccttcccggccgacgttgtccacggcatcttctctaacatctgctccatctattgcttccaccagcagttcctgctgcctgagctagagaagcgcatggaggaatggtgaggggccctagacctagactgcccactcccctgtccacctgcctgccgagcccagacccagaggtgtacacaagacttcatttctgcttgctcttcctcttagtgacttttgaaaaaggaatcagagccgggcacggtggctcacacctgtaatcccagcactttgggaagctgaggcaggtgaatcacctgaggtcaggagttcgagaacagcctggccaacatggcgaaaccctgcctctactaaaaacattaaaaattatcctggcgtgatggcacgcgcctgtagtcccagctactcgggaggctgaggcacaagaatcgcttgaacccaggaggcggaggtgtggtgacccgaaattgcaccattgcactccagcccaggtgatagagctagactctgtcttaaaaaaaaaaaaaaagaaaaagaaaaaagaatcaggcccaagctctgccttcgaggacctcccagtctgatgtggaacacagaccagaactcagaaaattgcaacagaatagcatagcctacaggagtatgaggttaggagccaaattggctgagttcaaattccagctgtgccacttgctagctttgagcaagtttcttaagttgctatgcctcagtttcctcatctataaaatggggggaaataataacggcctaccttgtagggttgttttaaggattaaataacttaatacataaaagagcttagaacagtaccaggtataggccaggcatggtggctcacacctgtaatcccagcactctgggaggccgaggcaggcggatcaccaggtcaggagagcgagaccatcctggctaacacggtaaaatcccgtctctactaaaaatacaaaaaattagccgggcatggtggcgggcgcctgtagtcccagctactcgggaggctgaagcaggagaatggtgtgaacctgggaggtggagcttgcagtgagccgagatcgtaccactgcactccagcctgggcaacagagcaagactctctcaaaaaaaaaaaaaacaaacaaacaaaacagtaccagatatatacagtaagtgctcaatggatgtaagcttttgttatttttacagtgctatgatagagcagagaatgggaggctgtgggaatccagacaaatggaccaagcctagcttggagattacagaaggattcagggagaaggtgatgcctaagctgagtcctgaggtagaagggcaaggtttacaggcagcctctcaggccttcttccaatccagcctttagagtccacaccatttgccagaacggtctctctaaacaagtcagaccatgtctctccctgcttaaaatcatgtccacattccccatacctacagattctccacacctacagagtcaagtgtgtccccctcaccagactgtgaccacagaaagccagcatgaagcctggttcctatatctccccacgagtctgtgaaccctgagggctgggaccaggtctggtttgctttgctcctgcaccagactgaccaatgaggagtacaaccaggcctggtctctttgtctcacctaccagatggtgaccctctcagggctcaaatgggtgtgactcatttctgtgtccccagcatcacccagcacacagttgataatcagtatatgaagtggtcctggcagtaaggtctcagggtgagtacttcaaccagtactcgggcagggcagaattgaggcaggtggcatcccaggctgtggtctgaagtcaagccgagcctcttggcctcactggcctgtaatgtaagcagcatttctgaaggagcagactagctgagaagtaggtttctaggactgagatgaaaggtatctgcctggggctggaaacttgtgggggaagtttctgaggggcaaagagcagcaggaccacatcagcccctaattccaccccagggaccgctatccacgcattggagacatcctgcagaaactggcccccttcctcaagatgtatggtgagtatgtgaagaactttgaccgggccgtggagctggtcaacacctggacagagcgctccacccagtttaaagtcatcatccatgaggtgcaggtaagtggtcaagctggaaggagcagacttggggaggagaggtctgcagggatgtggtggggcatctgcagccagatctgagcccctctgcttctgcctgtcacagaaggaggaagcctgtggcaacctgacattgcagcaccacatgctggagcctgtgcagcgcatcccccgctatgagcttcttctcaaggactatctgttaaagctgccccatggctccccggacagcaaggatgcccaaagtgagtgtgtgcacccaggccccttcctacttctccacactaatagctctaggccagacctctgaggcaggaccccaagacttaattcacagggtcggccttccattgccacatgattgaaatcccagaggagaatctccaaactgaaaggcccacattgaggttctgaagtgagaccccaggatgagatcctccttctgaatgttctctttgggtattcaggcagggacctctaagttgagacccctgcctgaatacctgtagagaacattcagaaggagatccccaacctgaacttcccaactggaaccccagagtttgagtggcatgcccattatgatcccctaaaggaactcatccatttcctagatcgagaccccaaggctgacccctagactcacccccaaatgaagttgtaccaaatgagaaaggaaactgagcctgaaacctcagggactgagccaccaagctgagaggccagactgacccctcaggccaagcccacatcacagaatctccacagctgagctccccagaaagagccctggctcatcaattttccatcctccagatttagagctttcctccatgtccgccagccactacccagaatgaacctcccaaaagaacctccaaattgagcaccctagactggaccccaaattttccacctctcaaatttggatctctaggctgagatacctcctccccagactgaatccttacacattgaaccactagaaaagtcttctatcccgattcctccagtatcaacctgaaccccacaccccagatagagctccccccgcctaccccactttctcttccccagattttcattcattcattcattcattagtttaacagctacttactgagcacctccatgtttttgtgcattgttctaggtactggggatatagaggtgaacaaaacagacaaggtccttgatctcagggagcatatattctagtcagcaatgagacacagtaaacaaaaataataaacacacagtagaggccgggcgcagtggctcacgcctgtaatcccagcactttgggaggccaggccgggggatcgcctgaggtcaggagtttgagactagcctggccaacatggtgaaaccccgtctctactaaaaatacaaacattagctgggcgtggtggcgggcacctgtaatcccagctacttgggaggctgaggcaggagaattgcttgaacccaggaggtggaggtttgcagtgagccaagattgcatcactacacttcagcctgggcaacagagcgagactccttctcaaaaaaaaaaaaaaaaaaaaaaagagctgggcgtggtggtgggtgcctgtaattccagctactcgggatgccagggcaggagaatcactcgaactcgggaggcagaggttgcattgagctgtgattgagccactgcactccagcctgggtgacagagcgagactccatctcaagaataaataaataagtaaataaatacacagtagaatattagataggtgctgagtataattcagagaattagaagagggtggcatgacagtggctggagagcctacttgagattgggtggcctgtctgactagaagacagtgagtcaaaacctgaataaaaagaaggtaggcacatgcctgttggggttgagcatgttccaggcagaggccacagcaagtatagggtccaaggcaaggggagatattaggggaggtggggtgctggacaggttgcatatctctggatcaggaagaaggtcagtgtgacctgaacatgacaaataagagtagaatggtagaaatgaggttggagagaggagcaaagactgaaggccaagataaggagatggattttattctgagtatggtgggtagccatgggaaggtttcgatcatgattacttggggagcaagagagagagagctgagagatcagttagaagccttttgcaataatccaagtgagaaaagttggcttggatgaggacagtagcagtagaatcggtgagaaatggttggattcaggatacattcttttcagaagcagcactgagaggactagggtggagtggatgctgggcttgggagcaagagtcaggaatgacttaaaggtttttggctggtggtgatggttcctgagatgatcttaggagtctgactttggacatgttcaaagtgagctgctagtcaggcagttagatgaatctagaatttcagggagagatttggatgtcattggcacatagatagtattccaaagccataaggctggccaagatcaccaaagggagtgagtgtaaaaggaggggaaagggggccaaggacaaagctcagggatgtggaatcaccaaaggagacttagaaggagcagccctaggctgggcgcggtgactcacacctgtaatcccagcacttttggaggctgaggcaggtggatcacaaagtcaggagttcgagaccagcctggccaacatggtgaaaccctgtctgtactgaaaatacaaaaattagccaggtatgatggtgcacgcctgtaattccagctagtcaggaggctgaggcagtagaaccacttgaacccgggaggcagaagttgcagtgagccgaggtggcgccactgcactccagcctgggtgacagagcaagaccccatctcaaaaaaaaaaaaaaaaagaaggagcagccctaaaggtaggaagaaaaccaagaaagtgtggggtcctaaaagccataagaatggggttcgaggccgggcgtggtggctcacgcctataatcctagcaatttgggaggctgaggcgggcagatcacctgaggtctggagtttgagaccagcctggccaagatgatgaaaccccatctctactaaaaatacaaaaattagccaggcgtggtggccgtgcctgtaatcccagctaccctggaggctgaggcaggagaatcgctggaacccgggaggcagaggctgcagtgagccaagatcgtgccactgcactccaacctgagccacggagtgagactccatctcaaaaaaaaaaaaaaaaaaaaagaatgggaagtggacagctgtgtccactgctgtgtccgcttcccaaactgagccttctccaccctgccagatggggcactttgctaccaagcctggacccctagaaagaactaggcctctagaaagtttaatagctaagctctacaagcagacatctgcagcataagtaagtacctcattcctcctgctgaaaaagagccctcactgaggtgccagcctaaacttctagaaagggccttccagactgattgtctgggatgggccctatggactgacatctccaaactgaaccttcatactaagcccattctgaggtcccagttatagatcccaacactggtttctcaaactaagatccccagactgggcctcttcccacctggaatactcttcccacactgagccctgagagtgggttcccagtgagagccttcagcttgaggtccccaaaagagcttcccagtctgatctccttggccaccattctatagacaagtattgccaaactgagcaccctagattaattctcctatttcatatccctcagactgaaactttcagcctgaacttaaaagactgactctccaggtccatcctacagactgaagccccactgagccccaagactggattctctgagttccccagagggaaccctgaaattcagcagcccagactgagctccagacagagattccagattgtgttctccccagcccaagtcccctagactgatgacccctatttttcttttttctttttcttttttttttttttttttttttttttgagacagagtcttgctccgtcacccaggctggagtgcagtggcgcgatctcggctcacggcaacctccgcctccctggttctagcgattctgcagcctcagcctcccaagtagctgggattacaggcacccaccaccgcgcccggctaatttttgtgtttttagtagagatggggtttcaccatcttggccaagctggtctcgaactcctgacctcgtgatccacctgccttggcttccaaaagtgctgggattacaggcatgagccaccgtgcccggccaacgacccctatttttcatttaccagatggagagtcccatgatgagctccaggactaatgccctagattattagactgtcccccaaattaagccacacaggctaagtgcctagtcccatgtccacattgagcttccaggactcagttctgcaattttattttcacactggatccccaacgtaacatccccaggtgaaaattctccaaataagctccctgcactagacccaaagtgagccgccagtgaaagcaacctagagtgggctccagatagagtccattttctcaactgtatatccttgggcaagctgctcagcctctcagcctaagttttctcacatgtagaatggggatgataatgatacctacctcatatggttgttttgagaagtaatgagataatctgggtaaagctcctagcacaatgcctggcacatggtaaaggctcaataaatgttagctgcttttattactaaatgcactggctaatgcccatccctctaaaattggccccaggttgagtttaagaaatttatttattttttatttatttttatttttatttatttattatttttttgagacgtagtctcactctgtcgcccaggctggactgcagtggcgcgatctccgctcactgcaatctctgcctcccaagttcaagcgattctcctgcttcagactcctaagtagctgggattacaggcacccaccaccacgcctagctaaattttgtattttgggtagagacagtgtttcaccgtgttggccaggatggtctcaatctcttgacctcgtgatccacccgcctcgccctcccaaagtgctgggattacaggcgtgcgccaccgcacccagcctatttttatttttattttttttgagactgagtctcgctctttcgccaggctggagtgcagtggcacaatcttggctcactgctgtctctgcctcctgggttcaagtgattcccctgcctcagtctcccaagtagctgggactacaggcacacaccaccatgcctggctaagttttgtattttagtagagatggggtttcaccatgttggccagcatggtctcgatctcctgacctcatgatctgcccaccttggcctctcaaagtgctgggattacaggcatgagccaccgcacccggccttttatttttttttattatttttatttatttatttatttatttttgtattttttttttagtagagacggggtttcaccatgttagccaggatggtctcaatctcctgactttttgatccacccgcctcggcctcccaaagtgctgggattacaggcgtgagccaccgtgcctggcctatttttttttttaagtgaaagtaagtttattaagaaagtaaagaaataaagaatggctactccataggcagagcagcctgagttgaagaaattgagcttcctgttttgtatcaatcccaaccctatctgaggccccaggatgaacctcacagcttgagcttggccaactgagcttccttaatggagcctcccagattgagctccccacatcaagtccaaagatgaaactttgtccccagaaacaacttaccggtctggttttctgagctgttcagaatgagaatctctgaatgagagcccgcctgagatatgcgcactaagatcctcagcccaagatcgtaagctgagctcccaattttttacacctcagactaaattccccaggctgagcctcactgaatcatatgtctggttccccagactgacttgcccactttctactttccagactgcactctggagcctggaccctagaccaatctccccataccaggccatctggaactcctggcctcagttgcctacactgggcccaagactaaactccaaaccaagatcctagactgccaagcccagaccaggccccactaacgcttccaaaccaagcccctacatcaggccccgcagattgcactccctagcctgaacccctaagtgaaattctagactgaaatccccacactgagcccccaggtagggactgtacaccctggatccttggaaatgccagtctgtactccacatgagacatctccagacagagctcgttgtaacaaagcctccagtcagagcccatcagcctacacaggcctgagcttgtgtgcccacaacttgccagagtcttcttcctatccccttccctgggtgccccctacctctaccactcagcctgccccctgccttggggtgggggagatgtaggatgtgtaggagaaaaggcagctgggagatcattcccagctctgatgccaactctgccacccaggtaggcaacctagggtggtcaccttctccctgggtcttggtttcctcattggataaatggggcacaatcatctatgttacagggttgttgtgagggttgaaggagctaatttatccaaagcatctgcctggagagggcagtgggaccttggccctgtcctagggagctcgtagtctactgaggaatatggatgcagatgtataaatacatgatgagcactgtgactagtgggacagaagggagcaaaggagaatgtgagaacccagacagggtcctaacccagcccgagaactctgggcaggctcactggaggaagtgagctggatccagaagacagtgacagttggccagatgaagtaagacgggacatgtttagggaggtgtaggaagctggagtggtcagcagaagccacatcaccaagggctttgagtctttttttttttttttttttttttttgagacgtagtctcgctctgtcacccaggctggagtgcagtggtgcgatctcggctcactgcaacctccacctccagggttcaagtgattctcctgcttcagcctcccgagtagctgggattacaggcacgtgccaccacgcctggcgaatttttataaatttagtagagacggggttttgccatgttggccaggctggtcttgaagtcaggtgatctgcccccctcggcctcctaaagtattgggattacaggcatgaaccaccacgcccagcctcaccaagggctttgaatgtcaggctaaagggctaggtctttaccctgcaggcacaggggagccattgacagatttgagcagaggagtgacagtaaactgtgtgagaaagctccttctggcagctaggatggaataagggttggagattggagcccggcccctgaaaggcatgtggatgcctgagctgggacaggggccatagatctccgtgagcaccaaaacttggtcatgaagagagagcctcttaggaaaacacgacttggttggccagccatatggacctccttcagaagcacctctgctcctctagcacaggctgatctgagtggggagatccagcacatacagaatggggtacacaaagactgtggccaggccttaagcatgggtgggatttattagtgtgtggagatgtacagggactcatttcagctttttctttttttttttttgatgatacctggtcactataggaaatatggaaattacagaaaaagatgaaagaagtaggaaaaaaatcccctgttatctgagcccccagagaataagcacaatgaacattgtgacataaattcttcctggtgttttttagacatgtatacttgtaaaagtaagatcattctatataaacatgtttgtatccttttcttaaaacaccctgagcatttcccagattattaaaagacctacatgaggatcatttgtaaaggttgtttaatgttccattatatgaagacaccataatgtatttaactgaacccctacagttggccattttttttggcagggaagaggtacaggtgaaggtgtgctcccctacagatggacatttttgtttcccacttggaactgttgtaaataccaatatgacaaaaatgtgtttgtgtatagaatgtgtattttcctagaatagatacccagaatcagaatcattgagacaaagaacaggatcatctcattgtttctttatatggctttttctgattataaaagtaatacatgttctttgtcaaaaatacggaaaatacagaaaaacctaaagaagacaataaaaaccacccacggccccaccaaccagagacaacatgggtatgcttccttctggttacatatgtaactattattgttattattaatggtaataataatcttggcaagcttgcatttttttattggctgccaactactccatctattgtgattctggcattgtgacattggacaacttctgattttaaatgatgttgctgtggacatctttgagggtggagctttctgagatgggagggtgtgatcaggccaggaggaggtattcagggaggaaagaagccccgaggccgggtgcggtggctcacgcctgtaatcccagcactttgggaggctgaggtgggtggttcacaaggtcaggagttcgagaccagcctggccaacatagtgaagccccgtctctactaaaaatacaaaaattagccaggcatggtggcacgtgcctgtagtcccagctacttgggaggctgaggcaggagaatcgcttgaacccgggaggcagaggttgtggtgagccgtgatcatgccgctgcactccagcctgggcaacagagtgagactccgtctcaaaaaaaaaaaacaaaaaacaaagccccggaaaggctcctctctgctagtcccccatctgacctcacccctctatgcctgtagagtctctggagctgatcgccacagcagcagagcactcgaatgctgccatccgcaaaatggtgagtggcccttctagcccctgcccttccttggccacccacctgtggtgtctccatcctggagtgggggtgtcgtgacttgtgggcatctgacaggaggctggcaccccaaccgtgccttttgttccctgtcttttgccaggagcgaatgcataagctgctgaaggtatatgagctgttagggggcgaggaggacattgtcagccccaccaaagagctcataaaagaaggccacatccttaagctgtcagcaaagaatgggaccactcaagaccgatacctcatactagtaagtgccaggcatggaattgtgggtgggtcatgcccctcccaacacacacacacatagtgacctggtactcactcaaagactatacctcctttcattcctgaaagaggaaaaaaaagaaaaacagactatacctcctgctagtcattctctcctctagtaacgaattgtattttcactacctagctaggattttttttctccactttacagatgaggcaaataagccttgcagagaagtgacttgcccgaggttccccactaggaagtgtcttccatgcctaggctctttccttgtgacccctgtgcccaatttgggctgtcttttctccatctattgcctacagtccttggcagtaaagcttcagggcaaggagctgggccacatccccactaggccctctgcacatacatcccaaactttttccttcctagttcaacgaccgcctcctttactgcgtgcccaggctgcggctccttggccagaagtttagcgtgcgggcacgcattgatgtagatggcatggaggtaagcatccaagaggtgggaaatgggaacttggagtggggcattggtgttgggaggaacaaagatgctggctttgaccccgagtctgtgtgtgtatgtgtgcagagggctagggccctgtggagttcagtggcctcaccatgcccctttctgcctccattcagctaaaggagagctccaacctcaatctgcctcgaaccttcctggtgtcaggaaagcagcgctccctcgagctccaggccaggtacttatccttgcctatgcctttcctccagcgcctacctcccttttgttcagatatgctgaggcattccaggcccagagattgttccagagaaaggatgggcacctttccccaaagatgcaggcttgctcttcagcggtgggggtgatccctaagggttagacaccatttagattcagggtgagtacttcacgatatggggaaaggtggcactcctgccagggaaaccttttggaaaatgaataagctctccctaattaaaccaagaatttcttctggtggattttgttagaggagagagaagaatgggatgtgaaacccaacatgaataataccaccacaaatagtttattgtagattcacagatctaagagaaataacaatcaaatgcagtacttggtccatgacagaagcctggtttgggaaaaagagccctaaaagacatttgtgggacaataagagaaaatgtggatgtaaagtgaacattagatattgagaaattattgctgtcttaggtgtgataatgttatggtggttatgcaggagaatggccttgttttgcagcagtgcatgctgagggcttagtgtcacaatgtctgttaattactttaaaatggttcagcacccaaaaaatacatatgtaaccatacatacacatttgcacacatatacatacatacacatatacagtcatgcactgtataaaacattttggtcaatgacagaccatatatacacagtggccccataagattaaagtatcatattttactctaccttttctttttttttttttttttttaagacagagtctcactctgtcacccaggagtgcggtggcatgatctcggctcactgcaacctccacctcccaggttcaagcaattctcctgcctcagcctcctgaataagtgggattataggtgcatgccaccacgcccatctaatttttgtatttttagtagagacagggtttcactatgttggccaggctggtttcgaactcctgatctcaagtgatctgcccgccttggcctcccaaagtgctgggattacaggcgtgagtcactacgcctgtctttactataccttttctaggtttagatatgtttacatacccaaataattagtgtgctacaaattaatacaatattcagtacaactgtaacatgctttacaggtttgtagcctaagagccataggctgtaccttatagcctaggtgtgtcgtaggctagaccatctagtgtactagtgtcagtacgctctctgatagtcgcacaacaatgaaatggtctaacgacacctttctcagaacacatccccgtggttaagtgacgcgtgactgtatgtacatatatatgaagtaaatatggcaaaatataaaaaaattttgcatctctatagtaggtatatagatatgtattgtacttgtgctatcctgtttacttttttgtatgcttgaagttttttataataaacattttaaaataatagcatgggatgatggccagccatttaacagaggggcctttcatatccattctctacttcgatgattataatcatagctcatatttcctcaagacttagttttttgccaggtgctgttttaagttaatgttaacttaaaattttaagtctaagttgactagtcaaaagcttacaagagccctagaagtagctactgttaccataaatctactttacaaatggggaaacttaggtgtaggacagttctgcatgcagggcgcagtggctcacgcctgtaatcccagcactttgggaggccaaggtaggaggatcacttgaggccaggagttcgagaccagcctgggcaacataacgagacctcgcctcttaaaaaagaaagaagaaagaaagaaaaagaatatttatgtacttgcccaagatcccagagcaagaaaggagcagagctgagattggagctcaggtcatccggccctggagtccacattcctaaccactgtctatgctgccttctgagggaccaggtgaaagggtatcagggtcatggtgagggccagaggatggatgcatgtcagcagatggcctgcttctgacaggctgtgagaaagtgagaaatgactggctgggactgcaaggaggtgggagagagagatgaatgtgagatagagggtatcctcctgggggatgaagtgagtcttgaagcttggggagattgagagcctcatggaggcctgcagcagggaaagtgagagcaaagcagatgccctgcacatccaggggagtgacaagccacgtgacagggactcatcatctgcagagaggaaaggggctgcagtgggacactgggcccagaaggggcagccaagcaatgtaggatttcctcctagtggcagcaggaaggcatggagggtttgctttgctttgcagtcacttttactgcccttaaaagaaaaaagaaatttaatgcaaattttcaaatatccggaaaagtgtaagtacaacaagcacccagatgcccacaacttagacagctgcttctcaactttggcaacctttggaatcagctggggagcttttaaaaaatacggatgcctgggacccacctgcagagattctgatttaattggcttgggggatagcctgaacatggagagctctaaaagccccccaggtgattttattttactttttaatttttatttatttatttttgagatggagtctcactctgtcgcccaggccagagtgcagtggcgccatctcggctcactgcaacctccacctcccgggttcaagtgattctcctgccttagcctcctgagtagctgggactacatgtgcatgccaccgcgcccggctaatttttgcatttttagtagagacggggtttcgccatattggccaggctggtcttgaactcctgaccttgtgatctgcccggctcggcctcccaaagtgctgggattacaggcatgagccaccacgcctggtccctaggtgattttaatgtgtgtatcagggtgtacaaccacttatttaagagtcaacaactactgacattaaatgtcttttgctgaaccattttaaagtaaattacaaatatcaggacacttcacccctatacacttcagcatgaatagccaaaaaactctactatactgtagttcttttttttttttttttttttttttgagatagggtctctccctgtcatccaggctagagtgcagtggcgttatcatggctcccttcagcctcgaactcctgggttcaagtgatcctcctgcctcagcctcccaagtagctgggaatacaagcatatgccaccatgcccagctaattttcgtattttttgtagagatgaggtctcactatgttgcccaggctggtcttaaactcctggcctcaagcaatcctcccgcttcagcctcccaaagtgctgagatgacaggtatgagccaccactccgtctattgtggctcttaaaaataaaaagcaacacttgttcacttctaagaaattataaattagaaaatatagataaataaaatatttcttttttttgagtcgcagtttctctcttgttgcccaggctggagtggcagcaatggctccatctcggctcactgcaagctccgcctcccaggttcaagcgattctcctgcctcagcctcacaagtagctgggattataggctcccgccaccacgcccggccaatttttgtattttcagtagagacggggtttcaccatgttggctaggctgacctcaggtgatccagccgcctcggcctcccaaagtgctgggattacaggcatgagccgctgcacctggccaataaaataattttttaaaagaatacaatcagaataggccaggcacggtagctcacgcctgtaatcccagcactttgggaggccaaggcgggtggatcacctgaggtcacgagttcaagaccagcctggccaacatggcaaaaccccgtctctactgaaaatacaaaaattagccaggcatggtggcacacacctgtaatcccagctactggggaggctgaggtaggagaatggcttgaatctggaaggcggaggttgcagtaagctgagatcacgccactgcactccagcctgggtgacagggcaagactccgtctcaaaaaaaaaaagaatacagtcagaataaagtgattgcagtgcagtgcagggcagacagaagagtcagggaaggggaacgcacactgattgagcatcgagtgtgccagacattgtgctgagcactgtacacgttacctcggttactgctgagaacccagagagtgataatcattatctccattttacaaatgaaaaaaaaactaccctcttttctcaacttgacacccagcaacagagaattttttttcctttttgagacagagtctcactctgtcacccaggctggagtgcagtgggacgatctccgctcactgcaacctccgcctcctgggctcaagcgattctcatgcctcagccccctgagtagctgggactacaggcatgagccatcacgcccggctaatttttgtacttttagtagagacagaatttcaccatgttggccgggctggtctccaattcctgacctcaagtgatccacccgccttgacctctcaaagtgctgggattacaggtgtgagccacccacacccggccaactgataattattgacacggtttcttttatgttctatattctctcccacacatttcacccttacccctctacctgaggcctagcacctccttgaaaagtcctcacccaaacttcagactggggcatgtcacctcctctgggctccttggccttattttcaccatcaaaacactgatctccctgtattgtccctgtctatttcctctactagaccatgagctccttgagggcagggtcctctctgaagctcaagttcttagcacagggtctggaaagtattagtaatcgttgaataaataaacccaggcagattatgtgacttgcccaaggtcatataagtaataggtgaagaagagggtcaagcccaggtctttctgactccaaaacacctgctcttccactcctattgctttttgtgggcctacctaaccaaacatctttcttttttattccccaccccaaggactgaggaggagaagaaagactgggtccaggtaacatccaaggctctgtggtagggggctagaagagtattaacaggtctcctaggggttgatagattctccctcaaaactcacagctaaccagaatggtcctggacaactgtctttcagcaaactttactatccccattttacagataagcaaactgaggtgcagaggttgagcagaaactcacaaactcttcttttaggaagctggtttctctgagggtgtataaggtgagggtgtcaagctctgtaaaatcttaagcccagaaggtggccaggaaagccacctgaggtttttcagccaccactccccctcccccattttacacttgtaacactgagacctggatttgggaggggatttgttcaaagtcatccacctaccagtgacagaactgggtttgaaacccagcttttctaacttcaggctagggtatacgaaggtgaggcgagggtagaaatgggtagtttgtggggtgatctgacttctcatttcttacacctcctccccaggccatcaactccaccctcctgaagcatgaacagacgctggagactttcaaactgttgaactcaacaaacagggaagatgaagacaccccacccaactctccagtaagagtccccgccctctttcccctgcactgggaccccttccagacttccaaatgcccacctgacctttagatgatcctctccctttcctagacggtaatgaccagagaggcaatgcatgacttcagaagcagtcttccattggtagggccacagagaaatcattggggaaactgaggcccagaaagtataatagaagtgacttgtcttcagtagcacagctaggagcagagccaggacttaaaggcaggtcttctgaatgtggctgctccccctacccccagcccatccccaccccatgataatccaagcgttggagcaggaacaagggctggctggactgggctggggagtagctgtctctgacctgagacctggccctccctacagaacgtggatcttgggaagcgggcacctacgcccatccgggaaaaggaagtcaccatgtgcatgcgctgccaggagcccttcaattctatcaccaaacgcaggcaccactgcaaggcctgcgggcatgtgagtgttgggaggcaggggcagagctagggaggggacagaatggcagcccaaaggcccactgcagagtgggtaccctccaagtggggggaggccacaagtctgctgtgggagttggtatgctgaagggaagacccgctggaatcaggctactcttgcccacttgccaccccaggtggtttgtgggaagtgctccgagttccgggcccgcctcgtctatgacaacaaccgctccaaccgtgtgtgcactgattgctatgtggccttgcacggggtgcctgggagcagtccagcctgcagccagcatacaccccagcgccggaggtccatcctggaggtaagagccagcccctgactaactctcccacagtgggcaaatgggttccaactctacccagtgagactgaggaggcccgagtatttgggaaacagtagtgatcaagggacccaggcttggagtgaataaaatgacggcaagagtgaatgaaagacagtcatctttaagtacttagacatttaatccccacagtaactaatctgcccatgctattgttctctttattttacaaacgaggaaactgaggcccagaggggtcatttgcccaaattacacagcaaatgagtggcagcactggatttttttaaaattaaaaaattggctgggcacagtggctcatgcctgtaatcccagcactttgggaggctgaggcgggtgaatcaccggaggtcgggagttcaggaccagcctgaccaatgtggagaaaccccatctctactaaaaacacaaaattagccaggcatggtggcgcacgcctgcaatcccagctacttgggagggctgaggcaggcaaatcgcttgaacctgggaagcagaggttgcggtgagccaagatcgcgccattgtactccagcctgggcaacaacagcaaaactccgtctcaaaaaaaaaaaaaaaatttaaaaattgtcttttgttattacaaagtaggataagtagaccaatataaacaaaaaataataaaataccgtatcccttctacccaaaagttaccattgtgagggcttatcctatctttctaggcatatatgcacaaacacacattttggagatttttttaaaaacaaatctaggtatttatttaacacttaaaagagtacttactctgtgccaggaactattctaagcactttgcatatattaattcatttaattctcacatcagctctctttgctctccaagtcaatacattttcatctagagctgggattctaagccagacttcattaaccacccacatacccccttaaaaccacaatgctagattacctctcaatgagtgtaggaaatggatgtgatgaaagacagaaaaaagcatgaggcctaaatgtgtgaatggcttgaggaatgaatgctctgactgaagaaagaatgcctgagatccgcacactccttccactggcctgtagaggcagcagccgttgcccaaatgaggcagacgaacctagctttgaatctcagctctagctgattcactgggtggcactggacaaatcactcctgccacctgagcttgagcgtcttcatctgagataggaatagcagtccctacactgaggaggtattaaagctaggaggagccaggctaggccttctgtcaacattgatgcccggtgtctctggccacagaaacaggcctcagtggctgcagagaacagcgtcatctgcagcttcctgcactacatggagaagggtggcaaaggatggcacaaggcatggttcgtggtccctgaaaatgaacccttggtgctgtatatctacggagcccctcaggtatgcatcctactccttcgggtcctttcagccacctggcaaagccagatccagtccttgacctctccttggccttggaagataaggtgagccttggaagataaggtgagcctatctctaagaggaaatcagaaccccaacccttgagagacaaagactggctagagacaaggagtggttgtggtatgtagggaaaaccaggatgagttgtgggcctggcttcctggaaggagtagagatggggaactgctaggtccaatttggagtgggtaagagtatgcagatgggaccgagcgcagtggctcacgcctgtaatcccagcactctgagaggccgaggcaggtggctcacctgagatcaggagttcaagaccagcctggccaacatggtgaaaccccgtctctactaaaaatacaaaaattagcctggcgtggtgacgtgtgcctgtagtcccagctactcaggaagctgaggcaggagaattgcttgaacctgggaggtagaggttgcagtgagccaagttcatgccactgcactccagcctgggcaacagggcaagactctgtctcaaaaaaaaaaaaaaaaaaaagtatgcagataggggcaatagcatagacaaaggcctgaaaacattatttggtatgctaaagagactagcccagcagttttgtgagaagaggcgggggtggggggagacaggtatttaaaccagcctgcattttagccccagttctgacatgttcctgttgataacactggagccacggaaggttcctgagtaggggagttcctgagtaggggactgaagacagagcatatgcaaaaccagttagaagctggggcgggggaaaggtctagccccaaggtggccccagctctgtccctcctcccgccaggatgtgaaagcccagcgcagcctgcccctcattggcttcgaggtgggaccgcccgaggcaggggagcggcctgacagaaggcatgtcttcaagatcacccagagccacctcagctggtacttcagccctgagacagaggaactacagcgacgctggatggctgtgcttggccgggcgggccgaggggacacgttctgcccggggcccacactgtctgaggacagggagatggaggaggcaccggtggctgctttaggagccactgctgaaccccccgaatccccccagacccgagacaagacctagagggtttgggacaaactgggagcccccaccccacactctagttgcccatgtctgattgggggctctagccccttccctcccagctcagtcaatacttgaactcccatcacgggcactttcaatcccgaatgctgggtcttgggttttttaattcatcttttcacaaaacgtgggcttttaaaaaatatattcctacagtgatgtcaatttttattaatccctgtccccagggagggtgggagccgttgccagtcctacctgaattaggtcgtttttctccctcatccctcaataccctaccacagatcctgcctccacccagttccccacaaagcaccagaggtaggagacctggattcaagtgccagctctgccactgaccctggggccccgacccagccctgcctcctcagccagtgtcttcacacgtacaactccacgtggggtggcaactagacctctcctgcctctcccatggcttacagcttctacccggccccaaggctacccagtattttatcgtccagacccatggcagggccagcgggcaggacagggaaacaggggggaggacaatggatactcagttttttgtgtttttttgtgtgtttttttttttttaagaaaaatacagtttatttcaggcttacagtaactttcatagcactgctgtgctccgttcgttcatctgtttggttgtccaaagtaccaggctgctagggtgggcccagaaactgctcccttgtaaactctgaagctgagctcccagaaggctgattctaaggctactactcacaggtcaagccacagattaagcagtaaggtattatttattaagatcttaagcctcacccctgaactcaaatgggatgggataaggagtaaggaaagaggttagaggagacagaaaacaaagcccagctcttccaagctcaccacctagccaaggtcttcgaattcctgagggaacccaggactggaggctgggctgaaggaaggcagcattcctgggaggttccaagttctgggcaggggtacagagctgttgcgtgtgtgtggggtggggtaagggagaggctccagagctactttcattcacattttcaactattctctcttccacttgcatgttcatctcaccattcctgacccagccagccccctatcactgagtactgctgctgctgctgatcctctcctccccaaatccacctgcccactgtccaccggcatctagctcctcctccagccacacccacactcactcatccccttcctcacaatgaccgcacccaaaagacactgtactggggaacccggcttcgtcactcggatgttaactaaaggcccaggggaatatgctggaaaaggtccccccacccccaagaccaaggaccctaggttttccttgccctggagggagccagacagaggaacaggggagagggtggagatggggtaaccagtccacaggtctgcaatcctcaaaaaaaaaacccctacagacaactcttagaacagcaaataagggcccaaagccatttccaatcatccccactcatttttttctccggacaatggtccagccatcttccactatatcctcttccttaatagtctgagcgtctggatcagagggttcaggctgggggcagaccccatctgtagcagccccatcattcgtagctgtgacctggaggggagatttaaaagagagctgaatacactgaccactggagacccaggctctgctccagcttttccaggattggctgtgtaactttaggaaagttccctgccctctctggataatactactaccaccaaccaccaccatccccttatcacttccctgtgaatctagctgctcttccagaaaattgaaaacatctgtatcccccaacccagggggcacccacttcacctccatctcttccacactgtccacatcatcttcatcctcatcagtctctctagctgtcttaagtgcagtggctgtgaccttgcattttctctgagtgatgcaggaggccatctccctcagagcagccccatcacccctctggaagtggtggaacatggtctgcagttgctggctcacctaccaagaaaatattcaaccagtttggattttccagatatctactatacaaacagcacgtgtttgaagcaacagtggggagtaggttggatttttccagaagagaacagagctctttcctccccaaggaattaaccaatgaagcaaccacatatgaagggctcaaatgaaggcctaaagcatcaaaagagagcctaactagcagggaatcctctagaactgggctttgaaagaaataagatgtaaaagggaaggtaatcttattggggagcaatggtaaccagagcgggggtgaaaatggacctggactggcctgacctgcccttgggatggggctgaggaacaggcctggatgggaatgatgtatagaaataaagaaaaggcagggtttggaaaggctacactttttcctctaggcaacagagtcatagtcaagagtcttggcccaaaacagacagctggggagaagaaagactacaggtagggagactgcagttgtgcccgtgataagctcacctggggcagactcccgtcttccacaactgtatcaaa
